United States Patent 9,254,311 (MODIFIED POLYNUCLEOTIDES FOR THE PRODUCTION OF PROTEINS) - sequence listing, part 4

SEQ ID NO: 3423 - DNA, 1152 bp, Homo sapiens
atggggcctttgttcaccaccattcctggtgcccattctggtcccatgcgtcctctgcccaagaaacacgtagaacccatggcagtgcgacagctgcttcttggcaactccaccatgatcaggcacacttgtcccatgtctgtcccgttgagccggcaagtcaaggaagttgctgcccagaaaccaagtgaggacatttacaagaactggcagcagcagcagcagcagcagcagcagcagcagcagcagcaactggatttgctttttcaccagaggatccagatttccctgtggcctcgcaaacaaaaaagaaggaagacggagcagcacagtcatccctttgtgaaaaaggcattcaggttctccgccggctctggctgcgggcggccctcatctaacaagatgcttcggtccatgggtggaggacaaaggcctacgggcttggggagcgagttctttcgtctcctacatgaccttcatctgctcgcgtttgccatgaagcgcatctggatccaccggaggggcgaggccacagctcgaccgcgagcacctgagcatcctgcaccgcctgcgacggccgtcagggggcgcgatgccgcctcacagaacctcaagcggcgcccgggttccggcacagacggcctgcggctccagggggcggagccgagccgtctcctcaggacctacgcaggaggcgccgtcatccctacagggacacctgagagggcccagcctcctcctcctcaggacccactcgggagacgccgctggctctctaggaacacctggggaccgtggccagggacgacccagcctccttctcctcagctcctcaggaacgactggggaagctgtggcttcatggtccccgaggctgcccgaggaaaggtatttcaggacagccaggagggggcgcacatccgccgagaaactgtgagcaagagcgtctgtgctgaaccatggcgccaccagagggcgcgcgatcccgccccaaccaacttcccgctgaggtgccagaagcagcgaggagcttcagcttcctcagggcagcacgagggtcgtgttaacttggtgttcttcattggttccccaacagttattgctgtaccagatttgcagtgtcccacaaaatactccggtatgttgtactga

SEQ ID NO: 3424 - DNA, 835 bp, Homo sapiens
gtcgcggccgccagctaggggcgcgggaaggcggggctcggatgcaatcgggacctcctcctggactgggccgggggcggactccgggacccagggcgccgggagccggcgggctacctgcgagtcgagttagcgttgtcgccgaaccgaagcctcgctcgccatgggggaggtggagatctcggccctggcctacgtgaagatgtgcctgcatgctgcccggtacccacacgccgcagtcaacgggctgtttttggcgccagcgccgcggtctggagaatgcctgtgcctcaccgactgtgtgcccctcttccacagccacctggccctgtccgtcatgttggaggtcgccctcaaccaggtggatgtgtggggagcacaggccggtctggtggtggctggttactaccatgccaatgcagctgtgaacgatcagagccctgggcccctggccttgaaaattgctgggcgaattgcagaattcttccctgatgcagtacttattatgttggataatcagaaactggtgcctcagcctcgtgtgcccccggtcatcgtcctggagaaccaaggtctccgctgggtccctaaggataagaacttagtgatgtggagggactgggaagagtcacggcagatggtgggagctctactggaagatcgggcccaccagcaccttgtggactttgactgccaccttgatgacatccggcaggactggaccaaccagcggctcaacactcaaatcacccagtgggttggtcccactaatggaaatggaaatgcctgagccagggccagcggggcccggttccaataaagagacttgggctga

SEQ ID NO: 3425 - DNA, 953 bp, Homo sapiens
gcggccgccagctaggggcgcgggaaggcggggctcggatgcaatcgggacctcctcctggactgggccgggggcggactccgggacccagggcgccgggagccggcgggctacctgcgagtcgagttagcgttgtcgccgaaccgaagtgagagggcacggggaagggtcaaagagcgtgccgaagcgctggagggagcttcacggacgcgagctaggcaccggctcgcctaatccggtactaatccggcttgctgcttcccgtccaggcctcgctcgccatgggggaggtggagatctcggccctggcctacgtgaagatgtgcctgcatgctgcccggtacccacacgccgcagtcaacgggctgtttttggcgccagcgccgcggtctggagaatgcctgtgcctcaccgactgtgtgcccctcttccacagccacctggccctgtccgtcatgttggaggtcgccctcaaccaggtggatgtgtggggagcacaggccggtctggtggtggctggttactaccatgccaatgcagctgtgaacgatcagagccctgggcccctggccttgaaaattgctgggcgaattgcagaattcttccctgatgcagtacttattatgttggataatcagaaactggtgcctcagcctcgtgtgcccccggtcatcgtcctggagaaccaaggtctccgctgggtccctaaggataagaacttagtgatgtggagggactgggaagagtcacggcagatggtgggagctctactggaagatcgggcccaccagcaccttgtggactttgactgccaccttgatgacatccggcaggactggaccaaccagcggctcaacactcaaatcacccagtgggttggtcccactaatggaaatggaaatgcctgagccagggccagcggggcccggttccaataaagagacttgggctga

SEQ ID NO: 3426 - DNA, 847 bp, Homo sapiens
ggggacagctaaggtctccaggctgctgatgaagtgagggaaagtggaggagagtcggcgccgagatgggcggataaaaggagcgaccgctcagcagcgagagggagaggcgagagtaaggcgcccagacaccatgtggacaaggggaggagagaaatcagaggtggcgcgcgaaggctgagcgcccaggcagccagagcccagatcggaagagccgagtccgggcagaggggtccgcgggctctggaggtgctggacgggtgcgatccgagagcagaccggggccctcgcgagcctctcccggcccctgcccgcgatgagcgaggccagccgactgtgctccggctactacagcctcaaccagagcttcgtggagcccttccagtgcccccggcgcggcgagggggcagcgctccagtattgctgcggcttcgccgacctcaagtactgctgcagcgagccgggcagctacttcccctacaagcacagctacatgtggagcctcagcattggtgccttgattggactaggaattgctgcccttgttttactcgcctttgtcatcagtgtctgtgtcctttgctatttatttctgtatacgaaacctcaaagattagacactggccttaagcttcaacacttagaggcttcttccactcaagaaggcaagtcaaatggaaaaaccaaagccctcaattcaaatgcagcatcaaatgcaacaaatgaaacatactatgaagctgatgatataattcaagaaaaaacaatggatgcaacacaaatccacattgcttattaactaaaaattctgtgttttaaatgcttactggagagatgggacaataaa

SEQ ID NO: 3427 - DNA, 4576 bp, Homo sapiens
acattcttcccgggcactcctgagtttgagccgggcctggaggacctgggccaagactttcgagcggcggccgcccgaggtgcgaggagccagcccggctttcctcactgggtcccgcgcaggcgtccccgggaccgcagagcaaactttctggactatctgaggacacttgtccagcgagccccactgctcggggaggaggagccacggccggggacaggtgatacacttgggtgttgaaggacatttttgaaatcatgagaactcaatgtttgactatgaatgtttcgttataactgcctggaaggttagcgtcaaagaagttgagatttttaaagtcttcttctaggggtttccagcagagccaaatgttagaaaaatctttccgctcctctgaagagtgaagtgagcaaatacaacccagcagtaggttattgaagacagcagccccaggttttggaaggtgacaatgaaatgtgaagaagttacatttctcaaacttgaaagttagtgacggcttaccaaattttaatgaaaattaaatatgacttagaagcattgatttatgaaggcttatgatgtcatcggtttcgacagaaagcaaactccagcaggctgtgagcctacagggagttgacccagaaacatgcatgattgtatttaaaaaccactgggcacaggttgtgaaaatcttggagaagcacgaccccttgaagaacacccaggcaaaatatgggtctatccctccagatgaggccagtgccgtgcagaattacgtagaacacatgctcttcttgttgattgaagagcaagccaaagatgctgcaatggggccgattctggaatttgtggtctctgagaacatcatggagaaacttttcctttggagcttgagaagggagtttactgatgagactaaaattgagcagctaaagatgtatgagatgttggtcacccagtcgcaccagcctctgctgcaccacaaacccattctgaagcctctgatgatgttgctgagctcttgttcaggaacaaccacccccactgtggaggagaagctggttgtcctactcaatcagctctgttccattcttgccaaagatccatccattttagaactcttcttccacactagtgaagaccaaggcgctgccaacttcctcatcttctcccttctgattcccttcattcaccgagaggggtcagtaggccagcaagctcgggatgcattgctcttcatcatgtctctttctgctgagaacaccatggtggcccatcacatcgtggagaacacctacttttgtccagtacttgcaactgggctcagtggtctctactcttccctgcctacaaagctagaagagaaaggcgaggaatggcactgccttctgaaagatgactggcttctacttccttctcttgtccagttcatgaactccctggagttttgcaatgcagtcatacaggtggctcaccccttgattcgaaatcagcttgtcaattacatttacaatggatttttggtaccagtcttggctcctgctctccataaggtgactgtggaagaggtcatgaccacaactgcatatctggaccttttcctgcgtagcatctccgagccagcactacttgagatcttcctccgttttatcctattgcaccagcacgagaatgtccacatcctagacactctcacgagtcgaatcaacaccccgtttcggctttgtgtggtgtctctggcattattcagaactctcattggtttacattgtgaagatgtgatgttacagctagttctaaggtatctgatcccctgcaatcacatgatgctgagtcagaggtgggctgtgaaggagagagactgttactctgtttctgcggccaagcttctcgccttgactcctgtctgctgctccagcgggatcactctgacgctggggaaccaagagagggattatattctctggtcaaagtgtatgcatgacacttcagggcctgtggagcggccattccccgaagcgttctccgagtcagcctgcattgtggagtatgggaaagccctggacatcagctacctgcagtacctgtgggaggcccacaccaacatcctccgctgcatgagggactgccgtgtctggtccgccctgtatgatggcgactcccccgaccctgagatgtttctccagagtctgacggaggagggcagtgtgagctcggcctgccctgtgttcgggctcccgcaacaactccccaggaagacaggacctcagctggctcccagaaaggacaagagccagacagagctggaatgggatgacagctatgacactggaatctcctcaggggctgacgtgggctccccagggccttatgatgatctggaggtttcaggccccccagcacccattgatccccccaaacacatccaggagatgaagaagaatgccctcctgctcttcaaagggtcctacatagaagagtcggactttcaggatgatgtgatggtgtacaggctgtgtgctgagaaggactccgaggacatgaaggattctcaggaggaagctgctaggccaccagctgaagcccaggctgaagttcagagtgtccccatcaacaacggccccctcctcagcacccagccagagacagattcagaggaggagtggaatagggacaattcagacccgtttcacagtgagcccaaggagccaaagcaagagagggaacctgaagcagccccagaatccaactcagagttagcatcccctgcccctgaggcagagcacagctctaacctgacagccgcccacccggagagcgaggagctcattgcccagtatgaccaaatcattaaagagctggattccggcgccgagggcttgatggaacagaattaccccacacctgatcccttgcttctcactaaggaggaagaagggaaggaagagagtaaaggagaaaaggagaaggaggggaagaaggagctagaagatgaggaggatgactttgactcttttatagcggagatgcctgctgtagagactgtgccttccccatttgtggggagagatgaggctgcctttgccagtcgccatcccgtgaggactcaaagcaccccattcacaggcccattcatcagcgtagtcctgtcaaagctggagaacatgctggagaactctttacatgttaatttgctgcttatcgggatcattactcagctagccagctacccccagccactcctgcgctcctttctgctcaacaccaacatggtcttccagccaagcgtccgctctctctatcaggtccttgcatctgtgaaaaacaagattgaacagtttgcttctgtggagagagacttcccagggctcctcattcaagctcagcagtacctgctcttccgtgtggacatgtctgatatgacccctgcagcactaaccaaagatcccattcaggaggcttccaggacaggaagtggcaagaaccttttggatggacctccaagagtgcttcagcccttcctgacccacagaaccaaggtggctgaggcaccccccaacctgcccctgccggtgaggaaccccatgctggctgctgccctcttcccagagttcctgaaggagctggcggccttggcccaggaacactccattctgtgctacaagatcttgggtgactttgaggactcctgctgttagcttttttttttttttttaatagaggttcttgttttgtaaggttttagtgtcttgactgaatgttaaatgcaaagctgcttacaaagatttctactttaatgtttcctgacaatacttgatttgtggggaggggaattttctgtatctttcctctctctctctagccgggcctttccaccttatgttatatatagaatgtaagtctcataagctggttgctcccttggcagttttctttgctctgtttttcctccttatatttttttggttgtcattctcctatccctttgagttactcttcttgcagctcagatcacgtcaagcagatattggggttcagtgatgtctggtgatgtctggaagtgccccatgtcagaattccagctgttcagcagcacaggaagattgtacacctgcaactgtgcgaatggtcctgttgcctcctgcattttggcctctgttctataaaggaagagtaaagatggagctcctcctgcctccatcacgaaagcacatatcatctgtccctttggattttacttccaggacgtgtgtcgtccccagcgtgtgttgccttatggtgccggcagagcctcagctatctgcctgggaagtcggatgtccttggagagaatttggaatgcagataatttttcttatttcttgagagcttactttaatcagcatgacactacctaaacactgaagatggccttatattagtaagatttgcacaaaattaagtatacctatgcaaactattactttggtttttaggagtttgatcagatgaagaagtaatggtatcacatatatatgtaagaagacaaccatcattatttttgtaagtgttttataaaaacaaactgattaacttg

SEQ ID NO: 3428 - DNA, 570 bp, Homo sapiens
acattcttcccgggcactcctgagtttgagccgggcctggaggacctgggccaagactttcgagcggcggccgcccgaggtgcgaggagccagcccggctttcctcactgggtcccgcgcaggcgtccccgggaccgcagagcaaactttctggactatctgaggacacttgtccagcgagccccactgctcggggaggaggagccacggccggggacaggtgatacacttgggtgttgaaggacatttttgaaatcatgagaactcaatgtttgactatgaatgtttcgttataactgcctggaaggttagcgtcaaagaagttgaggttttggaaggtgacaatgaaatgtgaagaagttacatttctcaaacttgaaagttagtgacggcttaccaaattttaatgaaaattaaatatgacttagaagcattgatttatgaaggcttatgatgtcatcggtttcgacagaaagcaaactccagcaggctgtgagcctacagggagttgacccagaaacatgcatgattgtatttaaaaaccactgggcacaggttgtgaaaatcttg

SEQ ID NO: 3429 - DNA, 4156 bp, Homo sapiens
cagccaaaccatatcaaccttattgatgtttttgcaggttttggaaggtgacaatgaaatgtgaagaagttacatttctcaaacttgaaagttagtgacggcttaccaaattttaatgaaaattaaatatgacttagaagcattgatttatgaaggcttatgatgtcatcggtttcgacagaaagcaaactccagcaggctgtgagcctacagggagttgacccagaaacatgcatgattgtatttaaaaaccactgggcacaggttgtgaaaatcttggagaagcacgaccccttgaagaacacccaggcaaaatatgggtctatccctccagatgaggccagtgccgtgcagaattacgtagaacacatgctcttcttgttgattgaagagcaagccaaagatgctgcaatggggccgattctggaatttgtggtctctgagaacatcatggagaaacttttcctttggagcttgagaagggagtttactgatgagactaaaattgagcagctaaagatgtatgagatgttggtcacccagtcgcaccagcctctgctgcaccacaaacccattctgaagcctctgatgatgttgctgagctcttgttcaggaacaaccacccccactgtggaggagaagctggttgtcctactcaatcagctctgttccattcttgccaaagatccatccattttagaactcttcttccacactagtgaagaccaaggcgctgccaacttcctcatcttctcccttctgattcccttcattcaccgagaggggtcagtaggccagcaagctcgggatgcattgctcttcatcatgtctctttctgctgagaacaccatggtggcccatcacatcgtggagaacacctacttttgtccagtacttgcaactgggctcagtggtctctactcttccctgcctacaaagctagaagagaaaggcgaggaatggcactgccttctgaaagatgactggcttctacttccttctcttgtccagttcatgaactccctggagttttgcaatgcagtcatacaggtggctcaccccttgattcgaaatcagcttgtcaattacatttacaatggatttttggtaccagtcttggctcctgctctccataaggtgactgtggaagaggtcatgaccacaactgcatatctggaccttttcctgcgtagcatctccgagccagcactacttgagatcttcctccgttttatcctattgcaccagcacgagaatgtccacatcctagacactctcacgagtcgaatcaacaccccgtttcggctttgtgtggtgtctctggcattattcagaactctcattggtttacattgtgaagatgtgatgttacagctagttctaaggtatctgatcccctgcaatcacatgatgctgagtcagaggtgggctgtgaaggagagagactgttactctgtttctgcggccaagcttctcgccttgactcctgtctgctgctccagcgggatcactctgacgctggggaaccaagagagggattatattctctggtcaaagtgtatgcatgacacttcagggcctgtggagcggccattccccgaagcgttctccgagtcagcctgcattgtggagtatgggaaagccctggacatcagctacctgcagtacctgtgggaggcccacaccaacatcctccgctgcatgagggactgccgtgtctggtccgccctgtatgatggcgactcccccgaccctgagatgtttctccagagtctgacggaggagggcagtgtgagctcggcctgccctgtgttcgggctcccgcaacaactccccaggaagacaggacctcagctggctcccagaaaggacaagagccagacagagctggaatgggatgacagctatgacactggaatctcctcaggggctgacgtgggctccccagggccttatgatgatctggaggtttcaggccccccagcacccattgatccccccaaacacatccaggagatgaagaagaatgccctcctgctcttcaaagggtcctacatagaagagtcggactttcaggatgatgtgatggtgtacaggctgtgtgctgagaaggactccgaggacatgaaggattctcaggaggaagctgctaggccaccagctgaagcccaggctgaagttcagagtgtccccatcaacaacggccccctcctcagcacccagccagagacagattcagaggaggagtggaatagggacaattcagacccgtttcacagtgagcccaaggagccaaagcaagagagggaacctgaagcagccccagaatccaactcagagttagcatcccctgcccctgaggcagagcacagctctaacctgacagccgcccacccggagagcgaggagctcattgcccagtatgaccaaatcattaaagagctggattccggcgccgagggcttgatggaacagaattaccccacacctgatcccttgcttctcactaaggaggaagaagggaaggaagagagtaaaggagaaaaggagaaggaggggaagaaggagctagaagatgaggaggatgactttgactcttttatagcggagatgcctgctgtagagactgtgccttccccatttgtggggagagatgaggctgcctttgccagtcgccatcccgtgaggactcaaagcaccccattcacaggcccattcatcagcgtagtcctgtcaaagctggagaacatgctggagaactctttacatgttaatttgctgcttatcgggatcattactcagctagccagctacccccagccactcctgcgctcctttctgctcaacaccaacatggtcttccagccaagcgtccgctctctctatcaggtccttgcatctgtgaaaaacaagattgaacagtttgcttctgtggagagagacttcccagggctcctcattcaagctcagcagtacctgctcttccgtgtggacatgtctgatatgacccctgcagcactaaccaaagatcccattcaggaggcttccaggacaggaagtggcaagaaccttttggatggacctccaagagtgcttcagcccttcctgacccacagaaccaaggtggctgaggcaccccccaacctgcccctgccggtgaggaaccccatgctggctgctgccctcttcccagagttcctgaaggagctggcggccttggcccaggaacactccattctgtgctacaagatcttgggtgactttgaggactcctgctgttagcttttttttttttttttaatagaggttcttgttttgtaaggttttagtgtcttgactgaatgttaaatgcaaagctgcttacaaagatttctactttaatgtttcctgacaatacttgatttgtggggaggggaattttctgtatctttcctctctctctctagccgggcctttccaccttatgttatatatagaatgtaagtctcataagctggttgctcccttggcagttttctttgctctgtttttcctccttatatttttttggttgtcattctcctatccctttgagttactcttcttgcagctcagatcacgtcaagcagatattggggttcagtgatgtctggtgatgtctggaagtgccccatgtcagaattccagctgttcagcagcacaggaagattgtacacctgcaactgtgcgaatggtcctgttgcctcctgcattttggcctctgttctataaaggaagagtaaagatggagctcctcctgcctccatcacgaaagcacatatcatctgtccctttggattttacttccaggacgtgtgtcgtccccagcgtgtgttgccttatggtgccggcagagcctcagctatctgcctgggaagtcggatgtccttggagagaatttggaatgcagataatttttcttatttcttgagagcttactttaatcagcatgacactacctaaacactgaagatggccttatattagtaagatttgcacaaaattaagtatacctatgcaaactattactttggtttttaggagtttgatcagatgaagaagtaatggtatcacatatatatgtaagaagacaaccatcattatttttgtaagtgttttataaaaacaaactgattaa

SEQ ID NO: 3430 - DNA, 548 bp, Homo sapiens
atacaacccagcagtaggttattgaagacagcagccccagtgaaattctagagaatccaagaacaagttaatcctcagtgttgattagcagcattagtgagcatggagaaaatggatcactagttattggagtttaaagcagtacaacttttgaggagtccgtttacatcaaaagccttcagatattcctactctttgagctgatgtttccacttctgggattctaattgaaggacaaaatcatgggttttggaaggtgacaatgaaatgtgaagaagttacatttctcaaacttgaaagttagtgacggcttaccaaattttaatgaaaattaaatatgacttagaagcattgatttatgaaggcttatgatgtcatcggtttcgacagaaagcaaactccagcaggctgtgagcctacagggagttgacccagaaacatgcatgattgtatttaaaaaccactgggcacaggttgtgaaaatcttggagaagcacgaccccttgaagaacacccaggcaaaatatgggtctatccctccagatgag

SEQ ID NO: 3431 - DNA, 401 bp, Homo sapiens
actgggtcccgcgcaggcgtccccgggaccgcagagcaaactttctggactatctgaggacacttgtccagcgagccccactgctcggggaggaggagccacggccggggacagatttttaaagtcttcttctaggggtttccagcagagccaaatgttagaaaaatctttccgctcctctgaagagtgaagtgagcaaatacaacccagcagtaggttattgaagacagcagccccaggttttggaaggtgacaatgaaatgtgaagaagttacatttctcaaacttgaaagttagtgacggcttaccaaattttaatgaaaattaaatatgacttagaagcattgatttatgaaggcttatgatgtcatcggtttcgacagaaagcaaactccagcagg

SEQ ID NO: 3432 - DNA, 565 bp, Homo sapiens
agcaaagcttagagtccctctaagctgaacatctacaacacttctcttctggctctcattctaccttgtggctacagttactggtgatacacttgggtgttgaaggacatttttgaaatcatgagaactcaatgtttgactatgaatgtttcgttataactgcctggaaggttagcgtcaaagaagttgagatttttaaagtcttcttctaggggtttccagcagagccaaatgttagaaaaatctttccgctcctctgaagagtgaagtgagcaaatacaacccagcagtaggttattgaagacagcagccccaggttttggaaggtgacaatgaaatgtgaagaagttacatttctcaaacttgaaagttagtgacggcttaccaaattttaatgaaaattaaatatgacttagaagcattgatttatgaaggcttatgatgtcatcggtttcgacagaaagcaaactccagcaggctgtgagcctacagggagttgacccagaaacatgcatgattgtatttaaaaaccactgggcacaggttgtgaaaatcttggagaagc

SEQ ID NO: 3433 - DNA, 666 bp, Homo sapiens
gaaggaacccgagccgggctgccaccgtgtcccaaccggtgccgccgccggagcttctccgggccccgagtcctcgccgaacgccctcctcgccgcccgccgcgtcccggcgccctccggagccgccgagccgcccgcgcacacctgaagcggccgggccaggccctgcctcgatcctcagctcgtcctccccgccccgcaccggccttcactctggagcggccccggcagccgcagcaggggcggcggcggcggatcgaggagctctccaggtcgtcccgggagaggctgctgcagtcccgggacaggatgttctccaagttcacctccatcctgcagcacgccgtggaggcgcttgcaccttctcttcctttacaagaagattttgtttatcactggaaggcaattacccattactacatagagacttcagatgataaagccccagtgaccgatacaaatattccatcgcatctggaacagatgttagatatactggttcaagaagaaaatgaacgggaatctggagagacagggccatgtatggaatatttgcttcatcacaagatcttggaaacattatataccttggggaaagctgatgtaagttcctgatccacaccatgttcttgggcattagtacatgcattaatgtcttacgaataa

SEQ ID NO: 3434 - DNA, 5806 bp, Homo sapiens
gcaggccgcggcgggcagagcggggggaaggaacccgagccgggctgccaccgtgtcccaaccggtgccgccgccggagcttctccgggccccgagtcctcgccgaacgccctcctcgccgcccgccgcgtcccggcgccctccggagccgccgagccgcccgcgcacacctgaagcggccgggccaggccctgcctcgatcctcagctcgtcctccccgccccgcaccggccttcactctggagcggccccggcagccgcagcaggggcggcggcggcggatcgaggagctctccaggtcgtcccgggagaggctgctgcagtcccgggacaggatgttctccaagttcacctccatcctgcagcacgccgtggaggcgcttgcaccttctcttcctttacaagaagattttgtttatcactggaaggcaattacccattactacatagagacttcagatgataaagccccagtgaccgatacaaatattccatcgcatctggaacagatgttagatatactggttcaagaagaaaatgaacgggaatctggagagacagggccatgtatggaatatttgcttcatcacaagatcttggaaacattatataccttggggaaagctgattgtcctccgggaatgaaacagcaggttttggttttctatacgaaacttctgggaagaatccggcagccactacttccacacattaacgtgcacaggccagtgcagaaattaattagactctgtggtgaagtcctagcaacaccaacagaaaatgaagagattcagtttctttgcattgtgtgtgcgaagctgaaacaggacccctacctggttaactttttcctagagaataagatgaaatcattggcttccaaaggagtaccaaatgtaatttcagaagatacattaaaaggtcaggattccttgtcaacagatacaggacagtcccgtcaaccagaggaactatctggtgctactggaatggagcaaacagaattggaagatgagcctcctcatcagatggatcacctgtccacaagcttggataacctcagtgtcacctcactgccagaggcctcggttgtttgtccaaatcaggattacaatttagtgaattctttgttaaatcttactagaagtcctgatggcagaatagctgtgaaggcatgtgaaggcttgatgctgttagtaagtttgccagagcctgcggctgcaaagtgccttacacagagcacttgcttgtgtgaactactgacagacagacttgcctccctgtacaaggccctacctcagtcagtggatccgttagatattgaaaccgtggaagcaattaactggggcttggactcatatagtcataaagaagatgcttcagcatttccaggaaaacgagccttaatttcatttctttcctggtttgattattgtgatcagctcattaaggaagcccaaaagactgctgctgttgctcttgccaaagctgttcatgaaagatttttcattggtgttatggaacctcaattaatgcaaacttctgagatgggtattctcacatccactgctctgcttcatcgcatcgttcggcaagtgacctctgatgttttgcttcaagaaatggtgttttttatccttggagaacagagggaaccagaaactctggcagaaatcagcagacatcctttaaggcataggttaattgaacattgtgatcacatatctgatgagataagcataatgacattacgaatgtttgaacatcttttacaaaaacccaatgagcacattctttacaacttggtcttgagaaatcttgaagaaagaaattatacagaatataaacctttgtgcccagaagataaagatgtggtagaaaatggattgatagcaggagcagtagatctggaagaagatccattatttactgacatttcaccagaaaacactttgccaaaccaagagtggcttagttcttcacctcctgctactccagaccaccccaaaaatgatggaaaaactgaagttcataaaattgtaaatagttttctctgtctggtaccggatgacgcaaaatcctcctaccatgttgagggcacaggatatgacacttacctccgagacgctcataggcagttccgagactactgtgctatctgcttaagatgggagtggcctgggtctccaaaagcattggaaaagtgcaatttagaagctgctttctttgaaggtcattttttgaaagtgctgttcgacagaatgggaagaattcttgatcagccatatgatgtaaacttacaagtaacctcagtgttatctagactttctctcttccctcatccacacatccacgagtaccttttggatccttacgtgaacctcgctcctggctgtagatctctcttctctgtaattgtcagggttgttggagaccttatgcttcgaatccagcgtattcaagactttactcccaagcttctgttagtcagaaagcggttacttggtttggaacctgaaggccctattattgaccacatcacactgctagagggtgtgattgtgttagaagagttctgtaaggagctggcggcaatcgcatttgtaaaatatcatgcttcctccacaccataaataacatctttcatgtaactgggggaacagaactactgtgtacatttcaccaaaaaagactcagttccacccagccacaagaggataaaaagcctttttaaacgcagtattgctgtaaactggacagaaccattaagaacctattgagtggacattcttggtgaaatgttgtataatgttgttttcattggctttatcataatggttctatatatacaattgcacattgttgaatccaggatacaatcaaaggaacttcaggaaataagcatttctaatgactgtgaaaagctgcaatatttccaatgtcatgactttgatgatatttctgttatattaatgtccttttaggtagcaaggcattttgacattctctgggactcaaatgcttgtattcttttggattaataagtagcaaaaaaaaatcactaattttataactttttaaggtcagaattcttatcaaacaaaatatgaaaactgtaaatgagaaaaaaatacaattcagaaaccattgaatgaattaattataggcgataaaaatgtgtagagcaccattaactttcttcagcttttttaagaataacaatttaatatgataaattcttgattaatataatatatctatatttttaaagaaatgttcttttactcttttgtgcacatagccatgttagtgattttcttcatgtgtgggtcccagtttatttaaactgtgtcgttttcgcagcagtgttcaatttgctcaccattggtagtgtttgctaaaattgtatttttttaagctaagtaacatgtactgggttgagaacctttttcccccctctccctctcagaaaattgctttataaaattgctttataatttgattttcttactgaaacgcatggtggtgtctaggtggggaactgactgataacccttggcagcaatcaaagtgccagtggctcctcgatgtttacatttttttctattttgttcagtcttttgttttaaatgattctaaagagattaaagaaaacagagttttaaatgtcctatttacatgttaaaggatttggggaaattgggtatgtatgtgaatgggtgtacatgtaggaacctgtagttcagcaaagctgcgctgggcacagcatgcttgtacttgattgacaaaatcgtgtttgccagtccactttctatttttcctttaagtgatgctgatcactcaaataatgcttttaagctattgtttgtttttatttgacatgttaagccgcagcactttcttcttcatctttccatttactgatatttgggggaacaggctatcaaaggttccggcttgaagggaactgtcactaccccctctaggaagttattttatgtagcatgtttgcatatacgcattgtgtggcatgtgcatagaggcttgttttacacctatctgctcattttgttgtgttagcttttctggtttatttcatagtttgttcttgctatttattaagaacagaatatcaaaagattatgaatagcctcagctctagaatgcttaccactgttaaaacaacaaaaagactaaacctctaatttcatgcaaatctttgttagcttattctaagaaatttattaagtaaaacaaagaaaaaacagaagtgggagatagttattttgtgcgtaattttctttaaatcattttgaatgatgtgaaggcattcagtttgctgtatttttttaatcacttcatacaaggaaaacttcgacatttacatttctagatgtagtaacagtctactttgatatatgagtatttaaactaaggcattaagagatattagatatttcttaatgttttcatagtgctcaataggtgtagtagcaatgatattacctctgaaaccaaatactcttttatccttgattccactatgggaccttataactagtccatgaaaccaagctcagaaaagctttaactcttatatttgtgtatatgtatgctgcttctgaaaatataatttttctaagttgttgtaatgactttaatttgtaatcagctaaggcttaagatttcatttgtttctaagtttctgtttttcatcccttcttttttcttttatatttagttcagacctagagccagtagaagctctcacagtgagttcaatttgttagtgaaacattgtactgcatcaccagtttttcttaccttctgttgacagctgaatatttctgttactcagtacttgcaaaaacagtaactaaaatgcactatgctgagtggaaagcaccgtcataacaattgattgccatagcaagttccaaagtgaatttcagccttgcttcacatttgtatcaataaatatgcacattttttaaaactttctaacaatatagtctttggatttgtttttagttatgagccgcattctttacttgatagaactcagatttgtcttagcctattgccatatagtactcaccttataactatgtaactttctcgtaatgtatctgtttgtgcaatatggaagctgtgagtggattcatagctttttggtttaattgtacattattgtgtgtgtatatatgtatatatgtatatatataaggaccaaaattcttagctcgcttacactgttgctagtgtaaacattgttacacttaattttacagggcacaaattatggaattacttcataaattcatggtaatgttttcataaattattgcattaacatacaattgccatttaattatgaagtccatcagtattgacagaagacgttacagtgaagtgctaaaaccacactatatggtaattatattttgggttatgtagtaaatcaaatatgcatgtcattgtgacactttatgtgttaaaacatggtagataatcacattttctgggccctgtaaaatagtgttactgtaatactctgttttgcctcctgccttgtttacattaaacaggatatttggtaaatttttttgtattgaaagttgtgtaggttactgacagtgttaccagcgtctggaattcttggtccctccgtggagaaactcttcagatggtcattgtgtacctactctctcttcaaaggaagttgtgatcaagttcaactttttgtgctaacaatgcatgcaggactaagagggatgatctaaaaaataaataatgtaatttaaac

SEQ ID NO: 3435 - DNA, 2870 bp, Homo sapiens
gcaggccgcggcgggcagagcggggggaaggaacccgagccgggctgccaccgtgtcccaaccggtgccgccgccggagcttctccgggccccgagtcctcgccgaacgccctcctcgccgcccgccgcgtcccggcgccctccggagccgccgagccgcccgcgcacacctgaagcggccgggccaggccctgcctcgatcctcagctcgtcctccccgccccgcaccggccttcactctggagcggccccggcagccgcagcaggggcggcggcggcggatcgaggagctctccaggtcgtcccgggagaggctgctgcagtcccgggacaggatgttctccaagttcacctccatcctgcagcacgccgtggaggcgcttgcaccttctcttcctttacaagaagattttgtttatcactggaaggcaattacccattactacatagagacttcagatgataaagccccagtgaccgatacaaatattccatcgcatctggaacagatgttagatatactggttcaagaagaaaatgaacgggaatctggagagacagggccatgtatggaatatttgcttcatcacaagatcttggaaacattatataccttggggaaagctgattgtcctccgggaatgaaacagcaggttttggttttctatacgaaacttctgggaagaatccggcagccactacttccacacattaacgtgcacaggccagtgcagaaattaattagactctgtggtgaagtcctagcaacaccaacagaaaatgaagagattcagtttctttgcattgtgtgtgcgaagctgaaacaggacccctacctggttaactttttcctagagaataagatgaaatcattggcttccaaaggagtaccaaatgtaatttcagaagatacattaaaaggtcaggattccttgtcaacagatacaggacagtcccgtcaaccagaggaactatctggtgctactggaatggagcaaacagaattggaagatgagcctcctcatcagatggatcacctgtccacaagcttggataacctcagtgtcacctcactgccagaggcctcggttgtttgtccaaatcaggattacaatttagtgaattctttgttaaatcttactagaagtcctgatggcagaatagctgtgaaggcatgtgaaggcttgatgctgttagtaagtttgccagagcctgcggctgcaaagtgccttacacagagcacttgcttgtgtgaactactgacagacagacttgcctccctgtacaaggccctacctcagtcagtggatccgttagatattgaaaccgtggaagcaattaactggggcttggactcatatagtcataaagaagatgcttcagcatttccaggaaaacgagccttaatttcatttctttcctggtttgattattgtgatcagctcattaaggaagcccaaaagactgctgctgttgctcttgccaaagctgttcatgaaagatttttcattggtgttatggaacctcaattaatgcaaacttctgagatgggtattctcacatccactgctctgcttcatcgcatcgttcggcaagtgacctctgatgttttgcttcaagaaatggtgttttttatccttggagaacagagggaaccagaaactctggcagaaatcagcagacatcctttaaggcataggttaattgaacattgtgatcacatatctgatgagataagcataatgacattacgaatgtttgaacatcttttacaaaaacccaatgagcacattctttacaacttggtcttgagaaatcttgaagaaagaaattatacagaatataaacctttgtgcccagaagataaagatgtggtagaaaatggattgatagcaggagcagtagatctggaagaagatccattatttactgacatttcaccagaaaacactttgccaaaccaagagtggcttagttcttcacctcctgctactccagaccaccccaaaaatgatggaaaaactgaagttcataaaattgtaaatagttttctctgtctggtaccggatgacgcaaaatcctcctaccatgttgagggcacaggatatgacacttacctccgagacgctcataggcagttccgagactactgtgctatctgcttaagatgggagtggcctgggtctccaaaagcattggaaaagtgcaatttagaagctgctttctttgaaggtcattttttgaaagtgctgttcgacagaatgggaagaattcttgatcagccatatgatgtaaacttacaagtaacctcagtgttatctagactttctctcttccctcatccacacatccacgagtaccttttggatccttacgtgaacctcgctcctggctgtagatctctcttctctgtaattgtcagggttgttggagaccttatgcttcgaatccagcgtattcaagactttactcccaagcttctgttagtcagaaagcggttacttggtttggaacctgaaggccctatgcagacgttgccttcatggtggtaagagggattccagagtctcttatgtcctcaaagcttcaagctcagccaaaagaatctcgatggtttccacaaaaaatcttgggccttggatcaactgcccacccttgaaccaatcctggtggccccaggctgattggcagacctgaatcacctatcccatgcccagaactttggcttgaccaggctcatccaaaacaagggaatccagagtgtttccccaaagaaaatcagggggctattactgggaaaaagaattccaccacaagtataaaaaatactgttatcaataaaacatcacctgatactttggttcattaaa

SEQ ID NO: 3436 - DNA, 469 bp, Homo sapiens
ctttctctcttccctcatccacacatccacgagtaccttttggatccttacgtgaacctcgctcctggctgtagatctctcttctctgtaattgtcagggttgttggagaccttatgcttcgaatccagcgtattcaagactttactcccaagcttctgttagtcagaaagcggttacttggtttggaacctgaaggccctatttcagacctagagccagtagaagctctcacagtgagttcaatttgttagtgaaacattgtactgcatcaccagtttttcttaccttctgttgacagctgaatatttctgttactcagtacttgcaaaaacagtaactaaaatgcactatgctgagtggaaagcaccgtcataacaattgattgccatagcaagttccaaagtgaatttcagccttgcttcacatttgtatcaataaatatgcacattttttaaaactttctaacaa

SEQ ID NO: 3437 - DNA, 4068 bp, Homo sapiens
gctgccgccgccgctttcgcccgggagccgggggccgggcgccatcatgctgagccggctcggggcgctgctgcaggaagccgtgggggcgcgcgagcccagcattgacctgctgcaggccttcgtggagcactggaagggcatcacgcactactacatcgagagcacagatgaaagcacccccgccaagaagacagacattccctggcggctgaagcagatgctggatatcctggtgtatgaagagcagcagcaggcggccgcgggtgaggcagggccctgcctggagtacctgctgcagcacaagatcctggagactctctgcacgctgggcaaggccgagtaccccccaggcatgcggcagcaggtgttccagttcttcagcaaggttctggcgcaggtgcagcaccccctgctgcattacctcagcgtccacaggcctgtgcagaaactcctccgacttggtgggactgcttccggatccgttacagaaaaggaggaggtgcagttcaccaccgtcctctgctccaagatccagcaggacccagagctgctcgcctacatcctggaaggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagtttcctgtgcctggtccccgaggaagccaagacctctgccttcctggaggagacaggctatgacacatacgtccacgatgcttatggcctgttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccaggtgagcacccagaccccagaccctcatgtgctgtgtgcctggccccttctgtactggccatttgtggccagggccaagcctgtgactcaactccaggggcaagatggggagtgagctgatggctccgagactggtcaggagcccaggccagtgagatggggcctggagccttgtctgtgtcacattaggtaccatgggagctgctgagacctgacattttgtcccctgcctacatggcttggcccatggagaaggagcagtgaatgggatcgtcggggaagcccctcttcctgctctgctcccctggaaactgttgcaaaactcccagccgcctcatggcaaatgcccaaagcatgttccgcacccaggcgggggcccctgctaatgagaaccttggtgcagctgcagccaggaggggagcgggcccaggagccaggctcaggtccagctggttcctctctggcgccttctgaacccgtctcagcaggtccacagcacctgggcagaggtcagagaccaggggaggccgggccttgccctcccttctgcccagggcccagtgttcttgatagaagacccttctggggagccagggagctcaggggacagataagggaaggacgccccctgactccaggcccctgagcctggcgggaagtggctgcggcccaggcagccagtcctggtggtgttctccctgcatgccctccgtggctgggctgccaccccacccggcccgaatctgtcttgacctgcaggaatacacgggcggcgccaggcattacctcacagcgggactacacagttgctggctttgctcctgggcaaggaggagcaggccagagcctcttttgcttccttttcttgcccatgccgcttctagaagccaggcacaggttgccaagaggtgacacgaaacaggaggaaactcagtgacctctgcctctcccacattcctccccgcgggggaggacctcgccgctctgaagagcaccgtgcacatgtgggtgcacaaacgtgggtgttggtgtggacggggcgcagatctccgtggatgaactgcgtctggactcttagattcataaaatattcgagggtttgggagtcacagaccctcccctctcctcagtgcactttggcatttgcacggtgtcttccccggacagcacagcaataaatggtgtgattgcgtggacaccgtggctctgttcttggccaagtttccccaccttctgcccaggactccactgctaattcgggcccatcttcctccccaaggaagacaaattctttttctagcgctgcagcagggaggtggggtgggcggtaaacagacaggctctggcagtgcagatctgctgatcctcagcgcctgccaggagccagactcttggcggagcagtgccacttctgctgggctgacctgcagcggagagtctgcccaccccggagacaccatgagggaatggaccacgtgggagcatctgtgtgcaagtctcatttgggtgtgtttatgctgcgtgttgtatgcctgtt

SEQ ID NO: 3438 - DNA, 998 bp, Homo sapiens
agccgggggccgggcgccatcatgctgagccggctcggggcgctgctgcatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccaggtgagcacccagaccccagaccctcatgtgctgtgtgcctggccccttctgtactggccatttgtggccagggccaagcctgtgactcaactccaggggcaagatggggagtgagctgatggctccgagactggtcaggagcccaggccagtgagatggggcctggagccttgtctgtgtcacattaggtaccatgggagctgctgagacctgacattttgtcccctgcctacatgg

SEQ ID NO: 3439 - DNA, 4078 bp, Homo sapiens
accacctgcgccaggacaccagcgggccgctgtggggagctgcacgcacagccccgcatcggctgacaagccgggccgccatggtgcagacctgcgccgtcgcactcagaactcccgcaggcccacctacgtagtgcgtccggagcagagcactccaatcccgtcccgcttccgcggcgtcctcagaaccggaaataaaatgcgcggagaaaataggccaatcggaaaacgaaccttgcctcctcgggcgggatggatcggaggctgccctggaagccaaccagacgccaaagctagaaaggggtggaccctggccccgcatagctctcgctgccaccgctgctgccactatcgctgtcactgtcgctgctgcctctgtccagctgaaatgaccgtggggaggcctgagggagcccccggaggcgcggaggggagccgtcagatatttccccccgagtccttcgcagacacagaggcaggagaggagctgtccggggatgggctggttttgcccagggccagcaaacttgacgagttcctcagcccagaggaggagatagattctacttctgactcaactgggagcatttaccagaacttacaggaactgaagcagaaagggagatggtgtctgttggagtctctctttcagtctgacccagagagtgatgaaaacctctctgaagatgaggaggacctggagagtttcttccaagacaaggacagggggatggtgcaggtccagtgcccgcaggctctgaggtgtggctccacaaggcgctgcagctccctgaacaaccttccctccaacattcccaggcctcagacccagccaccctcaggctcccggcctccctcccagcacagaagcgtcagctcctgggcatcatccattactgtccctcggccattccgcatgacgctgcgcgaggcccggaagaaggccgagtggctgggctcacctgcctcctttgagcaggagaggcagcgggcccagaggcagggtgaggaagaggccgagtgccacaggcagttccgggcacagcctgtgcctgcacatgtctacctgcccctctaccaagagatcatggagcgcagcgaggcccgaaggcaggcagggatccagaagaggaaggaactgctcctctcttctttgaagcccttcagcttcctggagaaggaggagcagctaaaggaagctgctcgacagagagacttggcagccacagctgaagccaagatctccaagcagaaggccaccagaaggattcccaagtccattctggagccagcccttggggataaactccaggaagctgagctcttcaggaaaattcgcatccaaatgagagccctggacatgctccagatggcctcttcccctatcgcctcctctagtaaccgggctaacccacagccccgcacagccacccgaacccagcaggaaaagcttgggtttctgcacactaacttcagattccagcctcgggtgaatcctgtggtccctgactatgagggcctttacaaggccttccagagaagagcagccaaaagaagagaaacccaagaggccactcgcaacaagcccttcttgctgaggaccgccaacctgcgccaccctcagcggccctgtgatgctgccaccaccggaaggaggcaggattccccacagccaccagctacacccctgccaaggagtcgttctctgagcggccttgcttccctctctgccaacactctccctgtgcacatcacagatgccaccaggaagagggaatctgcagtcagaagtgcacttgaaaaaaagaacaaagcagatgagagtattcagtggctggagatacacaaaaagaagtctcaagcaatgtccaaatctgtgaccttgcgtgcaaaagccatggatccccataaaagcctggaggaagtgttcaaagcaaagctgaaagagaaccggaacaatgaccgtaaaagagcgaaagaatataagaaagaactggaggaaatgaagcagcgaatacaaacaaggccctatctctttgaacaagttgccaaggatctagccaagaaagaagcagaacagtggtatctagacaccctgaagcaggctgggctggaggaagactttgtgagaaacaagggtcaaggcacccgggctgttcaagagaaagagaccaaaatcaaggattttcccaggttccaagaaactacaaaactcagcatcagagatccagagcagggtttagaaggatctctagaacagcctgcaagccccaggaaagtactggaggagctgtctcatcagtcaccagaaaatctcgtatcacttgcttaatcactacacttaaaattactgcttttgaaaaatattaagcagctaacttgggtttgagtcaaggcagggaaaacttgggttttgagtcatggctactgttagaggatggacaaatgaagagtagcagattaacaggccaggcgcagtggctcacgcctgtaatcccaacactttgggaggctgaggcaggcagatcatctgaggtcaggagtttgagaccagtccagccaacacggcaaaactccacctctactaaaaatacaaaaattagctgggcgtgatgacacgtgcctgtaatcctagctacttgggaagctgaggcaggagaatcacttgaacccaagaggcagaggttgtaatgagctgagatcactccacagcactccagcctgggcagcagagcaaaactctgtctgagaaaaaaaaagagcagcagataacagagaatagttcaaggaaatcaaagtggggaggctcaggtggagggatggtagcctaaagttaagggttcctgctttgtgcctcacacttagagaattaggtacagaaaagagagcacaggcccaaatgcctataaggggctagtgcagaaacataaatgcgtccatggagtgggtgtagacagtaggagatagtagacactggaaagtatcaaatcctgctggaatataggctcagagttactacatcaactacattttcatcaagccagaaatttgtatgctatcaactaatttaaaaattacttagaaatattgtatgggcaaaataaaatacatctgcatatcagatctagcccatgggggatgaaaaacttacaacttctagtacaggatttcttatcctcagtgctattaatattttgggccacctaattctttgttgagggttggggaagggaactgtcctgtacattgtagaatgtttagtagcatccctggccactacctgctagatgccagtagtacccctctccccagctgtgacaaccaaaaatgtctccagatattgcatatccccagggggcaaaaatgtgcctggctgagaaccactgctctaatataaatggctgcatgaagcaaaaactggcattctaagaatacaagtaattgccatgaacacagtctatgtactatgtgattatgcatgtcattaacaaattaagaatttaaaacaattctctcccgttatctgtttagaatgtgcctgtgtgtttatgtgagcatgaggttcattttaagtaaacttaaaatttcccagacaaccaagattttctactagtaggtgaactttggaataattttcttctcaccaataataattggatattctggctcggtgcagtggttcatgcttgtaatcccagcactttgaggggccaaggcaggaggatcgcttgaagccaggcgttcaagaccagcctgggcaacacagacctcatttctaccaaaaaaaccacaaaaagttagctggactggtggtacatgcctatagtcctagctattcaggaggctgaggtgggaggatgccttgagcgtaggagttcaaggttacattgagctatgattacactactgcactccagcctgggtgacagagcaagaccccatctcaaatcataatgatgatgagtggatattttctcagtagctgtggagacaggatgactgatagcaagagtgcctgctctaactaaagcacctttctcaagcttttttaaaaaaactatctttgtggaaaaattca

SEQ ID NO: 3440 - DNA, 2304 bp, Homo sapiens
agacgccaaagctagaaaggggtggaccctggccccgcatagctctcgctgccaccgctgctgccactatcgctgtcactgtcgctgctgcctctgtccagctgaaatgaccgtggggaggcctgagggagcccccggaggcgcggaggggagccgtcagatatttccccccgagtccttcgcagacacagaggcaggagaggagctgtccggggatgggctggttttgcccagggccagcaaacttgacgagttcctcagcccagaggaggagatagattctacttctgactcaactgggagcatttaccagaacttacaggaactgaagcagaaagggagatggtgtctgttggagtctctctttcagtctgacccagagagtgatgaaaacctctctgaagatgaggaggacctggagagtttcttccaagacaaggacagggggatggtgcaggtccagtgcccgcaggctctgaggtgtggctccacaaggcgctgcagctccctgaacaaccttccctccaacattcccaggcctcagacccagccaccctcaggctcccggcctccctcccagcacagaagcgtcagctcctgggcatcatccattactgtccctcggccattccgcatgacgctgcgcgaggcccggaagaaggccgagtggctgggctcacctgcctcctttgagcaggagaggcagcgggcccagaggcagggtgaggaagaggccgagtgccacaggcagttccgggcacagcctgtgcctgcacatgtctacctgcccctctaccaagagatcatggagcgcagcgaggcccgaaggcaggcagggatccagaagaggaaggaactgctcctctcttctttgaagcccttcagcttcctggagaaggaggagcagctaaaggaagctgctcgacagagagacttggcagccacagctgaagccaagatctccaagcagaaggccaccagaaggattcccaagtccattctggagccagcccttggggataaactccaggaagctgagctcttcaggaaaattcgcatccaaatgagagccctggacatgctccagatggcctcttcccctatcgcctcctctagtaaccgggctaacccacagccccgcacagccacccgaacccagcaggaaaagcttgggtttctgcacactaacttcagattccagcctcgggtgaatcctgtggtccctgactatgagggcctttacaaggccttccagagaagagcagccaaaagaagagaaacccaagaggccactcgcaacaagcccttcttgctgaggaccgccaacctgcgccaccctcagcggccctgtgatgctgccaccaccggaaggaggcaggattccccacagccaccagctacacccctgccaaggagtcgttctctgagcggccttgcttccctctctgccaacactctccctgtgcacatcacagatgccaccaggaagagggaatctgcagtcagaagtgcacttgaaaaaaagaacaaagcagatgagagtattcagtggctggagatacacaaaaagaagtctcaagcaatgtccaaatctgtgaccttgcgtgcaaaagccatggatccccataaaagcctggaggaagtgttcaaagcaaagctgaaagagaaccggaacaatgaccgtaaaagagcgaaagaatataagaaagaactggaggaaatgaagcagcgaatacaaacaaggccctatctctttgaacaagttgccaaggatctagccaagaaagaagcagaacagtggtatctagacaccctgaagcaggctgggctggaggaagactttgtgagaaacaagggtcaaggcacccgggctgttcaagagaaagagaccaaaatcaaggattttcccaggttccaagaaactacaaaactcagcatcagagatccagagcagggtttagaaggatctctagaacagcctgcaagccccaggaaagtactggaggagctgtctcatcagtcaccagaaaatctcgtatcacttgcttaatcactacacttaaaattactgcttttgaaaaatattaagcagctaacttgggtttgagtcaaggcagggaaaacttgggttttgagtcatggctactgttagaggatggacaaatgaagagtagcagattaacaggccaggcgcagtggctcacgcctgtaatcccaacactttgggaggctgaggcaggcagatcatctgaggtcaggagtttgagaccagtccagccaacacggcaaaactccacctctact

SEQ ID NO: 3441 - DNA, 1287 bp, Homo sapiens
ggaatgttagcgggtgggaggtgcggctgggttgctacagccagagctgggcggtggcgggcgctgctgaaggagtctcgctgagctcgaggaggtggcgcgatggagggactggaagagaatggaggtgttgtccaagttggagaattgttaccttgcaagatttgtggaagaacattctttccagtagcattaaaaaaacatggacccatttgccagaagactgcaactaaaaaacggaagacttttgattcaagcagacagagagctgaaggaactgatattccaacagtaaaacctctcaaaccgaggccagaaccaccaaagaaaccatctaattggagaaggaaacatgaagaattcattgctaccataagagcagctaaaggccttgatcaggccctcaaagagggtggcaaacttcctcctcctcctccaccttcttatgatcctgattatattcaatgtccatattgtcagaggagattcaatgaaaatgcagctgatagacatataaatttctgtaaagaacaggcagcacgtattagtaataaagggaaattttctacagataccaaaggaaaaccaacttctcggacacaggtgtataagccacccgcacttaaaaagtcaaattctcctggaactgcatcatcaggatcttcacgattaccgcagccaagtggcgctggcaaaactgttgtaggtgttccttcaggtaaagtgtcttcaagtagcagctctttgggaaacaaacttcagaccttatctccctctcataaagggatagcagcccctcatgcaggagctaatgtcaaaccccgaaattccacaccacctagtttggcaagaaatcctgccccaggtgtgcttacaaacaaaagaaaaacatatactgagagctacatagccaggccagatggggactgtgcatcttcccttaatggtggaaatattaaaggcattgaaggacattcacctggaaacttaccaaaattctgccatgagtgtgggactaaataccctgtagaatgggccaaattttgctgtgaatgtggcattcgaagaatgattctatgaatagaatctcaaaaaaaaaaaaaagccaagttcagagtttatgattattgctgcttggacagctagagcacatcctctagttagtttgtgctaaaaatactcgaaataccatttccagttaattttgaagtgtaatcttttggctatataatgtgtgtatgtttatatgtgtacatatactgtatataataaatatctgatacccca

SEQ ID NO: 3442 - DNA, 1509 bp, Homo sapiens
agaagccagctgagagcgcctgcgcggctgtcggttgatggggaggtcaggtctgggaaactaggccctggggttttccctgagcaggagcggtgcccgagggcctcaggcgtcagtccaggccctgaatggctggtctccagcggttggcgtcacatctgcctgtgggcgttatgctcccacataatacaacggaagctccagggccccactcagccaagcaagactcttacgaacaaggtgactcttcccagcagtccttgaaggggcacctgaggaacaatttccagaagcagcttttgagcaacaaagagttgattctggataaagtctatactcaccccaaatggaacacccaaacaaaagcccggagctactcctatccccactgtactggaatcagccagcaagatccagaaagtgattcccagggccaaggaaatggtttgttttactcgtcaggccctcaatcctggtatcccaaagccaataaccaggactttatcccctttacaaagaaacgagttggagtggaccgggcgttcccattgaaacccatggtccacaggaagtcgtgcagtacaggtgaggctggcactgatggggaccataatgtctacccaaggccccctgagccgagagagttttcatctaggaactttggtgtgaggaaccagggcaacttttctgtggttggtactgttcttgctgccacgcaggcggagaaggccgtggcaaactttgacaggacggagtgggtgcagatccgaagactagaagctgcaggggagagcttagaggaggaaatccgaagaaagcagattctcctgaggggaaagctgaagaagacagaggaggaactcagaaggatccagacgcaaaaggaacaggccaaggaaaatgaaaacggagagctacagaaaattatactccccaggagcagagttaaaggctgaacctcctcagaagagcaactggagatagaagcatgaatcttttatccatacgttccgccaggctcgagaggtccagcaggtaactgccaaaggtggaaactgttcacacttgcctcccatcctgcctgcagaaaacccagactgcattcagtgtcctcagtgtagccaccactttgctcccaaggtggctgagcaacacattcccaagtgtaagaccatcaagaactgtcttccacctctaaggaagcattatagttgagcagacaacaatggaaacttttggatagttcagaaagctctgcttctcttcagcagtaaatgggagtagaatttgatgcaaagcagaaagaaatcaaacagctcccagatctgcctgcagagctaaaatctgtgaggagagagccactgctaagcagcaggaggcagaaggaagccccagcttcccactaaattacaaccttgggctggtatgctttatgttattgccctcagaattgatgggtgaagacactgaagagtcatgagcaggctccattaaagctcttttcttgca

SEQ ID NO: 3443 - DNA, 2392 bp, Homo sapiens
ggacgccggcatcctgcggcggaagcacgcggaggcacagccagggcctccgccctttgccagacaagggcacaccccaaggtctgggagcgtcgttctcagaaaagtacaagttcttctttgaaggagctccagaaaagcctctcccgcccctccccggctccccaagggcagggctggaccgagctgcagagttggccggacactgactgggtcaagtgaccttgggctgaccgcacccccacccccggtcgccccgggtcgctggtgcactgcgcctgcgcgcgtctccccgaggagttcgcggcgaggggcggagcttggcgcgccagtgcctcggtttccaggcaccgggaataacagaagccagctgagagcgcctgcgcggctgtcggttgatggggaggtcaggtctgggaaactaggccctggggttttccctgagcaggagcggtgcccgagggcctcaggcgtcagtccaggccctgaatggctggtctccagcggttggcgtcacatctgcctgtgggcgttatgctcccacataatacaacggaagctccagggccccactcagccaagcaagactcttacgaacaaggtgactcttcccagcagtccttgaaggggcacctgaggaacaatttccagaagcagcttttgagcaacaaagagttgattctggataaagtctatactcaccccaaatggaacacccaaacaaaagcccggagctactcctatccccactgtactggaatcagccagcaagatccagaaagtgattcccagggccaaggaaatggtttgttttactcgtcaggccctcaatcctggtatcccaaagccaataaccaggactttatcccctttacaaagaaacgagttggagtggaccgggcgttcccattgaaacccatggtccacaggaagtcgtgcagtacaggtgaggctggcactgatggggaccataatgtctacccaaggccccctgagccgagagagttttcatctaggaactttggtgtgaggaaccagggcaacttttctgtggttggtactgttcttgctgccacgcaggcggagaaggccgtggcaaactttgacaggacggagtgggtgcagatccgaagactagaagctgcaggggagagcttagaggaggaaatccgaagaaagcagattctcctgaggggaaagctgaagaagacagaggaggaactcagaaggatccagacgcaaaaggaacaggccaaggaaaatgaaaacggagagctacagaaaattatactccccaggagcagagttaaaggtaataaaagcaacaccatgtacaaacctatcttctccccagaatttgagtttgaggaagaatttagtagagacaggagagaggatgaaacttggggacggtctcaacaaaattcaggtccattccagttctctgattatagaatccagaggctcaaaagggaaaggctggtagcaagcaataataaaattcgagacccagtctcagagccatcggtggagaaattctccccgccttcagaaacaccagtcggtgctttgcagggatccgccagaaattccagcctgtccatggcaccagactcctcaggttccagcggctccattgaagagccacagctgggtgagtgcagccactgtgggcgcaaattcctctcgttcaggctggagagacactccaacatctgcagcaggatgcggggttccaagaggaaagtgtttgactcctccagggcccgggctaagggcacagaactagagcagtacttgaactggaaggggccagcttcagccaaggctgaacctcctcagaagagcaactggagatagaagcatgaatcttttatccatacgttccgccaggctcgagaggtccagcaggtaactgccaaaggtggaaactgttcacacttgcctcccatcctgcctgcagaaaacccagactgcattcagtgtcctcagtgtagccaccactttgctcccaaggtggctgagcaacacattcccaagtgtaagaccatcaagaactgtcttccacctctaaggaagcattatagttgagcagacaacaatggaaacttttggatagttcagaaagctctgcttctcttcagcagtaaatgggagtagaatttgatgcaaagcagaaagaaatcaaacagctcccagatctgcctgcagagctaaaatctgtgaggagagagccactgctaagcagcaggaggcagaaggaagccccagcttcccactaaattacaaccttgggctggtatgctttatgttattgccctcagaattgatgggtgaagacactgaagagtcatgagcaggctccattaaagctcttttcttgcatgcctga

SEQ ID NO: 3444 - DNA, 544 bp, Homo sapiens
gatggggaggtcaggtctgggaaactaggccctggggttttccctgagcaggagcggtgcccgagggcctcaggtacgcagaagggcggggagacatgggatcagcacctccacctcctaagggaccgaagggcaggagagcgagaggacttgtccccagaggtggagtccgaagtgggggcgccccagttgacccttcgggacaaaacgtgacttcagccttaaggatctaaaaccggccgcggtcaggcgtcagtccaggccctgaatggctggtctccagcggttggcgtcacatctgcctgtgggcgttatgctcccacataatacaacggaagctccagggccccactcagccaagcaagactcttacgaacaaggtgactcttcccagcagtccttgaaggggcacctgaggaacaatttccagaagcagcttttgagcaacaaagagttgattctggataaagtctatactcaccccaaatggaacacccaaacaaaagcccggagctactcctatccccactgtactggaatcagc

SEQ ID NO: 3445 - DNA, 809 bp, Homo sapiens
ggttgatggggaggtcaggtctgggaaactaggccctggggttttccctgagcaggagcggtgcccgagggcctcaggtacgcagaagggcggggagacatgggatcagcacctccacctcctaagggaccgaagggcaggagagcgagaggacttgtccccagaggtggagtccgaagtgggggcgccccagttgacccttcgggacaaaacgtgacttcagccttaaggatctaaaaccggccgcggtcaggtcaggtggccctcaacgctcaggcgtcagtccaggccctgaatggctggtctccagcggttggcgtcacatctgcctgtgggcgttatgctcccacataatacaacggaagctccagggccccactcagccaagcaagactcttacgaacaaggtgactcttcccagcagtccttgaaggggcacctgaggaacaatttccagaagcagcttttgagcaacaaagagttgattctggataaagtctatactcaccccaaatggaacacccaaacaaaagcccggagctactcctatccccactgtactggaatcagccagcaagatccagaaagtgattcccagggccaaggaaatggtttgttttactcgtcaggccctcaatcctggtatcccaaagccaataaccaggactttatcccctttacaaagaaacgagttggagtggaccgggcgttcccattgaaacccatggtccacaggaagtcgtgcagtacaggtgaggctggcactgatggggaccataatgtctacccaaggccccctgagccgagag

SEQ ID NO: 3446 - DNA, 564 bp, Homo sapiens
aaaagctttgggttggggatctgtccaggaactcggctgggcctccacaaacctagccctcatcgcatctcagtcaacaagcgcaaccctcttctcattttctcatgaggagaaaggcatagacgaagaagtacatggggatacattcaatcattcaattaaatactgactgacagctactgtgtgccaggcacctgttctaggtgaccaggcaaacatcagtgaacaaaacaggatccctgtcctgaggagcttaattctggaggcgtcagtccaggccctgaatggctggtctccagcggttggcgtcacatctgcctgtgggcgttatgctcccacataatacaacggaagctccagggccccactcagccaagcaagactcttacgaacaaggtgactcttcccagcagtccttgaaggggcacctgaggaacaatttccagaagcagcttttgagcaacaaagagttgattctggataaagtctatactcaccccaaatggaacacccaaacaaaagcccggagctactcctatccccactgtactggaatcagccagc

SEQ ID NO: 3447 - DNA, 547 bp, Homo sapiens
agaagccagctgagagcgcctgcgcggctgtcggttgatggggaggcgtcagtccaggccctgaatggctggtctccagcggttggcgtcacatctgcctgtgggcgttatgctcccacataatacaacggaagctccagggccccactcagccaagcaagactcttacgaacaaggtgactcttcccagcagtccttgaaggggcacctgaggaacaatttccagaagcagcttttgagcaacaaagagttgattctggataaagtctatactcaccccaaatggaacacccaaacaaaagcccggagctactcctatccccactgtactggaatcagccagcaagatccagaaagtgattcccagggccaaggaaatggtttgttttactcgtcaggccctcaatcctggtatcccaaagccaataaccaggactttatcccctttacaaagaaacgagttggagtggaccgggcgttcccattgaaacccatggtccacaggaagtcgtgcagtacaggtgaggctggcactgatggggaccat

SEQ ID NO: 3448 - DNA, 958 bp, Homo sapiens
agccctggacacggtacacacagaccagagccttggctcaaaggcaaacaaaaggaaatgcccggctccccatggctgtggccagcaccttcataccagggctcaaccctcagaaccctcattatatcccagggtacactggacactgcccactacttcggttcagcgtgggccagacctatgggcaggtgactggtcagctacttcgaggccctcctggcctagcctggccccctgtccaccgcacacttctgcctcccattcggcctccaagatctcctgaggttcccagggagagtctacctgtcaggcgtgggcaagaaaggctcagctccagcatgatccctgggtacacaggttttgtaccccgggcacagttcatctttgccaagaactgcagccaggtctgggccgaggctctgagtgactttactcacttgcatgaaaagcaagggagtgaagagctaccaaaggaggccaagggaagaaaggacacagagaaggaccaggtgccagagccggaggggcagctggaggagccgacactggaggtggtggaacaagcttctccctactccatggatgacagggaccctcggaagttcttcatgtcaggcttcactggctatgtgccctgcgcccgcttcctcttcggctccagctttcctgtgctcaccaaccaggcactgcaggaatttgggcagaagcactcaccaggcagtgcccaggaccccaaacatctccccccacttcccagaacataccctcagaacctgggtcttttacctaactatgggggctacgtgccagggtataagttccagtttggccacacatttggccatctcacccatgatgctctgggcctcagcaccttccagaagcagctcttggcttaggccactggacatcaagttcccttcccttttcatcctatcccagccatccttttggaagg

SEQ ID NO: 3449 - DNA, 889 bp, Homo sapiens
agccctggacacggtacacacagaccagagccttggctcaaaggcaaacaaaaggaaatgcccggctccccatggctgtggccagcaccttcataccagggctcaaccctcagaaccctcattatatcccagggtacactggacactgcccactacttcggttcagcgtgggccagacctatgggcaggtgactggtcagctacttcgaggccctcctggcctagcctggccccctgtccaccgcacacttctgcctcccattcggcctccaagatctcctgaggttcccagggagagtctacctgtcaggcgtgggcaagaaaggctcagctccagcatgatccctgggtacacaggttttgtaccccgggcacagttcatctttgccaagaactgcagccaggtctgggccgaggctctgagtgactttactcacttgcatgaaaagcaagggagtgaagagctaccaaaggaggccaagggaagaaaggacacagagaaggaccaggtgccagagccggaggggcagctggaggagccgacactggaggtggtggaacaagcttctccctactccatggatgacagggaccctcggaagttcttcatgtcaggcactgcaggaatttgggcagaagcactcaccaggcagtgcccaggaccccaaacatctccccccacttcccagaacataccctcagaacctgggtcttttacctaactatgggggctacgtgccagggtataagttccagtttggccacacatttggccatctcacccatgatgctctgggcctcagcaccttccagaagcagctcttggcttaggccactggacatcaagttcccttcccttttcatcctatcccagccatccttttggaag

SEQ ID NO: 3450 - DNA, 1124 bp, Homo sapiens
aagggagctggatgccgggagggactggagccagcaaggccagagtgaaagcaaaatgacaactactcagaaacacgatctcttcacgccggagcctcactatgtccctggctatgccggcttctttccgcagctgcgctaccaggtggggaacacctatgggcgtaccacggggcagctgctcacagaccccagtgtgcagaagagcccctgctctgtgctgtcccccatgtccaaacccaagttcattgaggacttcagccagtccaagcccccgagggttccctgccaagacctgacggagccctacatcccccactacaccagtctgaagccctctaagaactttgagattctgggccagctcccacccttggaggtggacgcccaggagccgccaggggtagagaacatacccagacagattctgctgcctgcaggcttcacgcccgacaccccgcaccctccgtgcccaccaggcaggaagggagactccagagacttgggacacccagtatacggggaagaggcctggaagagcgccactcctgtttgcgaggcccccaggcagcaccagctgtaccactgccagagggatgagtacccaccccccgcccgccgccagcaggagacgctagatgtgggcagcttccagcggctgccgcagctggaccaccctaacctaatccaacgcaaggccatctcaggctatgctggcttcattccccgtttcacctgggtaatggggttgaattaccgagacggcgtcatgcaagccatggacgaattcgacaagagccagttcctgtttagaaacccccactgtgacctgggcgagaagctgcctggaacacactggcccagcaaccacatctacagcagccaaggcctgatccccttctacatggggttcatccccgccatgcaggacaactacgccctgacattcggcaacagcacccggagggcctactggaaggaatgggcaaagcgaaaccacacactatgaaaatgctttaatggtggtgtctgtacagcatggatgtggacagggaaaacagcaagtgcacacagtgggacaggccacaggacaggctgggagtgaataaagagttcacactgct

SEQ ID NO: 3451 - DNA, 871 bp, Homo sapiens
aagggagctggatgccgggagggactggagccagcaaggccagagtgaaagcaaaatgacaactactcagaaacacgatctcttcacgccggagcctcactatgtccctggctatgccggcttctttccgcagctgcgctaccaggtggggaacacctatgggcgtaccacggggcagctgctcacagaccccagtgtgcagaagagcccctgctctgtgctgtcccccatgtccaaacccaagttcattgaggacttcagccagtccaagcccccgagggttccctgccaagacctgacggagccctacatcccccactacaccagtctgaagccctctaagaactttgagattctgggccagctcccacccttggaggtggacgcccaggagccgccaggggtagagaacatacccagacagattctgctgcctgcaggcttcacgcccgacaccccgcaccctccgtgcccaccaggcaggaagggagactccagagacttgggacacccagtatacggggaagaggcctggaagagcgccactcctgtttgcgaggcccccaggcagcaccagctgtaccactgccagagggatgagtacccaccccccgcccgccgccagcaggagacgctagatgtgggcagcttccagcggctgccgcagctggaccaccctaacctaatccaacgcaaggccatctcagaacaggctagcggcctggggggacctcctctgcctcccagctgcttccaggagcccagcttttcccaagacgaggcggtgccttgcctgcctgttcccatttggccacatcagacagtcgccaacgttcagggaacgaaagggagccttgcctggcttccctga

SEQ ID NO: 3452 - DNA, 909 bp, Homo sapiens
agccctggacacggtacacacagaccagagccttggctcaaaggcaaacaaaaggaaatgcccggctccccatggctgtggccagcaccttcataccagggctcaaccctcagaaccctcattatatcccagggtacactggacactgcccactacttcggttcagcgtgggccagacctatgggcaggtgactggtcagctacttcgaggccctcctggcctagcctggccccctgtccaccgcacacttctgcctcccattcggcctccaagatctcctgaggttcccagggagagtctacctgtcaggcgtgggcaagaaaggctcagctccagcatgatccctgggtacacaggttttgtaccccgggcacagttcatctttgccaagaactgcagccaggtctgggccgaggctctgagtgactttactcacttgcatgaaaagcaagggagtgaagagctaccaaaggaggccaagggaagaaaggacacagagaaggaccaggtgccagagccggaggggcagctggaggagccgacactggaggtggtggaacaagcttctccctactccatggatgacagggaccctcggaagttcttcatgtcagctttcctgtgctcaccaaccaggcactgcaggaatttgggcagaagcactcaccaggcagtgcccaggaccccaaacatctccccccacttcccagaacataccctcagaacctgggtcttttacaactatgggggctacgtgccagggtataagttccagtttggccacacatttggccatctcacccatgatgctctgggcctcagcaccttccagaagcagctcttggcttaggccactggacatcaagttcccttcccttttcatcctatcccagccatccttttggaag

SEQ ID NO: 3453 - DNA, 936 bp, Homo sapiens
cacacacccatctgctcactcaccctggcacattcagcccccctaacccaccttgaacattgaccaccacacactccctggcacgctcttctcaccctcaacttctgccacctctccctgggcaatactgccagcctttccctaatctcagagctgcagccctgccctgtcactcacctcaaacctgccatgtccctggggctactgaaattccaggcagtgggtgaagaggacgaggaggatgaggagggggagagcctggactctgtgaaggcactgacagccaagctgcagctgcagactcggcggccctcatatctggagtggacagcccaggtccagagccaggcctggcgcagggcccaagccaaacctggaccagggggacctggggacatctgtggtttcgactcaatggactccgcccttgagtggctccgacgggagctgcgggagatgcaggcgcaggacaggcagctggcagggcagctgctgcggctgcgggcccagctgcaccgactgaagatggaccaagcctgtcacctgcaccaggagctgctggatgaggccgagctggagctggagctggagcccggggccggcctagccctggccccgctgctgcggcacctgggcctcacgcgcatgaacatcagcgcccggcgcttcaccctctgctgaggaacacctgtgccccccgactccccgccccctctcccaatgccgcttcccctgcctgcctgggaagaggaaagggaggggtgccccagaggcaccagctcctggcgggggaggaggaacattcaggtttctgagagctgaattccaagagtgcaaaaccccagcatcctgtttcctctgctgacccagctgggagggggaggaggaggagctcacaccctcaaactcctcaataaacgctttctctggttccca

SEQ ID NO: 3454 - DNA, 7296 bp, Homo sapiens
ccttctgagcggtcccccgcctcctccctccgcctcctcctccctcgcccgcagccgagcgtcccctccccccacccgtcgggctcctcggcggctactgcagaggattcagagccgagtcgctgaggaggaggctccggtccccgcgcgccatccgccaccctactggacacgggcgagagcgtcgccgccgtagcctccggagaagacaagggcatcgccgcctcagccgccgccgccgccgttttcgcctgcagctgctcaccggatcctcagtcttccacaatgaaccctgtttacagccccgtgcagcctggggctccttatggcaaccctaagaacatggcctacacgggttaccccacagcctatccagcagctgcccctgcctacaatcccagcctgtaccccaccaatagtcccagttatgctccagagtttcagttcctgcattcagcttatgcaactctgctgatgaaacaggcctggccacagaactcgtcttcctgtggcactgaaggcaccttccacctcccagtggacaccgggaccgagaaccgaacttaccaagcatcctctgcggctttcagatatactgcggggacaccatacaaggtcccaccgacccagagtaacactgctccacccccctactccccatcacccaacccctatcagacggccatgtatccaatcagaagtgcctacccccagcagaatctgtatgcccagggagcctactacacacagccggtgtatgctgcccagcctcatgtcatccaccataccacggtcgtccagcccaacagcattccctctgctatctacccagcacctgttgccgccccgaggaccaacggtgtggccatgggcatggtggcaggcaccaccatggcaatgtcagcaggtaccctgctgactacaccccagcacacggcgattggggcacaccctgtctccatgccaacatatagggcccaaggaacccctgcgtacagctacgtgcccccacactggtaaagcctgcagcccatccaaatctggagtcacacattgtatgcaactactcaagtcttacaccggtgctggagcagttccctagcagcaccacctctatttgcaagaagagacaacggaagtgcaagggtcactttatgcatctttaatggttttgatttttatttttggtttttgtaaaagctgctttttctaatctcctgcctctccccaactgtccccctcttagcccctgcccttccagctctatccccttcctcctacctgaccaggccatgtcctctctgctcttccctaagtgtcctgtccctggggatcccagtctagaggcaagcagagagtagggtttattgcagtggttcatctgaaggctggattccatttgaagagcataaacagatgtggtccagggtaggaactcagagctgttgagcaggctacatctctaggggagtgttctggttgttttttcttaagcaagattagttcaggacattcccatgtcccagacacaaatgaaatgtctcctgagaaccattgcaacagaccaagaacaaaaccacctgagtatgtaggcgtgttattagcagcttaataccccaggctgagaacctggggaaaaaagtctttagaatttgggggagggtggggggagggagggcattgtggggaaggagagggaagaagggaggagcggtgcttgcctcatggctttggtttgaaaggtctctggccaaagcatctggccctggaccttctgatttgcacagtgatgttaactgacctggcacttcctcaaaaggtgattttgtccttagacctgccaagcggctgcagggtggtaggatcccagcatcccgaggccttggaaggccggatgccctgtgtcatccagacttcagcctctgagctgtcatggacccactctgatgaggagcttcctcctgattggagtgggaacctagggcatttctctcccttttcttttgcccttcccagtgccaggactcacctgtctgaccatagagcttgcaggcaggccaagctcttggttacctgtgccattcatggcccaagtgaaggaaccacattccaggtgggtgctggcagctctgaaggtgaggatagtgaaggaaaagcaatagcaataaacatttcatagactcatggaactgaagggaccttagcaatcatctcatccatttccctatttggcagatgaggaaactgaggcccagagaagcggaaaggacttccctagaccttacagtaaattagcattaaatgcagccttcctacctagtgggcaccttgcttacaaaaatttacctagggacggattggcttggttttgtaaaaattaagtcggcagcgcccatacctggtgagtctggaatggtctctgggctcctgtttctgctcttttcctccacggactccaaaggcgggggttgaagactgggcagaggctacatgggggcggatggcaggaacagaaattgcaaatgaagaaatagcatttggaaattctgtgaagacatctggaacttccgtcctgtacctgactccacctccaggagaaggagcaggtggactggccgaaaaggagaggccatgcttttaggacagtagcccctcatcccgagaggagaggaagaggaggaagacagtgggagtcatcaggagaggagaatgaggatgaggcccaggagacaggctcatctgggagaagagggacccctgggacgaggaggtccctgctagtctcagccaggagcctggattgcccagcagcagcctccggcacccagcgcttggctgggccagcagcccctctgggggtggggcacgaacattttattgtaaaaaatgggatcattgacaacatttgggactttaaaaaactgctttcatttaaaattcatgcaaacttggacatatccttaccccaacctcccatgtctccctaagggagggaaaaatcaggaaacccttgggttggaaggagctcagaagctgtctagccattcccaggagggtaaagcccatcagcctccttggcctagagccaggagtttgggggcccaccttcctgggcttccaaggaactttaggaccagtaagaaaaaattcagctgttctaaattatctgttctgggtgctgatgaggtttcactttaaaacaatagaaagttttccagtgttaattcactttttgcaaatacctccttccaccctctttggttttgtaaaggtgggtgaaggttgttctagattatgtcatacgtgtttgaaaaatgccaaaataataataatgataataataatagaaacctttggatttgtcaggtgcatcacagaggtcaaagcacttcacggcctttcatgtactcgccctgagagggacagggttagagttattacagtcaattgacaaatgaggaaacaggttatggaagggaacaggcccacagtgagcagcatgctggtatccgctaggcttcccagaaccctgctgcctccatgtgggctggggtggaaccacagagaggagaaaggaagaagaggagacctaggaatgaccttgtaacttttgttctttcaacaccagtaagtaaaactaacagctggacctcacagttcacagaacagttgaacataaattatctggtttaacccgatgaaatagaggttatttctcctatttgatccataaggaaatcaaggcttggaaaagtcaagtgacttgctaataagtgacagagccactcgaatcccaggctgtctgctgtctcgttcccctccatctgatccccacacaggctcacgtactgaagcatctgtgctctgtgccctatcttagcacctactatgtaattcaagagcaaaggggggccccaaggtgaaaataaggcactgaaaggctgtggtctggaagagcccaggtccagcacccctttttcagtatgagccccagttcagccggcctcagcctcttgctgtgatggagatccacaagcctagccaagcttggggagtcactgcaaaaggactgagcccaggagagcggggacagtcatgtgcctctggtaggatgggcacagttactggtaaggtcacagagatctagtgggaggtaccataggtagatacctccaaagattctagatggcacggtggtcaagctagacaaaaagtcagagctggaagggccgtctcattgaaggcaggcaagcaagagaggacaagggatgtagccgcctgacagtgagctacagcactggccccaggatgcaaacccctctctcctcctcatgccactgcctctccccaagtgcaacacctatggccaggatcaggggtacagatggctcgttaccagccaacccttttgaattcttctacttctacctgaccccctctcctcactggcctggggtcaagaagtttgagtctgggagctggattgcctgcaaatagtgaaagcctgaaacataatggtttgccatgttttgaaaaaaaatgcatatttaatttcttcctcatgagataggacagttgctgttctttcttacctggcaatgaccctaaaatgtatatcctctttcctgaatatttagcagagacacacacacctgtccagagcgtttttggtatgcaaagtactttgacattggttgccaaagtcctccattttatagatgaaaaaactaaggctcaggaggcttgagacttgctaaaaggtcacacagcttggaagtgattcttcaaatcctctgctctttctgctgccacctgctgggtctcttggcaagcatggagggaggggctaactgtactttatagagctgggaagcccagtctctgagctgagcagatttgtatgaactgctttgggccaggacctgtaatgagccctggggagggacccagaggcacatctaactggcagcacaaggaggatgagaatttgcaactaaaggcctcacttggacaaaacactttggggtcacaatgcccaggaccgaagacatgttcaaggacagcacgaggcatctttctattgggagacccatgtccttggtaagcctgcacacctggcttcctaatccctgagagcctgcccactgtccagatccagtgagttggtacaaaacgtacagactgaagtccctgggcttgcttttcccatgggtgaggaccagaaccagactctgagcatccttacccctggccacccgaattgttccaagtttgaggtaccccgttcccagagatctgggggtccttctttggagggcttgctttgttctgatggccttcagaaaggaatcacatgaagtataaaaggacaggccccttggtcaccaagttttggctcctcatacagataggactcatccaggttcccagcgaggcactgactaagcgaggctcagagcttccatatcaaattcctcagctttgttctgtgcccagagggggtgggccccattctgggccctgtgaactttgtcttatatatcaccatctgtatcagaattcctcctcaattgcagttaagtgaaaatacgtggaagtctgcttttccatcctgtattctcccacatcactactggctgtgcggcccccgctgcttgccaagcttgggaatccagagaggggcagtagtagagtgggccagttgggacccacccgcagagctgaagaaacacgccagactaactgatgggattccacaccggagcctctgagcgcacaggcaggcatgccaagggggctgcagggtttgtcctttacttatctgcccctttcctagaaaactcctcgtttctgaaattaggcattatatggttccaggacccagccttcaaaattcctggcaggccagcttcaacattccatggccagccctgcctaagccagacttgggtcccagtccctcagtctctccagtggatatcttctgtggtgcatgctgttgagtccaacccaaaggccaaccgaggcacacaggagttgggactggctgccacaaagctagaaagggacaaaacagcacttgcttccctatggccacatggatagtccctggatatccttgctgtggtagaggtcctctacccattccagccactgatagcagggggattttccttcctaaggagaacagatgtaacagctttgcaaagtaccggcccataggaatcaaatgggtgagatcagctttgggcctgaccccagcaagaccagcatctccagaccccagcctttctcctcaggcctaagagagtcagggaaagagaggagactgtcccagagaccttctcctcgggtcagccagatagtctggatctatggtgtgactcaagctcctccttacccagggggggtaaggccaggcctctagctacttggagttgtctgtaataatcttgaaaggcccaagggcctgtccccatcctgacttaaaggcatctgcttccctgtttcatatcacatgacagagaaacctgttctcatggcatgtaacatccctgtgaagagagcgttgtatatgattttgtattttttaattcattttaatctacaggttggaatctaatttttaaattttattggaactcacattttaaaaagaaataaaatttaaaataataataataataataataataataataaacctttgaccagtgtcttccaagtagtttgatcaaagaatttataggtgttttcaaaacacagtccggagtgtaaagattggaaagccccatggccttgcctgtgtgtatgaagtgtaaatctggttttgttttgttgttttggattcttttgggtttttgttttgttttgaagatcagacagtgatcactctgaaagattgaagccaagaatttgtaactatggtatttactgtaagctgtagaacactcaataactattaaaaaaaaaaattcccccccaaaaaaaagtcttaggtgactagactgagtggttcttggggagggaggcacagaggactgtcctgggccagtgagtcccttgggcgtctccccaagttgatgctaaatttgttctcagtagtcaagaaaaacctatggtacatcttacagctgatctgacaggggtctgccctaagggtctcacagctgctggggagctttaagtggcaacttcagcacccaccctaagtgtgtgatgtgggagcacagtgaggccattcagagttgaaatccattgagccatccgcgcaataaagctgacatctattgtgtg

SEQ ID NO: 3455 - DNA, 1767 bp, Homo sapiens
gagcggtcccccgcctcctccctccgcctcctcctccctcgcccgcagccgagcgtcccctccccccacccgtcgggctcctcggcggctactgcagaggattcagagccgagtcgctgaggaggaggctccggtccccgcgcgccatccgccaccctactggacacgggcgagagcgtcgccgccgtagcctccggagaagacaagggcatcgccgcctcagccgccgccgccgccgttttcgcctgcagctgctcaccggatcctcagtcttccacaatgaaccctgtttacagccccgtgcagcctggggctccttatggcaaccctaagaacatggcctacacgggttaccccacagcctatccagcagctgcccctgcctacaatcccagcctgtaccccaccaatagtcccagttatgctccagcaactctgctgatgaaacaggcctggccacagaactcgtcttcctgtggcactgaaggcaccttccacctcccagtggacaccgggaccgagaaccgaacttaccaagcatcctctgcggctttcagatatactgcggggacaccatacaaggtcccaccgacccagagtaacactgctccacccccctactccccatcacccaacccctatcagacggccatgtatccaatcagaagtgcctacccccagcagaatctgtatgcccagggagcctactacacacagccggtgtatgctgcccagcctcatgtcatccaccataccacggtcgtccagcccaacagcattccctctgctatctacccagcacctgttgccgccccgaggaccaacggtgtggccatgggcatggtggcaggcaccaccatggcaatgtcagcaggtaccctgctgactacaccccagcacacggcgattggggcacaccctgtctccatgccaacatatagggcccaaggaacccctgcgtacagctacgtgcccccacactggtaaagcctgcagcccatccaaatctggagtcacacattgtatgcaactactcaagtcttacaccggtgctggagcagttccctagcagcaccacctctatttgcaagaagagacaacggaagtgcaagggtcactttatgcatctttaatggttttgatttttatttttggtttttgtaaaagctgctttttctaatctcctgcctctccccaactgtccccctcttagcccctgcccttccagctctatccccttcctcctacctgaccaggccatgtcctctctgctcttccctaagtgtcctgtccctggggatcccagtctagaggcaagcagagagtagggtttattgcagtggttcatctgaaggctggattccatttgaagagcataaacagatgtggtccagggtaggaactcagagctgttgagcaggctacatctctaggggagtgttctggttgttttttcttaagcaagattagttcaggacattcccatgtcccagacacaaatgaaatgtctcctgagaaccattgcaacagaccaagaacaaaaccacctgagtatgtaggcgtgttattagcagcttaataccccaggctgagaacctggggaaaaaagtctttagaatttgggggagggtggggggagggagggcattgtggggaaggagagggaagaagggaggagcggtgcttgcctcatggctttggtttgaaaggtctctggccaaagcatctggccctggaccttctgatttgcacagtgatgttaactga

SEQ ID NO: 3456 - DNA, 1364 bp, Homo sapiens
cggctactgcagaggattcagagccgagtcgctgaggaggaggctccggtccccgcgcgccatccgccaccctactggacacgggcgagagcgtcgccgccgtagcctccggagaagacaagggcatcgccgcctcagccgccgccgccgccgttttcgcctgcagctgctcaccggatcctcagtcttccacaatgaaccctgtttacagccccgtgcagcctggggctccttatggcaaccctaagaacatggcctacacgggttaccccacagcctatccagcagctgcccctgcctacaatcccagcctgtaccccaccaatagtcccagttatgctccagcaactctgctgatgaaacaggcctggccacagaactcgtcttcctgtggcactgaaggcaccttccacctcccagtggacaccgggaccgagaaccgaacttaccaagcatcctctgcggctttcagtaccctgctgactacaccccagcacacggcgattggggcacaccctgtctccatgccaacatatagggcccaaggaacccctgcgtacagctacgtgcccccacactggtaaagcctgcagcccatccaaatctggagtcacacattgtatgcaactactcaagtcttacaccggtgctggagcagttccctagcagcaccacctctatttgcaagaagagacaacggaagtgcaagggtcactttatgcatctttaatggttttgatttttatttttggtttttgtaaaagctgctttttctaatctcctgcctctccccaactgtccccctcttagcccctgcccttccagctctatccccttcctcctacctgaccaggccatgtcctctctgctcttccctaagtgtcctgtccctggggatcccagtctagaggcaagcagagagtagggtttattgcagtggttcatctgaaggctggattccatttgaagagcataaacagatgtggtccagggtaggaactcagagctgttgagcaggctacatctctaggggagtgttctggttgttttttcttaagcaagattagttcaggacattcccatgtcccagacacaaatgaaatgtctcctgagaaccattgcaacagaccaagaacaaaaccacctgagtatgtaggcgtgttattagcagcttaataccccaggctgagaacctggggaaaaaagtctttagaatttgggggagggtggggggagggagggcattgtggggaaggagagggaagaagggaggagcggtgcttgcctcatggctttggtttgaaaggtctctggccaaagcatctggccctggaccttctgatttgcacagtgatgttaactga

SEQ ID NO: 3457 - DNA, 589 bp, Homo sapiens
gggctgcggagaggcgggccgggccaagcggagccgagcgagcgggagcgcggcgtccgggaggcggcggagacgcggggctcggagggtcagcctcttatcgtagcaggtctcctcggcacgccccccttgtttcgccccacggccaagcccgccgcgggccggcgtgcgctggtcactgaggcccaggtcgccgccgcggcgcgtttttgaaatcatgaatcctgtttatagtcctggatcttctggggttccctatgcaaatgccaaaggaattggttatccagctggttttcccatgggctatgcagcagcagctcctgcctattctcctaacatgtatcctggagcgaatcctaccttccaaacaggttacactcctggcacaccttacaaagtgtcctgttcccccaccagcggggctgtgccaccgtactcctcctccccgaacgctgtgcccatgagtccctgtgcagaccagtgggcaaggcagctgggccagatctcaggccagccgtttgtgctcctagcagggttgctgtgctggccacacggagaggccctagagagcctcatggattgtaactaa

SEQ ID NO: 3458 - DNA, 944 bp, Homo sapiens
gtcggcggctccggtggctgcgcagcgtcggcggggagcgcgggctgcggagaggcgggccgggccaagcggagccgagcgagcgggagcgcggcgtccgggaggcggcggagacgcggggctcggagggtcagcctcttatcgtagcaggtctcctcggcacgccccccttgtttcgccccacggccaagcccgccgcgggccggcgtgcgctggtcactgaggcccaggtcgccgccgcggcgcgtttttgaaatcatgaatcctgtttatagtcctggatcttctggggttccctatgcaaatgccaaaggaattggttatccagctggttttcccatgggctatgcagcagcagctcctgcctattctcctaacatgtatcctggagcgaatcctaccttccaaacaggttacactcctggcacaccttacaaagtgtcctgttcccccaccagcggggctgtgccaccgtactcctcctccccgaacccctaccagactgccgtgtaccctgtgcgaagtgcctacccccagcagagcccgtatgcacagcaaggcacgtactacacacagccgctgtatgcagcacctcctcacgtcatccaccacaccacggtggtgcagcccaacggcatgcctgcaacggtgtaccctgctcccatcccccctcctagaggcaacggggtcaccatgggcatggtggctgggaccaccatggccatgtcagcaggtaccctgctgactgctcactccccaactcctgtcgccccccacccggtcactgtgcccacgtaccgggccccaggaacgcccacttacagctatgtgccccctcagtggtgatcacctgcaaatgtttgaggacggagctgtgcagtcacattattggggattccacagctggtgctgcaggccttgcgcctccaaccaggactttcttc

SEQ ID NO: 3459 - DNA, 5285 bp, Homo sapiens
ggggagcgcgggctgcggagaggcgggccgggccaagcggagccgagcgagcgggagcgcggcgtccgggaggcggcggagacgcggggctcggaggtttttgaaatcatgaatcctgtttatagtcctggatcttctggggttccctatgcaaatgccaaaggaattggttatccagctggttttcccatgggctatgcagcagcagctcctgcctattctcctaacatgtatcctggagcgaatcctaccttccaaacaggttacactcctggcacaccttacaaagtgtcctgttcccccaccagcggggctgtgccaccgtactcctcctccccgaacccctaccagactgccgtgtaccctgtgcgaagtgcctacccccagcagagcccgtatgcacagcaaggcacgtactacacacagccgctgtatgcagcacctcctcacgtcatccaccacaccacggtggtgcagcccaacggcatgcctgcaacggtgtaccctgctcccatcccccctcctagaggcaacggggtcaccatgggcatggtggctgggaccaccatggccatgtcagcaggtaccctgctgactgctcactccccaactcctgtcgccccccacccggtcactgtgcccacgtaccgggccccaggaacgcccacttacagctatgtgccccctcagtggtgatcacctgcaaatgtttgaggacggagctgtgcagtcacattattggggattccacagctggtgctgcaggccttgcgcctccaaccaggactttcttcttaatgctctcgacacttagctaaacacgactatatcccggcccagcaggccccagcgccgttagtctccagctgactctgtgggttggtcttaaagcaaattctgttttgtggactgcctggcaattttttagctaactgtaatgataaaaagggagtattaatctattctgaatcatatctagttgaatgcatgtttaaaaaaacaaacacaaaaagcttgctcaatctacctgcagtgactgatgcaaaaccatcatatgcaaaatccaaaggaatggaaacgtattttacaacttgtatcactaatgcactgttgtaatgtatgcaaagtcttacagttataagtgttaaagtgaatttcttcatagagcatctgaaatatcttagatgattcttcaaccttttggggttgatgtgggttgccagttagggatgtggacattttagttttcagcgacctgtttctttggcactgactgtcctgggagggagttgcgaggtttgggagagagtagggaagccacagctgcttgggtgcagctggttcatggacatccctttgagtttaggcttggtggagtcagtggaacagggacatgcttaaagctcatcatgaaagattatggtagtgtggccagtgaaatttggggcgaggggggtggtttatgtgtcagcaaagcagtttctctgctatctaaattttcattacagttctcttagagagatgatgtttttatatgtctttattggaaaagtcctatgtaaaactaaattattttcctgggatggaagaaatgtgaaagagaaacagccatgcttgcaggaggtattgtcctctgctttatttagcttagaaaatcattcctttttttttttttttcctggagaaatgtttgaatcagctgaaaacaggtaggcattgctgtttttccccaacaaagaagggcaaaggtttcagctgtatgttatgaagaaagtggtatatttaagaatgagttaaaagggaacaaaactttatttaaaattcctccaatttcttgtagaaaggcagggccgtggatatgtctggaaatgtagaaacctgtagctgcttctgggatcacccacctgatggtggtgacttgtctgctgaggccggctggaggggacgcttagagatggggcgagggggaggccagtgtctgttgtctgcgagcctctcctgccatctcttttgcagctgagggcacttggcacaaagcaagcacagacagcagagagggccaggcagtgctggagtgcgtttgctggcagggtttattgtgggagaggaatttgagtttaggatctgaatcttgtacataagaaatgaaaaggcttccctccaccccgcccccaaaatatgcccgtcctgtatccatgagagtgcatgtcggttctcagtgagggtcagagtgggggtgggggatgtaaggcctgggtccctttcagcggcctctagggcaggagcgtgcgtcttcttcccagtgcagtggtggtttgagtgctgtgggctctggtggggagggggctctgctcctcttcatttgctggtagctgggtcagggcactggcgcccagtgaggatgcccactagcattctgccccagttggttggtggggggacacctgaccactgagcctttggtaaccttattttttatagtaagtacttcttataattttctttttcacatcttattttataagaagtttaggaatatttttgcatggatcattgtaaacagcagattctttattcctgatgtctattaacatagaatgtttactgataagtactttaaattgcttcatgagcacttaatccatcttagtgtctatgtgtgggggcagacatttaccgcaggcacacagtttgtgcccctttcttcaagtctctgttggtaattccatctgtttagtggatggttggcaggattagtaggttctaacggttccaggggttcagctgaccaagtagcagagaagtcttttttcccaattgagtgctaatagattaggataaaatactcacaatgttagtgtatgcttttaaaaagccccacacaacaaaatggaaacatacatgtacaactcctgtgagggctggagtcttggggttcaggaggaggttagaagttacaggcatctcttcaggcttgcttggtacttggcacacacaggatggtgttttaaagagtgggctgcaccccccacacgccatttacatcagcttcataaacacttttcttcctccctgtaacttaaccttttttcccttttatgaagttgagaggctttatgaaataagtttgcattgcacatccgtgcagaaatctttctgactttgaaatttttaggacgtcagctgtcagatacgaaaggtagatatcaggtaagaatctggacttaggaaatagtcacaaaactgtcataggttgtaattttatcaacattcgcttctagtaaaattaaagtcaattaagaaatagaacttgggtcaaaattctgttacaaagcttcataatttgtcccgaagcatatggtggagcattctgagaaatttgctttttgtgtgtttgacattcctaatttgggagtccttcagctgaattactattcttttagaagttgagacagcaggtaagcaaaggacctagttcatgtaaacatggacatcatgatggctatttaaaaaatatttgttctacaccttctcccctgaggcttggggagtgtgttcagccgctgcagtttctctgctcatggaggtcttgtttggatctgtgctggcggctgagcatttagtgtgagccagtgacccatgaacttgccgctctgtgagggccagagtcagggccagtcatggtaatgggcctgaaggcacttccagaaccttttatgtctctcgtgagccatctgttaagaacgttcttcttggtgtggtttgtaggcctacctgtcgctattctgggaaaccttcttgagtgctatgcaaatgtgttcacaggcaatgggggtggtcctgagccttggggtgggcacctggtcagtgagtgtcttgcccttccccagctgggcatacagtaccttgctctttctggtggcatcatctggctgtgatgaatgaggtctaggaaataatttgcatgtgtcttgggggacacaacagtaacgagaggaaatacattattacagcaacttgcgacgtactaatacctgtcagtgttggcccccgtaaggtatgtaaggcacctgtgagtgccagtgagtgctggtgaaaggccaacatgtactagttatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctcaccacaggctgtgcccatgagtccctgtgcagaccagtgggcaaggcagctgggccagatctcaggccagccgtttgtgctcctagcagggttgctgtgctggccacacggagaggccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcattgaacttacgtatccatgccaaggaatggaatttccatcctgagccagttcagttaggtgtcaattgatactattttaattttttatgcaatctgatgagatgagctcagatttaaaaatctcaaaagcacgtttattgtaacaagaattgttatgtattaatactgcagttttcaataaagattgacttgtgttgca

SEQ ID NO: 3460 - DNA, 2261 bp, Homo sapiens
atggccgcgcccactctgggtaaatttcaggagggcctacgcggggctggagaactccaccgggctatgcgaacagaatcctgcgaagaggatggcattccctgtggatatgctggaaaattgcagccatgaggaattggaaaattctgctgaagattacatgtcagatttaaggtgtggggaccctgaaaatccagagtgtttttctcttctcaatattacgattcctattagcctgtcaaatgtaggctttgtacctctttatggtggagatcagacccagaaaattcttgctctctttgcacctgaagattcactgacagctgtggcactttaccttgctgatcagtggtgggctattgatgatattgtgaaaacatctgttccttcaagagaggggcttaagcaggaagcatatgtgcctcttttcttacccaaagttaccaattgccagttcttgatacaatgtttctaagaaagaaatacagaggtaaagattttgggcttcacatgctggaggactttgttgattcctttacagaagatgcgcttggcttgcggtatccactgtcttctctcatgtatacagcttgcaagcaatactttgagaagtatccaggagaccatgaactcctttgggaagttgaaggtgttggacactggtaccagcgaataccagtcaccagagcattacaaagagaagcacttaaaattctagcactttctcaaaatgaacctaaaagacctatgtctggagaatatggtcctgcatctgttccagaatacgaagcaagaactgaagacaatcagtctagtgagatgcagctaactattgattctctaaaagatgcctttgcaagcacttccgaaggtcatgataaaacatctgtttccactcatactcgaagtggtaatctaaagcggccaaagattggaaagcggtttcaggattctgaatttagcagttctcaaggtgaagatgaaaagacctcccagacttcacttacagcttcaataaacaaattggagtctactgcacgcccatcagagagctcagaagaattcctggaagaagaacctgaacagagagggattgaatttgaggatgaaagcagtgatagagatgcacggccagcactggaaacccagccacagcaagagaagcaagatggtgaaaaggaatctgaattagagcctatgaatggtgagataatggacgattctcttaagacctcacttataacagaagaggaagactccactagtgaagttttagatgaagaattaaaattgcagccttttaattccagtgaagactctacaaatcttgttccactggtggtagaatcttcaaaaccccctgaggtagatgcaccagataagaccccacgtatacctgactcagaaatgttgatggatgaaggcacatctgatgaaaaggggcacatggaagagaaattgtccctacttccaagaaagaaagcacatcttgggagttcagacaatgttgctactatgtcaaatgaagaacgatctgatggtggttttccaaactctgtgatagctgaattttccgaagaaccggtctctgagaatttgtctcctaatactacttcctcattggaagaccagggtgaggagggggtatctgagccccaggaaacatctactgctcttcctcagagttctttgatagaggttgaacttgaagacgtgccattttcacagaatgcaggacagaagaatcagtcagaggagcagtctgaagcatcttccgagcaactggatcagtttacacaatcggcagaaaaagctgtggatagcagctcagaggaaatagaagtggaagtgcctgtggtagacaggcggaatttaagaagaaaggccaaagggcataaaggacctgctaagaagaaagctaagctgacctgaaggaagaagaaagtggatgataaatcctcttctttgtaacatagttgttgtttttaaaatatggtaattaataaacagcatggggcacaggacaaaaatttccaaaatttcaatttgaacttacttactatgcagttttttgcttccctttagaacgtagaattcaccattgtttttaattttccaggctatttttggtaaatgcaattttttatttttattaaccatgtttcaattttgggaaaccagatcatattatattttctttatcaggtggtacatctgaccattatttcaaaaatataattaaaaagctgtgaaagtagtag

SEQ ID NO: 3461 - DNA, 5990 bp, Homo sapiens
atggccgcgcccactctgggtaaatttcaggagggcctacgcggggctggagaactccaccgggctatgcgaacagaatcctgcgaagaggatggcattccctgtggatatgctggaaaattgcagccatgaggaattggaaaattctgctgaagattacatgtcagatttaaggtgtggggaccctgaaaatccagagtgtttttctcttctcaatattacgattcctattagcctgtcaaatgtaggctttgtacctctttatggtggagatcagacccagaaaattcttgctctctttgcacctgaagattcactgacagctgtggcactttaccttgctgatcagtggtgggctattgatgatattgtgaaaacatctgttccttcaagagaggggcttaagcaggtgagcactcttggggagagagtggttctgtatgttctgaatcgaattatttatagaaaacaggaaatggagagaaatgagatcccattcctgtgtcatagcagtactgattatgctaagattctgtggaagaaaggagaggccattgggttttattcagttaagcctacaggaagcatatgtgcctcttttcttacccaaagttaccaattgccagttcttgatacaatgtttctaagaaagaaatacagaggtaaagattttgggcttcacatgctggaggactttgttgattcctttacagaagatgcgcttggcttgcggtatccactgtcttctctcatgtatacagcttgcaagcaatactttgagaagtatccaggagaccatgaactcctttgggaagttgaaggtgttggacactggtaccagcgaataccagtcaccagagcattacaaagagaagcacttaaaattctagcactttctcaaaatgaacctaaaagacctatgtctggagaatatggtcctgcatctgttccagaatacgaagcaagaactgaagacaatcagtctagtgagatgcagctaactattgattctctaaaagatgcctttgcaagcacttccgaaggtcatgataaaacatctgtttccactcatactcgaagtggtaatctaaagcggccaaagattggaaagcggtttcaggattctgaatttagcagttctcaaggtgaagatgaaaagacctcccagacttcacttacagcttcaataaacaaattggagtctactgcacgcccatcagagagctcagaagaattcctggaagaagaacctgaacagagagggattgaatttgaggatgaaagcagtgatagagatgcacggccagcactggaaacccagccacagcaagagaagcaagatggtgaaaaggaatctgaattagagcctatgaatggtgagataatggacgattctcttaagacctcacttataacagaagaggaagactccactagtgaagttttagatgaagaattaaaattgcagccttttaattccagtgaagactctacaaatcttgttccactggtggtagaatcttcaaaaccccctgaggtagatgcaccagataagaccccacgtatacctgactcagaaatgttgatggatgaaggcacatctgatgaaaaggggcacatggaagagaaattgtccctacttccaagaaagaaagcacatcttgggagttcagacaatgttgctactatgtcaaatgaagaacgatctgatggtggttttccaaactctgtgatagctgaattttccgaagaaccggtctctgagaatttgtctcctaatactacttcctcattggaagaccagggtgaggagggggtatctgagccccaggaaacatctactgctcttcctcagagttctttgatagaggttgaacttgaagacgtgccattttcacagaatgcaggacagaagaatcagtcagaggagcagtctgaagcatcttccgagcaactggatcagtttacacaatcggcagaaaaagctgtggatagcagctcagaggaaatagaagtggaagtgcctgtggtagacaggcggaatttaagaagaaaggccaaagggcataaaggacctgctaagaagaaagctaagctgacctgaaggaagaagaaagtggatgataaatcctcttctttgtaacatagttgttgtttttaaaatatggtaattaataaacagcatggggcacaggacaaaaatttccaaaatttcaatttgaacttacttactatgcagttttttgcttccctttagaacgtagaattcaccattgtttttaattttccaggctatttttggtaaatgcaattttttatttttattaaccatgtttcaattttgggaaaccagatcatattatattttctttatcaggtggtacatctgaccattatttcaaaaatataattaaaaagctgtgaaagtagtaggatttccattacttataaggatcacagaaatcttttatactaagggttttaatagtaaaacttggtgagggttctagaagttttaaatttcaaaactaatcaccaattttttaaaatgtaggcatgcctaaacaaaaataagtgtcaataaattagaaaaaatataacttcaagtaaatgagagcacaaaaacagaaacttacggtcaaaggttcatgaagatattttggttttggcctcttaatcctagatatagatgcagttttttcctttgacttcactatctatggaaaggtacacataaaatctgtttctgattcattctatcatctgatgttaacagtactgtcagggatttaactgtggcatgtggggactaattatttaaaatttcatttgaagtattagtttgctgtaattttttttgtctgcatatgtgcagacgcctagaagtttagactttcacctttaatcaggtaaaaatcacaactatactttggagacatggtttaatttggacttctggtcctgatcagatagataaattaagctggagattttacttttatcccaacccagttaacatctatatttcagaagtatgaggctccttcctaaggcatctccttaaatcttgccacctccctaattctacagtcttatttatattcccccacagctttcatctacttctgtaactcatggagtgattctccaatcaacagatcttcctgcctgccggcttatgcccttgatgtccatttttgggtaggtttggaggtgcaccccacaatgttagacctatatggcaggagtaaaactgcccccagtgttagacctatatggcaggggtaaactgcctttgggggagctgtggttacaagggcttcaatcatattggaggcttcaatcatcctttgatttgtactgagtactggttgcaagctggcctgttaagtatatattgtgttgccataacaaaggcctaggaaaatttgaagaaaaaaaacactgaactgttattttttgtaatttatttaaaaatggacaaaatggttattagaatccaaagataatctaaaaacagttctactctttggaaatattatgtgtactcaaatttgcacttaagttggagaatgttttgagaccatttaaattgttttaaaaatagcttgatcttgatccttatgcaaaagaaactaagactttgtgtcattatttgaggtagctaaggactgatgttgaaagtgtattcagtctatagtaagctgatgtcaggtcagtaaattttgtttggggatgttggtattttcgatcaagttaaaatcttaaagcagacaaaaatagtaaacgctcctatttgtgttagattttgaacaattgtattaccctatattttctttaattagtcaaaggtaagccagattatttcattctaaatgaaaattaaagcactttggccatttattttttcaacaaatgctaatactaagtaaaaaaaaaaaagtatgactactattagtgaatctaccaaacatttatgctgttttatacattttatgagaaacttctgtcaatatcacaaagggaaatactctgttaagattcagtaaattcttaatctttacatgtttcatttcttagatttgaaaacacttgtagatattttatttttacttggatttgtttaaaatactttcttttcaaattattttaaacatggaaacgcttcatgaatttgtgtcatccttgcacaggggccatgctaattttccctgtattgttctaattttagtatatgtgctgccgaagtgagcactaaaagactttctttagacaagtgtagttttttaaagattgagctcactggctcaactcttgatgtgtgaatatagttgagtttacaaaaaatgtttattaatcatatatgaccattgggggctaacagtataaacttattcttgttaaacttgtttgggttaaatagtaagtgaattgtaaacaatttagaagttttttgttcagcacacaagaacacttctgttacagattctctctgacagaaattgttattttggggtttatagattatagagggaaaagttagatcacttggaaaaacctaactctcatgttcagtaacttgagtatagaatttataccacaatttatcttcaataaggaacctacatgaacttaatcagttatctgtagtttttgcaaggcattagaaaaaatttcacaattacagaggactgaaaatgtgatttcaaccggctagtctagttgttgaatgtccagtcacattacacatagtcctttgtgaacttatttgtgaagggagttcactttttatgtacatacgtgtatatttccttgtgtaatataaagcagatggttattagtattttagttctttcaagtttaaattattcaattgctagacatcacagaaattagtatatttaagaatttattataaagctcctctacaacttttaaaggtgagagggtctattatgatttttttataaaatcaaacagcatgatttagaacgtcagtcttctacttaaaatgtgtctatattcatggtatttccattcagtgtagatggtaaggaaaacatctagtcattaaagatttacttatagcagactccagaacactacctacaatggggtttcagtgactagaaatcttgaaggtttatgattgcatcaaattgagcctgtactaatatctaaatatctgctcttatgttctgctttatcccttgggattaccttctaaggtttggtcacaccagcaaactgaaacagatcttaatgtacataaaaaatttatactaatattactcatctgtgttacagtattttgaaaaatgtttcaggtgtcatctagtcgtctttcatgggtgtgattagttacaaatgttatgcttatgttttcatacttaatatcaagctttctttgtaccttacaagatagtatttttggttctaaaaaaaacaagcaaacttcatttttgtagtatccagaaattacctggagtcagtatttttattcgccttctagaacttgtgatccacacatcacccatttatattagtggtaaaattatctgctaaaatctaattgtaagaaaggcttaccttctgtcatcaagtgattgtatcatcctggatcgtcatttccaaggaactagcctttcttttcctaagcgtctgtatgtgttctaaaacttccagtatatatttatagaacttagaaaaaatgttacattattcagagtagcaagtcttactggagtacctatgtttgttttcttggtttttatttttttttaagtttaaaagtagtaattaaacctatattttgtgattgtttcctggtctgtgtttttaaattcctttccttcagttttcctcatgaagatgtttcagatactgaatttgtttagacattgaatgactttgttaaaggcacaattaatcacattggttgtactctgaagacagacttctttaaaaaaaaaataaacaatttaaaacaa

SEQ ID NO: 3462 - DNA, 571 bp, Homo sapiens
attctccctcctctggaatgctggtcgttgcagttttgtcctaattgtgttctcagctctccattatgccatttttcaagaggcctgtgcctcaggaggtgaagccttgaaccctgggtggtttatggctcgggggtctggattacactgactcccatgactgtccttggggagaaaggatgaagcatctcactggcttttcagcgtctgggaagcggcgtgggtatcgtatcgggtggattcgaagataaccacctgatgcaggtcaccttcccccgctgggagagccgttcctaacgtaaattaaaacaggatggcattccctgtggatatgctggaaaattgcagccatgaggaattggaaaattctgctgaagattacatgtcagatttaaggtgtggggaccctgaaaatccagagtgtttttctcttctcaatattacgattcctattagcctgtcaaatgtaggctttgtacctctttatggtggagatcagacccagaaaattcttgctctctttgcacctgaagattcactgacagctgtggcactttaccttgctgatcag

SEQ ID NO: 3463 - DNA, 803 bp, Homo sapiens
cccacgattctaacttgcatgcacctaagtggcagtaggtttaggatgaaagtggtggggcggaggccggcggtcctcgcccgtgccctctgcacccctgtcccgaggccgggatggccgcgcccactctggaggatggcattccctgtggatatgctggaaaattgcagccatgaggaattggaaaattctgctgaagattacatgtcagatttaaggtgtggggaccctgaaaatccagagtgtttttctcttctcaatattacgattcctattagcctgtcaaatgtaggctttgtacctctttatggtggagatcagacccagaaaattcttgctctctttgcacctgaagattcactgacagctgtggcactttaccttgctgatcagtggtgggctattgatgatattgtgaaaacatctgttccttcaagagaggggcttaagcaggtgagcactcttggggagagagtggttctgtatgttctgaatcgaattatttatagaaaacaggaaatggagagaaatgagatcccattcctgtgtcatagcagtactgattatgctaagattctgtggaagaaaggagaggccattgggttttattcagttaagcctacaggaagcatatgtgcctcttttcttacccaaagttaccaattgccagttcttgatacaatgtttctaagaaagaaatacagaggtaaagattttgggcttcacatgctggaggactttgttgattcctttacagaagatgcgcttggcttgcggtatccactgtcttctctcatgtatac

SEQ ID NO: 3464 - DNA, 751 bp, Homo sapiens
agtgcgtcacgtcgtcggagggcacggtgggccgcggccgacccgcgacgaggagccgggcgtccggggcgagcgggaggcagccgcactcgccctggcagccgcgagctgtgcggcctgggaccggccggaggtcgccagcgagcagccgccggctccattcattcgcgcggctccgcctcctttcccgggctcttccagcggctcccggggcgcgtctgagaggatggcattccctgtggatatgctggaaaattgcagccatgaggaattggaaaattctgctgaagattacatgtcagatttaaggtgtggggaccctgaaaatccagagtgtttttctcttctcaatattacgattcctattagcctgtcaaatgtaggctttgtacctctttatggtggagatcagacccagaaaattcttgctctctttgcacctgaagattcactgacagctgtggcactttaccttgctgatcagtggtgggctattgatgatattgtgaaaacatctgttccttcaagagaggggcttaagcaggtgagcactcttggggagagagtggttctgtatgttctgaatcgaattatttatagaaaacaggaaatggagagaaatgagatcccattcctgtgtcatagcagtactgattatgctaagattctgtggaagaaaggagaggccattgggttttattcagttaagcctacaggaagcatatgtgcctcttttcttacccaaagttac

SEQ ID NO: 3465 - DNA, 3129 bp, Homo sapiens
gttgtggctgtttacataaaggaatcctggtgctccacggaagatgcactaagaacctctgatcctgcaagagaagggttgatgaaggttcagtcgtttggggaaagggttgtgcttttcattctaaacgccattatttttggaagattggagagaaatttggatgatgatgacatgttttttctacctcactctgtgaaggaacaagctaaaatcctgtggagacgtggagcggctgttgggttttacacaaccaagatgaaaggcagactgtgtggtgatggcaccggtgcatgctacctgctgcctgtctttgacaccgtgttcatcaggaggaaacactggcaccgaggcttgggaacagccatgctgcgggacttctgtgagacattcccagaggacgaggccctgggggttagctgctcgatgtctcctgccatgtaccaagcacacccaggaaattccgaggacgtgagccgtcatgcgaggacttctcagaatgacagacccagacagcctgcccctggagacggcagcaaggagaggatgtgtggagaagaactggaagacacaaaggatgatccagagtgtggagtggaagaggaggatgccgggctggcagggcagccaccaggcaagcttacaaggtccagtccctgacgtctccagacgcccatctgggccaggtccagaggcctgcctgggctcccaggattcgggtctgagacttgtgtgtctgggagtgtaccttccctggggatctttgaggggccagtgaccccacgggccccacctacctctgaggtgggctcaggctctagagtacctgagaacgtgctgcgctcagcatgcgacaccgtgccacagtgaggaagtatttccctaagttaattgttgacagttcctaaacgtttcagaagcttactcgttaaaactaatgtggtttctgtttctcaggataaattggtgggactttaccggaaccacagggatgttttactgaatgtacctctttccttatagaagtttaaagatgctcaggaaggggccacacccgttccatctgggctgtagaaacccattgcaggtttgtgcatgccagccctgctgttgccgtgagaccacggacaccaaagaggtttgcaggggtacacgtgtcctttccggacaccaaagaggtttgcaggggtacacgtgtcctttcccgggaggcttcagccacatcagtgctgatgtgcctcaaggcacatgagtgccttgagggcaggggcagtggctggatggtgcctactgtaggcctggagctctcttctggcctggtatacagaaggcactcagagagctcatatgggaagtactgggtaggaatttgggcagatggtgcttctagaatattggtggccttgagtggaaagtcttgtggtagtaaaagtaactgaaaatgatagcctggctcgaatgtgacattggcttcccccttctcaaatactgatggagccctgtttggtcgctatagtgtatggccgctcttgggatgcagagacaaggacctgctcttaggccccaggtccaatgggctaggcagagttgtcccagggccgcctgccctcctcaagggtggggcgcaaatccaggctgctttagggagcccaaagcctgctccccgagaggtggggtggtgctttctctgctattgggcccagccttgctgatttcagtaggatttttcccagagaaagctggtcaggccctcttgaggcagacgacccaagttcttgcccctgcttttgggaaaatgcaaatccaatcccattgccgaggacatcccaaacccctctgtgctcatcactgactttggagaagccaggggccctgctgcctctgctccttgccattggagttcagctgcaggatcagccctgggctgcctggttactttgttgacagaagaagagggttttacctttttaggatgtaataaagcccctcctgtggcctgatgaggagactaccaacagtcccaagttctgggaatatatcgtctgttcccttgagcagtcaaaggacacacatggtgggacctgttatttattcatccatgcacccagctgtccatctctctgtccatccatccgtctatccatccatcatccatccatccacctaaccatccatctattcaatccattcatcatccatctatccatccctccatccatccattcatccatctatccatccatcatccgtccatcctccatccatcatccatccatccatcctccatccatcatccatccatccatccatccatccatcctccatccatcttccatccatccatcctccatccatccatctatccatccatccacccatccatccatccatccacccatccatcatccatccatccatcctccatcttccatccatccatccatccatccatccttcatccagccatccatctatccatacatttatcatccatccatccatcatccatccgtccatcctccatccatccattcatcctctatccatccatcatccatccatccatccatccacccatcctccatccatccatccatcctccatccgtcatccatccgtccatccatccatccatccattctgttgtacaacagatattcagcatgctttctcagggacatgctctgtgctggggacaggggatataagtgaggtatggatactggcctcaggaaactctcttctctttggaggaatctcttctggagtgttccactggagttttcatctctcttgcacccattacaaagatggaagggtccaattgactagaaatatagtttagagattcatatggagacatcatgaagcctgcctcccccctgccccttatacttgggctctctgtgcaggtggcacagaccataaaaggagagtgaagtctacagcctagagggtgccctgtgtgtggtgtcagatgtaacctttcacatgggatgtgtgtgctgtgagcattgtgctatttgagatgaatggttagtattttgtgtttacatgaaaataaatgtttaaaaatgtctcaggggtttgatgaagttactattcaataaaagaaacctctcagggaag

SEQ ID NO: 3466 - DNA, 3298 bp, Homo sapiens
aactccgcaagcaaatgaaaaacatcctggaattgtgaattcccctgtggcaagtggttatcgttcgtggtggcagtctgctgttacgagcataataggatgaatatggactttgacgtcagatggagctgacttggaatcctggctctgccagctgactggcagaggggttgtggctgtttacataaaggaatcctggtgctccacggaagatgcactaagaacctctgatcctgcaagagaagggttgatgaaggttcagtcgtttggggaaagggttgtgcttttcattctaaacgccattatttttggaagattggagagaaatttggatgatgatgacatgttttttctacctcactctgtgaaggaacaagctaaaatcctgtggagacgtggagcggctgttgggttttacacaaccaagatgaaaggcagactgtgtggtgatggcaccggtgcatgctacctgctgcctgtctttgacaccgtgttcatcaggaggaaacactggcaccgaggcttgggaacagccatgctgcgggacttctgtgagacattcccagaggacgaggccctgggggttagctgctcgatgtctcctgccatgtaccaagcacacccaggaaattccgaggacgtgagccgtcatgcgaggacttctcagaatgacagacccagacagcctgcccctggagacggcagcaaggagaggatgtgtggagaagaactggaagacacaaaggatgatccagagtgtggagtggaagaggaggatgccgggctggcagggcagccaccaggcaagcttacaaggtccagtccctgacgtctccagacgcccatctgggccaggtccagaggcctgcctgggctcccaggattcgggtctgagacttgtgtgtctgggagtgtaccttccctggggatctttgaggggccagtgaccccacgggccccacctacctctgaggtgggctcaggctctagagtacctgagaacgtgctgcgctcagcatgcgacaccgtgccacagtgaggaagtatttccctaagttaattgttgacagttcctaaacgtttcagaagcttactcgttaaaactaatgtggtttctgtttctcaggataaattggtgggactttaccggaaccacagggatgttttactgaatgtacctctttccttatagaagtttaaagatgctcaggaaggggccacacccgttccatctgggctgtagaaacccattgcaggtttgtgcatgccagccctgctgttgccgtgagaccacggacaccaaagaggtttgcaggggtacacgtgtcctttccggacaccaaagaggtttgcaggggtacacgtgtcctttcccgggaggcttcagccacatcagtgctgatgtgcctcaaggcacatgagtgccttgagggcaggggcagtggctggatggtgcctactgtaggcctggagctctcttctggcctggtatacagaaggcactcagagagctcatatgggaagtactgggtaggaatttgggcagatggtgcttctagaatattggtggccttgagtggaaagtcttgtggtagtaaaagtaactgaaaatgatagcctggctcgaatgtgacattggcttcccccttctcaaatactgatggagccctgtttggtcgctatagtgtatggccgctcttgggatgcagagacaaggacctgctcttaggccccaggtccaatgggctaggcagagttgtcccagggccgcctgccctcctcaagggtggggcgcaaatccaggctgctttagggagcccaaagcctgctccccgagaggtggggtggtgctttctctgctattgggcccagccttgctgatttcagtaggatttttcccagagaaagctggtcaggccctcttgaggcagacgacccaagttcttgcccctgcttttgggaaaatgcaaatccaatcccattgccgaggacatcccaaacccctctgtgctcatcactgactttggagaagccaggggccctgctgcctctgctccttgccattggagttcagctgcaggatcagccctgggctgcctggttactttgttgacagaagaagagggttttacctttttaggatgtaataaagcccctcctgtggcctgatgaggagactaccaacagtcccaagttctgggaatatatcgtctgttcccttgagcagtcaaaggacacacatggtgggacctgttatttattcatccatgcacccagctgtccatctctctgtccatccatccgtctatccatccatcatccatccatccacctaaccatccatctattcaatccattcatcatccatctatccatccctccatccatccattcatccatctatccatccatcatccgtccatcctccatccatcatccatccatccatcctccatccatcatccatccatccatccatccatccatcctccatccatcttccatccatccatcctccatccatccatctatccatccatccacccatccatccatccatccacccatccatcatccatccatccatcctccatcttccatccatccatccatccatccatccttcatccagccatccatctatccatacatttatcatccatccatccatcatccatccgtccatcctccatccatccattcatcctctatccatccatcatccatccatccatccatccacccatcctccatccatccatccatcctccatccgtcatccatccgtccatccatccatccatccattctgttgtacaacagatattcagcatgctttctcagggacatgctctgtgctggggacaggggatataagtgaggtatggatactggcctcaggaaactctcttctctttggaggaatctcttctggagtgttccactggagttttcatctctcttgcacccattacaaagatggaagggtccaattgactagaaatatagtttagagattcatatggagacatcatgaagcctgcctcccccctgccccttatacttgggctctctgtgcaggtggcacagaccataaaaggagagtgaagtctacagcctagagggtgccctgtgtgtggtgtcagatgtaacctttcacatgggatgtgtgtgctgtgagcattgtgctatttgagatgaatggttagtattttgtgtttacatgaaaataaatgtttaaaaatgtctcaggggtttgatgaagttactattcaataaaagaaacctctcagggaag

SEQ ID NO: 3467 - DNA, 1336 bp, Homo sapiens
gctgctccttcactaagcggtctgagttctttagctatctcggagattcaactacgtttactcgtactgaatctttttaatgaatttcctgagagccaagaagggccaatctacaggaaaaagtgggaggtggacattaagcatcttctagaaactcttctagctgatatcatgaaacgacgacaaaagaggaaacatttggaaaatgaagagtcccaggaaaccgctgagaagggaggaggaatgtcaaagtcccaagaggatgccctgcagcctggatccactagagtggccaaaggctggagccaaggggtgggagaagttacttctacctccgaatactgctcctgcgtttcttcttcacgcaagctcatccacagtggaatccagagaatacatcgagacagcccccagcctcaatcacccctggcccaggttcaggaacgaggagagactcctccccgctcacaacatgtctccttgtcgtcctattcatcctataagacttgtgtgtcctctctgtgtgtaaacaaagaggaaaggggcatgaaaatatactacatgcaggtacaaatgaacaaaggtgtggctgtctcctgggagacagaggaaactttggagtccttagaaaagcagccaaggatggaagaagtgaccctttctgaggttgtgagggtaggtactcccccctctgatgtgtccaccagaaacctcctgtctgacagtgagcccagtggggaggagaaagagcatgaggaaaggacagaatcagacagcctgccaggctcacccaccgttgaggacacacccagagccaagactcctgactggctggtgaccatggagaacggcttcaggtgcatggcctgctgccgggtgttcaccaccatggaagccctccaggagcatgtgcagtttgggatcagagagggcttcagctgccacgtctttcatctcaccatggctcagctgacaggcaacatggaatcagagagcacccaagatgagcaggaggaggaaaatggaaatgagaaggaggaggaagagaaaccagaagcaaaggaggaggaggggcagcccacagaagaagaccttggcctgaggagatcctggagccaatgtccaggctgtgtgtttcattctccaaaggacaggaactgagacttatgggccagaagatactggaagatggtgtggccttctcttgcaagagggagaagaaagagccatggagatagtagcagacaggctgcccaaggtatgaagcagatgagggaccagcactcagtctaacatgtaaacatcatacgtaataaaggttgtgtttcaaacctta

SEQ ID NO: 3468 - DNA, 1234 bp, Homo sapiens
aaccttaacagccctgcagtgtagtgggcactgggcagtgctgctccttcactaagcggtctgagttctttagctatctcggagattcaactacgtttactcgtactgaatctttttaatgaatttcctgagagccaagaagggccaatctacaggaaaaagtgggaggtggacattaagcatcttctagaaactcttctagctgatatcatgaaacgacgacaaaagaggaaacatttggaaaatgaagagtcccaggaaaccgctgagaagggaggaggaatccagagaatacatcgagacagcccccagcctcaatcacccctggcccaggttcaggaacgaggagagactcctccccgctcacaacatgtctccttgtcgtcctattcatcctataagacttgtgtgtcctctctgtgtgtaaacaaagaggaaaggggcatgaaaatatactacatgcaggtacaaatgaacaaaggtgtggctgtctcctgggagacagaggaaactttggagtccttagaaaagcagccaaggatggaagaagtgaccctttctgaggttgtgagggtaggtactcccccctctgatgtgtccaccagaaacctcctgtctgacagtgagcccagtggggaggagaaagagcatgaggaaaggacagaatcagacagcctgccaggctcacccaccgttgaggacacacccagagccaagactcctgactggctggtgaccatggagaacggcttcaggtgcatggcctgctgccgggtgttcaccaccatggaagccctccaggagcatgtgcagtttgggatcagagagggcttcagctgccacgtctttcatctcaccatggctcagctgacaggcaacatggaatcagagagcacccaagatgagcaggaggaggaaaatggaaatgagaaggaggaggaagagaaaccagaagcaaaggaggaggaggggcagcccacagaagaagaccttggcctgaggagatcctggagccaatgtccaggctgtgtgtttcattctccaaaggacaggaactgagacttatgggccagaagatactggaagatggtgtggccttctcttgcaagagggagaagaaagagccatggagatagtagcagacaggctgcccaaggtatgaagcagatgagggaccagcactcagtctaacatgtaaacatcatacgtaataaaggttgtgtttcaaacctta

SEQ ID NO: 3469 - DNA, 945 bp, Homo sapiens
aaccttaacagccctgcagtgtagtgggcactgggcagtgctgctccttcactaagcggtctgagttctttagctatctcggagattcaactacgtttactcgtactgaatctttttaatgaatttcctgagagccaagaagggccaatctacaggaaaaagtgggaggtggacattaagcatcttctagaaactcttctagctgatatcatgaaacgacgacaaaagaggaaacatttggaaaatgaagagtcccaggaaaccgctgagaagggaggaggaatccagagaatacatcgagacagcccccagcctcaatcacccctggcccaggttcaggaacgaggagagactcctccccgctcacaacatgtctccttgtcgtcctattcatcctataagacttgtgtgtcctctctgtgtgtaaacaaagaggaaaggggcatgaaaatatactacatgcaggtacaaatgaacaaaggtgtggctgtctcctgggagacagaggaaactttggagtccttagaaaagcagccaaggatggaagaagtgaccctttctgaggttgtgagggtaggtactcccccctctgatgtgtccaccagaaacctcctgtctgacagtgagcccagtggggaggagaaagagcatgaggaaaggacagaatcagacagcctgccaggctcacccaccgttgaggacacacccagagccaagactcctgactggctggtgaccatggagaacggcttcaggtgcatggcctgctgccgggtgttcaccaccatggaagccctccaggagcatgtgcagtttgggatcagagagggcttcagctgccccaagatgagcaggaggaggaaaatggaaatgagaaggaggaggaagagaaaccagaagcaaaggaggaggaggggcagcccacagaagaagaccttggcctga

SEQ ID NO: 3470 - DNA, 1213 bp, Homo sapiens
tgctgctccttcactaagcggtctgagttctttagctatctcggagattcaactacgtttactcgtactgaatctttttaatgaatttcctgagagccaagaagggccaatctacaggaaaaagtgggaggtggacattaagcatcttctagaaactcttctagctgatatcatgaaacgacgacaaaagaggaaacatttggaaaatgaagagtcccaggaaaccgctgagaagggaggaggaatgtcaaagtcccaagaggatgccctgcagcctggatccactagagtggccaaaggctggagccaaggggtgggagaagttacttctacctccgaatactgctcctgcgtttcttcttcacgcaagctcatccacagtggaatccagagaatacatcgagacagcccccagcctcaatcacccctggcccaggttcaggaacgaggagagactcctccccgctcacaacatgtctccttgtcgtcctattcatcctataagacttgtgtgtcctctctgtgtgtaaacaaagaggaaaggggcatgaaaatatactacatgcaggtacaaatgaacaaaggtgtggctgtctcctgggagacagaggaaactttggagtccttagaaaagcagccaaggatggaagaagtgaccctttctgaggttgtgagggtaggtactcccccctctgatgtgtccaccagaaacctcctgtctgacagtgagcccagtggggaggagaaagagcatgaggaaaggacagaatcagacagcctgccaggctcacccaccgttgaggacacacccagagccaagactcctgactggctggtgaccatggagaacggcttcaggtgcatggcctgctgccgggtgttcaccaccatggaagccctccaggagcatgtgcagtttgggatcagagagggcttcagctgccacgtctttcatctcaccatggctcagctgacaggcaacatggaatcagagagcacccaagatgagcaggaggaggaaaatggaaatgagaaggaggaggaagagaaaccagaagcaaaggaggaggaggggcagcccacagaagaagaccttggcctgaggagatcctggagccaatgtccaggctgtgtgtttcattctccaaaggacaggaacagctgagacttatgggccagaagatactggaagatggtgtggccttctcttgca

SEQ ID NO: 3471 - DNA, 1401 bp, Homo sapiens
gctggggccagctggaggccttcagtacagccccagccaactctcactgaacagctggagcaccgacaccctgggcactcatttcaaatcatgaaatgctacttcacagatcacaggggagaacagtcacccaccgatgggaccaccctcagcttgaccagccctgagtccactgaggagagtgtggaagtgttctggccagggactatacagagagaagggtcgtccccacggccggggcctgccattccccgggaggagggcctctacttcgctgccagggaccgggggatgcgggactggagcagctccccatcctcagagtcctccgagtaccagtcctactcccagtaccagtcgtgctgctcctgcatgtgcgatgaggacaatgctgctccgcagagtgtgtgtgccttctacacgcacgtgcagactgtgcggggtgtggctgtggcctgggagacggaggccggcttcgagccggtcaccaggaagccccgcatccatgaagcccagttcatcaagaggcagaggtggaacggctcctccttcgaaatggcttccaacaccgatatgcgctgggacctggaagcctgcaagagcaactgcagccccgagcccgaggacatagacctgctggagtgctgcctgcaggagctgcgggagccgccggactggctggtcaccaccaactacggggtgcgctgcgtggcctgctgcagggtcttgccctccctggacgctctgctggagcacgcccagcatggcatccgggagggcttcagctgtcagatcttttttgaggagatgctggagagaaggcgggctcagggccaagcacatgaccaacagctggaggaggagcagagtccttcagacaacagcgaatgttcccggccccagggtgaggtgctctcagcacagcagcaggagaagcagtgagccagaggggagatacccaaccctgccctcacctccagggcctgggactgctccttccccagccagcagtatcagagccactagggcagggagagaggaccagggtcagggggaaggaaaggcatggagtgtagagcaaggagggccaggagactggaaggaacccccttcctgccctaggcacagcatctccaccagagtccatttcaaaacccaaacgagagggctttgagtgtttctgatggcaggcacaacatctgaaacccacaaacgcatggccagagggatttctatttttgccggtggatcaggcaggtccacacttgctaagtatatgtgggtcacaggacagccaactgcaaattactctccagccctatttttttcactattacaaatctgtcatatgccctagttctatgtcttatgttattgggattaaacttgaataacacaaaa

SEQ ID NO: 3472 - DNA, 1054 bp, Homo sapiens
attcaagcctgggccctggaaggaggggtggacagtcccctcccttccagtccagcatgggtctggggaagagaagcagctttgcctggaaggggcctcctaggagggggagcggtggtttctagctcaggctttaggatcagagagcagcagattcaaatcctgacggttttggtaaagtcaattcaatctctccaagactccgtttatttgatctgcgaagtggggataatggtatcacgtcgcagggttgtcaggcggagctggtaggggagctgccccccagagcagcatggatgccccgcgaagggacatggagttgctcagcaacagcctggctgcctacgcgcacatccgcgccaaccccgagagcttcggcctctacttcgtgctgggcgtctgcttcggcctgctgctcaccctctgcctgctcgtcatcagcatctcgtgggcgccccgcccgcggccccggggcccggctcagcgccgggacccccgcagcagcaccctggagcccgaggacgacgacgaggacgaggaggacacggtgactcggctgggccccgacgacacgctgccgggccccgagctgtccgcagagccggacgggcccctcaacgtcaacgtcttcacgtcggcggaggagctggagcgggcgcagcggctggaggagcgcgaacggatcctgcgggagatctggcgcaccgggcagccggacctgctgggcacaggcacgctggggcccagccccacggccacgggcaccctgggccgcatgcactattactgatgggccccggctcccgctgcaaggcgctcggggtaccggacctgcacatgagctcagagctaccccacaccttcggactgcctcggcccccacagctcccaggtgctactgggcgtggaccgccaccccctgagaggctcccttccccagtcctgccagaagaccccgggggcggggagggggcagcatgcagggtccccactccctctctggggtcgatgaagaggtgaagtgaccaaatgaaagaaagctgcattctcagtg

SEQ ID NO: 3473 - DNA, 2927 bp, Homo sapiens
gcgggtgagtcccacttcccgacagcctggctcggccagcgactgggcggggagaccaaggatggaagtgggcttaccggccattaccctctttctcaccagcgccagcagccctgtggtggcgacgacgatggaccaggagccagtgggcggtgtggaacgaggagaagccgtcgcagcctcgggagctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagttttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggtaagttgctgattaagtctaattggaattgataattccatagtcttagattaaaatgaggatattttctcctagattttctcatgttatgccatgcatttatatatctaaccattaatttcacactaaggatgcttcaccatataataaaaggagcaagatggaagcactttgaattttctttcattgagaataactgttttatgtaagaatctgtatttataacaccagatattaagataggcttccattttttaatgcaagccacttacttaatcttgtattctttttcaggactcaaataactagctttgaacataatattaaaacactacttatagaatagatttattaatgttaatacctagtgaatatccatgtggcatcctggttatgttatcggttcagcgttaatcctatagaaaagtggtttggaggggattgggggatagtgggacaggtatagatttaatccatcaggagcaattagatattgtataaggtgcaatgatagcctaatgaaattacccgtcattcatcatttagaagtagcaacagtgaagactggacagtttacttgaatctggttggccactcctctacctacttggttatttgtaaaccttacaaatgtatatattgtgaagctaattttgaaaatattcctaaatatggccaggtacggtgctcacacctgtaatcccagcactttgggaggctgaagtgggcagattacttgaggtcaggagtttgagaccagcctggccaacgtagtgaaaccccgtctctacaaaaatacaaaaattagccaggcgtggtggtgcacgtctgtaatcccagctgctcgggaggctgaggcaggagaatcacttgaaccagggaggtggaggttgcagtgagccaagattgcaccactgcactccagcctgggcgacagagtgagactccatcttggggggaaaaaagtatatatatatacacacacacagacacacacacacacacatatatctctaaatgtgtgtatagaaccttttatcagtataacattgatttataattaaatgtgggtgaggaagaatgtgtggagtgtttcagaaattttgatcttaaaagccttttcagaaactcaaagctttcagaaattaatagttatattaatagccttctaaacagcattaagttttcaattttaatatatctatataaaatatagtgtcaaagaaagtaacatcaatatagtgggtctgtaatggaaatctgtcaatgaacatgaactgagttcttcaactacaggttgaaggataattaaacttttcattaggagtgttcagctacatggattcatggaatggtggttcatagtaagtgatggtaatctttttattcatgggtgtaaaccctttataacttagtgcttaaaatattaatcttttgattatataatgtcccatgaattatagtttaccaatagttctaaaacatgctaacctgaccttttccttctaatttgtttttaacttcattcgagatagtacctctcactcacagatatttatttggttatcaagtgaagataggtgtgtctaaaagtgatcttctgaatcctgtctccctagaggtactagtatctagagtttacccagaaaattttatgattgtaacaaaaggaagtagtgacttatgaaggttttgtttcttgaattttacttttgctacttgtccaatagtggctagtttatgtttatcaatatagttattcactgtgccttaagtttatactttgtttatgcaaactataaaatttcccataaatgtattcaa

SEQ ID NO: 3474 - DNA, 858 bp, Homo sapiens
aggcgcggcgcgaggcgggcgctgggcggcgccagcagccctgtggtggcgacgacgatggaccaggagccagtgggcggtgtggaacgaggagaagccgtcgcagcctcgggagctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagttttttttttttaatacaaaaactttcacattctttattcagtgggacttaatacaattatttatattttaaattattaaagtatctggaaagggaaaatgttttcttcatttttaggatctatct

SEQ ID NO: 3475 - DNA, 3254 bp, Homo sapiens
aagaaaattgtaatttgatatttaattgccactttggaaaataaaatcatgcatttataaatatcccacaaagttttagtaataaagattgttgattgccctgcttgccagtaagaaggaagagattttgaatacatataatgcagaactgtgttgtttatgaatgccaattcatgaagtcttaacaattggttctttatttttgttttcaatttatggccgagtttggttttgctgttttggactgtctcaactccctgctgatgccaccatacagagtcagatcagcaaccacatcccatcactagcctttgaagtacaacgacacagctgtcttcattttacaagtgcaaaaaccgaggtcctgcggggtgactgccccagacgccgctggtgacgggctgcgccgaggtcgagacgccaggcttcagcgccagcagccctgtggtggcgacgacgatggaccaggagccagtgggcggtgtggaacgaggagaagccgtcgcagcctcgggagctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaagttgatggcctggagaagaaagatgttttgcctactgttgatccgacaaaacttacctggggtccctacttatggttttacatgcttcgggctgctacatcaactctctcagtgtgtgacttccttggagagaagattgcatctgttttgggtatcagcaccccaaagtaccaatatgccattgatgaatattatcggatgaagaaggaggaagaagaagaagaagaagaaaacaggatgtctgaagaagcagaaaaacaatatcaacagaataaattgcagactgattccattgttcagacagatcaaccagagacagtgatatccagctcatttgtgaatgtcaattttgaaatggagggagacagtgaagtaattatggaaagcaagcaaaatccagtctctgtcccaccataaaatgaaatgactatcaagcttcaaactcttaagttttttttttttaatacaaaaactttcacattctttattcagtgggacttaatacaattatttatattttaaattattaaagtatctggaaagggaaaatgttttcttcatttttaggatctatctagcaaaagccagatctgaaattcagatatttgtactgtttttactgtgtatagaaattagtgctttggttttaaaatgatcttttaaaaaagttaaggacatcctagagccttaatagttaagaagagttaaattatcaagcctatttgtgcatttgctttttttgaaaaaggtaagttgctgattaagtctaattggaattgataattccatagtcttagattaaaatgaggatattttctcctagattttctcatgttatgccatgcatttatatatctaaccattaatttcacactaaggatgcttcaccatataataaaaggagcaagatggaagcactttgaattttctttcattgagaataactgttttatgtaagaatctgtatttataacaccagatattaagataggcttccattttttaatgcaagccacttacttaatcttgtattctttttcaggactcaaataactagctttgaacataatattaaaacactacttatagaatagatttattaatgttaatacctagtgaatatccatgtggcatcctggttatgttatcggttcagcgttaatcctatagaaaagtggtttggaggggattgggggatagtgggacaggtatagatttaatccatcaggagcaattagatattgtataaggtgcaatgatagcctaatgaaattacccgtcattcatcatttagaagtagcaacagtgaagactggacagtttacttgaatctggttggccactcctctacctacttggttatttgtaaaccttacaaatgtatatattgtgaagctaattttgaaaatattcctaaatatggccaggtacggtgctcacacctgtaatcccagcactttgggaggctgaagtgggcagattacttgaggtcaggagtttgagaccagcctggccaacgtagtgaaaccccgtctctacaaaaatacaaaaattagccaggcgtggtggtgcacgtctgtaatcccagctgctcgggaggctgaggcaggagaatcacttgaaccagggaggtggaggttgcagtgagccaagattgcaccactgcactccagcctgggcgacagagtgagactccatcttggggggaaaaaagtatatatatatacacacacacagacacacacacacacacatatatctctaaatgtgtgtatagaaccttttatcagtataacattgatttataattaaatgtgggtgaggaagaatgtgtggagtgtttcagaaattttgatcttaaaagccttttcagaaactcaaagctttcagaaattaatagttatattaatagccttctaaacagcattaagttttcaattttaatatatctatataaaatatagtgtcaaagaaagtaacatcaatatagtgggtctgtaatggaaatctgtcaatgaacatgaactgagttcttcaactacaggttgaaggataattaaacttttcattaggagtgttcagctacatggattcatggaatggtggttcatagtaagtgatggtaatctttttattcatgggtgtaaaccctttataacttagtgcttaaaatattaatcttttgattatataatgtcccatgaattatagtttaccaatagttctaaaacatgctaacctgaccttttccttctaatttgtttttaacttcattcgagatagtacctctcactcacagatatttatttggttatcaagtgaagataggtgtgtctaaaagtgatcttctgaatcctgtctccctagaggtactagtatctagagtttacccagaaaattttatgattgtaacaaaaggaagtagtgacttatgaaggttttgtttcttgaattttacttttgctacttgtccaatagtggctagtttatgtttatcaatatagttattcactgtgccttaagtttatactttgtttatgcaaactataaaatttcccataaatgtattc

SEQ ID NO: 3476 - DNA, 476 bp, Homo sapiens
aatttatggccgagtttggttttgctgttttggactgtctcaactccctgctgatgccaccatacagagtcagatcagcaaccacatcccatcactagcctttgaagtacaacgacacagctgtcttcattttacaagtgcaaaaaccgaggtcctgcggggtgactgccccagacgccgctggtgacgggctgcgccgaggtcgagacgccaggcttcagcgccagcagccctgtggtggcgacgacgatggaccaggagccagtgggcggtgtggaacgaggagaagccgtcgcagcctcgggagctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgaagt

SEQ ID NO: 3477 - DNA, 764 bp, Homo sapiens
ggagtgttcagtgttgatttgatgtgaggtgtgattaaagaagaaccaagaatgactttagtgttgttggcctgagcaactggaagaacagagttgccatttattgagatgagaaggctgccagaagagtagagttgttttgtttcattatggagattgacggtttccagcagttagacctagagaagagtgtaccttccaaaaagactactcctaaaaggattatccattttgttgacggagacatcatggaagaatatagcacagaggaggaggaggaagaggaaaaggaggagcagagcacaaattcaacacttgacccttctaaactttcctgggggccctacctacgattttgggcaggacgaatagcaagcacctcattttctacatgtgaattccttggtggaagatttgctgtcttctttggtcttactcaacccaaatatcagtatgtgttaaacgagttctataggatacaaaacaagaaaagtgacaacaaaagtgaaaggagaggatcaaaggcccaggcagctgaggttcctaatgaaaagtgtcacttggaggctggggtccaagagtatggaaccatacaacaggatgtgacagaggccattcctcagtgaagcacctcatccagggagggtctggtggcagatcctagctcatgatggcagcaaagactgcagtttccctggatctgttccttggccattgattaccatggcaacaacaccagaggtagcacttctgagccagatctg

SEQ ID NO: 3478 - DNA, 466 bp, Homo sapiens
aggggcagaagatacagcagtgaacataacagatttgatgtgaggtgtgattaaagaagaaccaagaatgactttagtgttgttggcctgagcaactggaagaacagagttgccatttattgagatgagaaggctgccagaagagtagagttgttttgtttcattatggagattgacggtttccagcagttagacctagagaagagtgtaccttccaaaaagactactcctaaaaggattatccattttgttgacggagacatcatggaagaatatagcacagaggaggaggaggaagaggaaaaggaggagcagagcacaaattcaacacttgacccttctaaactttcctgggggccctacctacgattttgggcaggacgaatagcaagcacctcattttctacatgtgaattccttggtggaagatttgctgtcttctttggtcttactcaacccaaatatc

SEQ ID NO: 3479 - DNA, 1345 bp, Homo sapiens
agatacagcagtgaacataacaggtaaaaccctccccctctgccaaggggcaggacagggaggaaagggaagacagagacaggtggaatatggagtgttcagtgttgaaatatccaagacaatttcctggcagatttgatgtgaggtgtgattaaagaagaaccaagaatgactttagtgttgttggcctgagcaactggaagaacagagttgccatttattgagatgagaaggctgccagaagagtagagttgttttgtttcattatggagattgacggtttccagcagttagacctagagaagagtgtaccttccaaaaagactactcctaaaaggattatccattttgttgacggagacatcatggaagaatatagcacagaggaggaggaggaagaggaaaaggaggagcagagcacaaattcaacacttgacccttctaaactttcctgggggccctacctacgattttgggcaggacgaatagcaagcacctcattttctacatgtgaattccttggtggaagatttgctgtcttctttggtcttactcaacccaaatatcagtatgtgttaaacgagttctataggatacaaaacaagaaaagtgacaacaaaagtgaaaggagaggatcaaaggcccaggcagctgaggttcctaatgaaaagtgtcacttggaggctggggtccaagagtatggaaccatacaacaggatgtgacagaggccattcctcagtgaagcacctcatccagggagggtctggtggcagatcctagctcatgatggcagcaaagactgcagtttccctggatctgttccttggccattgattaccatggcaacaacaccagaggtagcacttctgagccagatctgatcctaatctctgtgtgacttagtctcaagcatccaggaattacaagcaataatgagagtaattttggacactttctcagaataatttctatattcaagccaccccacctcaactccacccctgtgatacaagtcccatgagtactgacatttgcacagtagcataaatgccttaaggaactttgggactgggagtttttggctgaaatcctctgtcatgggacgagggtacagtaaagaagctctattcctcagaagaaaatttgggcaccgcaaagtctaaataaatcccctttcaggatttgatatagtgtgtacttccaacaaccatcctggcgtagttggggattgttttacaataagtaaacattgctaataactgtgttacaagatcattatcaagatctttaagaattaggtacatccctccaaattaaaacaattgataaataatataagctcta

SEQ ID NO: 3480 - DNA, 545 bp, Homo sapiens
agcatatccaagtgcactgtatggcctcagcctacagaacccttaactcttaaatttatcatctattgaacaatttctaacatcaaaatttgtactactttcaacaccaaacatcactaattaatgaaagaaaaatacagaggaattattcataacctaatgatcccagcaagataatgtcctgtcttctaagatgtgcatcaagcctggtacatactgaaaatcctataagttgttttgtttcattatggagattgacggtttccagcagttagacctagagaagagtgtaccttccaaaaagactactcctaaaaggattatccattttgttgacggagacatcatggaagaatatagcacagaggaggaggaggaagaggaaaaggaggagcagagcacaaattcaacacttgacccttctaaactttcctgggggccctacctacgattttgggcaggacgaatagcaagcacctcattttctacatgtgaattccttggtggaagatttgctgtcttctttggtcttactcaacccaaat

SEQ ID NO: 3481 - DNA, 2684 bp, Homo sapiens
ctccccagctggcggcggcggcggctgtgagctggccgcttggtttggagtcggaactcaatccccagaactggatctttaggttccacgttggcggccctggatctagggacgcaactcttggggtcctcccactgcgccgcctggggagcctgctcctgcttcctttcccggctagctggccccgtcctctgaggccgtgcgaattcccgccaccctccctcaccccggagccctgcccttcccgccctatgtggccaaggcttccaggtgcgggcctcgctccacaactcaggaggcaggatcagcggctccattttacaggacagatgtcccacggcttgcagatggctgggccccaggagacggtgctagcccttcctctgagagaaggggtgcaggctgccgccaccgtgcccatcctcctgtacaacctggaggatggcttgtcagaccatcccctggaccaggggccccgctgccctgcccggcggccctgcagccctgcctcggctccagctcccacatcgccaaagaagcccaagatacaggcacctggggaaacgtttcccactgactggagccccccgcccgtggaattcctcaacccgagggtgctgcaggccagtcgggaggccccggcccagaggtgggtgggtgtggtgggcccccagggcctgaggagactggctggtgagctgcccgaggagttggagcaggaacacctggacttggacccgaagaggggcctggccttgccagagaagctgttctggaacacgtcaggcctgagccagcaggctgcggccccagagttttcctgggggggctcaggaagctacttcaacaacctggactacttactgcaggagaagagggaacaggccctggagcaggagcgagagaggctgcttctgcaggagtgtctcaatctcaactccttggatcttgatgaagaggaagtgccactcacacccgagcacaggatgctggtggaaaagtactcagtgtccctgcagaccatcccgccggtccatccaggtgagactgtgtttctgcccaggtgtcaccccctgccatgcatcctggactcctcactcctgaagccacgcagccacctggaagggctgttcctcagctccccgccagcccaacagctctccttcctgcgcagtggcctcctgaacatcctctacctgcacatgcctgactgcccggtatccctgctccagtggctgttccagctgctgacatggcctccagaaacatctttgggagcctttggtcttctgtgggatctcattgtggatggaatcttccttcagcctgatgaagacaagcacctgtggtgcccctcactgcaagaagtcagggaggcattccacagcctgggtgcccacagtcctgccctgtaccctctggggcccttttggcacggtggcagggtgcttccaggcgaggctggcctgaatgagaatgaggagcaggacgctccccaagagattgccttggacatcagcctgggccacatctacaagtttctggcgctgtgtgcccaggcccagccgggggcctacactgatgagaacctcatgggactgattgagctgctgtgccgcaccagcctggacgtggggctccgcctgctgcccaaagttgacctccagcagcttctcctcttgctcctggagaacatccgggagtggccagggaagctccaggaactgtgctgcaccctgagctgggtgtctgaccaccaccacaacctgctggccctcgtgcagttcttcccagacatgacctcccggagcaggcggcttcgaagccagctcagccttgtggtcattgctcgaatgctgggccagcaggagatgctccctctctggcaagagaagacccagctgtcctcgctcagccggctcctgggcctcatgaggccatcatctctcaggcaatacctggactctgtgcccttgccaccctgccaggagcaacagccaaaggctagtgccgagctagaccacaaggcctgctacctgtgccacagcttgctgatgctggccggggtagttgttagctgccaggacatcactccagaccagtggggcgagctgcagctgctgtgcatgcagttggaccgccacatcagcacgcagatccgggagagcccccaggccatgcaccgcaccatgctcaaggacctggctacccagacctacatccgttggcaggagctgctgacccactgccagccccaggcccagtatttcagcccctggaaagacatctaaagggacagggtcagggcagcccagggctcctggcttcagcaggaagtgaacaggctcagggaactggaggaagcgaagcatcaaggccagaggaggccacatgctgaccagcctgatgaggcaagagcctgcccctgccaccgccccgacccctctcctctctgcaagagcctgcctctgccaccgccccgaccccctctcctctcagcaagggatgggcctctctgcctcgcccacccctcagccctcctcccagccatctcctcttccctaaggcctctgtctccatagctctggtttccctgggcctcagtcctccccaccctccttcctctgtctccctgtcactaatgtgaggtttctttgtgcacattaaagtcttctttcagcatc

SEQ ID NO: 3482 - DNA, 1001 bp, Homo sapiens
cacaggggtttagaattgactggtgtaggagcagaggacctggggctggatctgggcacagcaatttgcagggcactgctgggcaggagtccctgatggccaagctgctgggctctgtatctcccacaagctgcagcggaggccccatggagcaggagcagaagcacacgttggagaactgaacttgaaggacaggacttacagcattgaggtcacacagctgtcctcgctcagccggctcctgggcctcatgaggccatcatctctcaggcaatacctggactctgtgcccttgccaccctgccaggagcaacagccaaaggctagtgccgagctagaccacaaggcctgctacctgtgccacagcttgctgatgctggccggggtagttgttagctgccaggacatcactccagaccagtggggcgagctgcagctgctgtgcatgcagttggaccgccacatcagcacgcagatccgggagagcccccaggccatgcaccgcaccatgctcaaggacctggctacccagacctacatccgttggcaggagctgctgacccactgccagccccaggcccagtatttcagcccctggaaagacatctaaagggacagggtcagggcagcccagggctcctggcttcagcaggaagtgaacaggctcagggaactggaggaagcgaagcatcaaggccagaggaggccacatgctgaccagcctgatgaggcaagagcctgcccctgccaccgccccgacccctctcctctctgcaagagcctgcctctgccaccgccccgaccccctctcctctcagcaagggatgggcctctctgcctcgcccacccctcagccctcctcccagccatctcctcttccctaaggcctctgtctccatagctctggtttccctgggcctcagtcctccccaccctccttcctctgtctccctgtcactaatgtgaggtttctttgtgcacattaaagtcttctttcagca

SEQ ID NO: 3483 - DNA, 2877 bp, Homo sapiens
atggcccatgagagggagattttaaaaggaatgtatgaggagctgaaggaaaagtcccataaaccagatgtggagctaatccagcatcgtgcatggaggatcgacatggtttccacagagctggagtcattcaggaaagcttcttatatcgagagtggtccagaagaattctaccaaagatttaagaagtgtttttctgcaactcacatcttcataagtataaagggtaaagattctcagaatacagctcatggatatctgattcttaacaggactctacatcaacaactaaaaattaaaaatccttttctggccccgtcctctgaggccgtgcgaattcccgccaccctccctcaccccggagccctgcccttcccgccctatgtggccaaggcttccagcgatgaactgctgaacttgcagaaacccttgcagagtgccctgggcttcgtgatcttgagaagcagccaaaactggaacagcaaaaaccgtcaacgctggagtagaacaaaggccggacagatgtcccacggcttgcagatggctgggccccaggagacggtgctagcccttcctctgagagaaggggtgcaggctgccgccaccgtgcccatcctcctgtacaacctggaggatggcttgtcagaccatcccctggaccaggggccccgctgccctgcccggcggccctgcagccctgcctcggctccagctcccacatcgccaaagaagcccaagatacaggcacctggggaaacgtttcccactgactggagccccccgcccgtggaattcctcaacccgagggtgctgcaggccagtcgggaggccccggcccagaggtgggtgggtgtggtgggcccccagggcctgaggagactggctggtgagctgcccgaggagttggagcaggaacacctggacttggacccgaagaggggcctggccttgccagagaagctgttctggaacacgtcaggcctgagccagcaggctgcggccccagagttttcctgggggggctcaggaagctacttcaacaacctggactacttactgcaggagaagagggaacaggccctggagcaggagcgagagaggctgcttctgcaggagtgtctcaatctcaactccttggatcttgatgaagaggaagtgccactcacacccgagcacaggatgctggtggaaaagtactcagtgtccctgcagaccatcccgccggtccatccaggtgagactgtgtttctgcccaggtgtcaccccctgccatgcatcctggactcctcactcctgaagccacgcagccacctggaagggctgttcctcagctccccgccagcccaacagctctccttcctgcgcagtggcctcctgaacatcctctacctgcacatgcctgactgcccggtatccctgctccagtggctgttccagctgctgacatggcctccagaaacatctttgggagcctttggtcttctgtgggatctcattgtggatggaatcttccttcagcctgatgaagacaagcacctgtggtgcccctcactgcaagaagtcagggaggcattccacagcctgggtgcccacagtcctgccctgtaccctctggggcccttttggcacggtggcagggtgcttccaggcgaggctggcctgaatgagaatgaggagcaggacgctccccaagagattgccttggacatcagcctgggccacatctacaagtttctggcgctgtgtgcccaggcccagccgggggcctacactgatgagaacctcatgggactgattgagctgctgtgccgcaccagcctggacgtggggctccgcctgctgcccaaagttgacctccagcagcttctcctcttgctcctggagaacatccgggagtggccagggaagctccaggaactgtgctgcaccctgagctgggtgtctgaccaccaccacaacctgctggccctcgtgcagttcttcccagacatgacctcccggagcaggcggcttcgaagccagctcagccttgtggtcattgctcgaatgctgggccagcaggagatgctccctctctggcaagagaagacccagctgtcctcgctcagccggctcctgggcctcatgaggccatcatctctcaggcaatacctggactctgtgcccttgccaccctgccaggagcaacagccaaaggctagtgccgagctagaccacaaggcctgctacctgtgccacagcttgctgatgctggccggggtagttgttagctgccaggacatcactccagaccagtggggcgagctgcagctgctgtgcatgcagttggaccgccacatcagcacgcagatccgggagagcccccaggccatgcaccgcaccatgctcaaggacctggctacccagacctacatccgttggcaggagctgctgacccactgccagccccaggcccagtatttcagcccctggaaagacatctaaagggacagggtcagggcagcccagggctcctggcttcagcaggaagtgaacaggctcagggaactggaggaagcgaagcatcaaggccagaggaggccacatgctgaccagcctgatgaggcaagagcctgcccctgccaccgccccgacccctctcctctctgcaagagcctgcctctgccaccgccccgaccccctctcctctcagcaagggatgggcctctctgcctcgcccacccctcagccctcctcccagccatctcctcttccctaaggcctctgtctccatagctctggtttccctgggcctcagtcctccccaccctccttcctctgtctccctgtcactaatgtgaggtttctttgtgcacattaaagtcttctttcagcatc

SEQ ID NO: 3484 - DNA, 2710 bp, Homo sapiens
ggaagagggtgcgcacttggccggcgagctccccagctggcggcggcggcggctgtgagctggccgcttggtttggagtcggaactcaatccccagaactggatctttaggttccacgttggcggccctggatctagggacgcaactcttggggtcctcccactgcgccgcctggggagcctgctcctgcttcctttcccggctagctggccccgtcctctgaggccgtgcgaattcccgccaccctccctcaccccggagccctgcccttcccgccctatgtggccaaggcttccaggtgcgggcctcgctccacaactcaggaggcaggatcagcggctccattttacaggacagatgtcccacggcttgcagatggctgggccccaggagacggtgctagcccttcctctgagagaaggggtgcaggctgccgccaccgtgcccatcctcctgtacaacctggaggatggcttgtcagaccatcccctggaccaggggccccgctgccctgcccggcggccctgcagccctgcctcggctccagctcccacatcgccaaagaagcccaagatacaggcacctggggaaacgtttcccactgactggagccccccgcccgtggaattcctcaacccgagggtgctgcaggccagtcgggaggccccggcccagaggtgggtgggtgtggtgggcccccagggcctgaggagactggctggtgagctgcccgaggagttggagcaggaacacctggacttggacccgaagaggggcctggccttgccagagaagctgttctggaacacgtcaggcctgagccagcaggctgcggccccagagttttcctgggggggctcaggaagctacttcaacaacctggactacttactgcaggagaagagggaacaggccctggagcaggagcgagagaggctgcttctgcaggagtgtctcaatctcaactccttggatcttgatgaagaggaagtgccactcacacccgagcacaggatgctggtggaaaagtactcagtgtccctgcagaccatcccgccggtccatccaggtgagactgtgtttctgcccaggtgtcaccccctgccatgcatcctggactcctcactcctgaagccacgcagccacctggaagggctgttcctcagctccccgccagcccaacagctctccttcctgcgcagtggcctcctgaacatcctctacctgcacatgcctgactgcccggtatccctgctccagtggctgttccagctgctgacatggcctccagaaacatctttgggagcctttggtcttctgtgggatctcattgtggatggaatcttccttcagcctgatgaagacaagcacctgtggtgcccctcactgcaagaagtcagggaggcattccacagcctgggtgcccacagtcctgccctgtaccctctggggcccttttggcacggtggcagggtgcttccaggcgaggctggcctgaatgagaatgaggagcaggacgctccccaagagattgccttggacatcagcctgggccacatctacaagtttctggcgctgtgtgcccaggcccagccgggggcctacactgatgagaacctcatgggactgattgagctgctgtgccgcaccagcctggacgtggggctccgcctgctgcccaaagttgacctccagcagcttctcctcttgctcctggagaacatccgggagtggccagggaagctccaggaactgtgctgcaccctgagctgggtgtctgaccaccaccacaacctgctggccctcgtgcagttcttcccagacatgacctcccggagcaggcggcttcgaagccagctcagccttgtggtcattgctcgaatgctgggccagcaggagatgctccctctctggcaagagaagacccagctgtcctcgctcagccggctcctgggcctcatgaggccatcatctctcaggcaatacctggactctgtgcccttgccaccctgccaggagcaacagccaaaggctagtgccgagctagaccacaaggcctgctacctgtgccacagcttgctgatgctggccggggtagttgttagctgccaggacatcactccagaccagtggggcgagctgcagctgctgtgcatgcagttggaccgccacatcagcacgcagatccgggagagcccccaggccatgcaccgcaccatgctcaaggacctggctacccagacctacatccgttggcaggagctgctgacccactgccagccccaggcccagtatttcagcccctggaaagacatctaaagggacagggtcagggcagcccagggctcctggcttcagcaggaagtgaacaggctcagggaactggaggaagcgaagcatcaaggccagaggaggccacatgctgaccagcctgatgaggcaagagcctgcccctgccaccgccccgacccctctcctctctgcaagagcctgcctctgccaccgccccgaccccctctcctctcagcaagggatgggcctctctgcctcgcccacccctcagccctcctcccagccatctcctcttccctaaggcctctgtctccatagctctggtttccctgggcctcagtcctccccaccctccttcctctgtctccctgtcactaatgtgaggtttctttgtgcacattaaagtcttctttcagca

SEQ ID NO: 3485 - DNA, 3548 bp, Homo sapiens
gtttattcaaggagagctttgctgagagctggagcacgccagcagtggagctcgtggccacccagcccctgctcagacaggaggctgcggcccaggactgtgtggctggtgggggccagggtgggccaggcctggggctgccccgtccttgcctccctgggcccatgagcatcaacgtctctatagagaccaaggaccctggattcctccagtgacaggggtttggcctctggacagagaggtcccggatgttacaggtcagagccctccagacccccaaggactgtactcactgcccagaaatagctgctgcctctgggcaaccttgtaggcaccttctccacccaggacatgggcacccgtgacgatgtccccgaagccaaggtcctggtccccgtggccgtgtactgcgggagcatccctcggaccagtgctgggccccgggtgctcccgcctggaagcatcaactccagtctgcctcatggagaaggttctctccagcctgagccaagagccctgctgaacaacgaggaaccgtcacagctcctgcgtggactcggacagctgggtggcctcaagctggacaccccttccaagggctggcaggcaaggaatggtcaccccaggaacctcagggccttgtctttgggggaccagcccctggtgctcctcccttctccggagtcagaggccaacagcgtggccagggacaccatccagattaaggacaagctcaagaaaaggaggctctcagagggcttggcagcgtcttcccgagcctctctggatccagggggaggcccccaaggagttcccctgcacagcaccatcccccgagccacctctcagaggctgctgagggtgcccaggccgatgcctctcatccagagcatccctaccacccctgaggccagcggagtcaaagagaagggcctggacctaccggggagcattccgggtcctcacgagttgagacccggtgctcaggaggcgcagatctcctggcaatacctgcactgcaatgatgagaagatgcagaagtccctgggcgccatcgtgatcccacccatcccaaaggccaggacggttgcagcgaccccctcccgtgtgcctggctcccttcccagcccgttacctccaggccagggagtcctcacaggcctgagggccccacgcacgcgattggctcgggggagtgggcctcgggagaagacccctgcatctctggagccaaaacctttggcctcacccatcagagacaggcctgccgctgccaagaagcctgccctgcctttttctcagtctgctcccacgctgacagccttctcctttgactgtgccagagaagcctgccctccgctgaaagaagaggaccagaaggagatcggcaccaagatccaagtcaccatctccaagtctgcccgggagaagatgcagctgaagcagatgaaggagatggagctgcttcggaggctggaggagcccaggacagggcaggagctcacttcccagtgcctgggctcccagagagccttcatgaaggaaggcctccttcccctccggggcagcgggacactgtctgtgcccactaggctgagcggcccatgcagaaacgacgtcagcatcatcctgaggaagtgggccagccgggcctccctgcccagcatccccatcagccggcaggagccccgctttgcccgccacgcctcagctaactcattacctgcggtgctcacgttggggtctcctgaatgggaagaagaggaggagatggatcttagagcctgtaaggagttgaggcctttctcgaacccggagctggggctgagggatgcactccagtgcctcaacagcagtgactggcagatgaaggagaagggtctggtgagcatccagcgcttggcagcctgtcactcagaggtcctcaccgggaagctgcacgacgtgtgcttggtggtgactggggaggtcaccaacctgcggtccaaggtgtctcacctggccatcagcaccttgggagacctcttccaggccttgaagaagaatatggaccaggaggccgaggagatcgcccgctgcttgctgcagaagatggcggacaccaacgagttcatccagagagcagccggccagtctctgagggctatggtggagaatgtgacccttgcccgctccctggtggtcctcacctcggcgggtgtctaccaccggaaccccttgatccggaaatacgcggctgagcacctctcagctgtgctggagcagatcggcgctgagaagcttctctcgggcaccagagacagcacagacatgttggtgcacaacctggtgaggctggcacaggactccaaccaggacaccagattttatggccggaagatggtgaatatcttgatggcgaacactaagtttgatgcatttctgaagcaatctctcccatcttacgacttgcagaaggtcatggcggccattaaacagcagggaatagaagataatgatgaacttccctctgccaaaggccgcaaggtgttgaggagtctggtggtgtgtgagaacgggctgcccatcaaggaggggctcagctgcaatggcccaaggctggtggggctgcgctccacactgcagggccgcggggagatggtggagcagctacgggagctgacacggctgctggaggccaaggacttccggtcccggatggaaggcgtggggcagctcctggagctctgcaaggccaagacggagcttgtcactgcccacctggtccaggtctttgatgctttcaccccaaggcttcaggattccaacaagaaagtgaaccagtgggcgctggagtccttcgccaagatgatccccctcctcagagagagcttacaccccatgctgctctccatcatcatcactgttgcagacaacctcaactccaagaactcagggatttacgctgctgccgtggctgtgctggatgcgatggttgagagcctggacaacctttgccttctaccagcgcttgctgggcgagtgcgtttcctgagtggccgtgcggtgctggatgtcacagatcgcctggcagtgctggtggcctcagtttacccccggaagcctcaagctgtagagcggcatgtccttcccatcctctggcacttcctgaacaccgccaccaggaatggcaccctgcctggacccagcgggaacatccgcggggtggtgtgccggctgtccaggagcctccaggagcacatgggctcccgcctgctggactttgccgccagccagccaaagcacgtcctcaagacgctccaggaactcttagactcagagtccttgggaggcagccgcaaggccactgacagaggggtggcccctgacagcaagacaactggcagctcatacccttttcagctggattaaagatggatctgaaatgggcaattattatttatcttatttttttgatggactattctcctggttactttcccccttagagttccagatgtacatggtatattttgaagtagaaataaaagaattacttatttttctaa

SEQ ID NO: 3486 - DNA, 3381 bp, Homo sapiens
gtttattcaaggagagctttgctgagagctggagcacgccagcagtggagctcgtggccacccagcccctgctcagacaggaggctgcggcccaggactgtgtggctggtgggggccagggtgggccaggcctggggctgccccgtccttgcctccctgggcccatgagcatcaacgtctctatagagaccaaggaccctggattcctccagtgacaggggtttggcctctggacagagaggtcccggatgttacaggtcagagccctccagacccccaaggactgtactcactgcccagaaatagctgctgcctctgggcaaccttgtaggcaccttctccacccaggacatgggcacccgtgacgatgtccccgaagccaaggtcctggtccccgtggccgtgtactgcgggagcatccctcggaccagtgctgggccccgggtgctcccgcctggaagcatcaactccagtctgcctcatggagaaggttctctccagcctgagccaagagccctgctgaacaacgaggaaccgtcacagctcctgcgtggactcggacagctgggtggcctcaagctggacaccccttccaagggctggcaggcaaggaatggtcaccccaggaacctcagggccttgtctttgggggaccagcccctggtgctcctcccttctccggagtcagaggccaacagcgtggccagggacaccatccagattaaggacaagctcaagaaaaggaggctctcagagggcttggcagcgtcttcccgagcctctctggatccagggggaggcccccaaggagttcccctgcacagcaccatcccccgagccacctctcagaggctgctgagggtgcccaggccgatgcctctcatccagagcatccctaccacccctgaggccagcggagtcaaagagaagggcctggacctaccggggagcattccgggtcctcacgagttgagacccggtgctcaggaggcgcagatctcctggcaatacctgcactgcaatgatgagaagatgcagaagtccctgggcgccatcgtgatcccacccatcccaaaggccaggacggttgcagcgaccccctcccgtgtgcctggctcccttcccagcccgttacctccaggccagggagtcctcacaggcctgagggccccacgcacgcgattggctcgggggagtgggcctcgggagaagacccctgcatctctggagccaaaacctttggcctcacccatcagagacaggcctgccgctgccaagaagcctgccctgcctttttctcagtctgctcccacgctgacagccttctcctttgactgtgccagagaagcctgccctccgctgaaagaagaggaccagaaggagatcggcaccaagatccaagtcaccatctccaagtctgcccgggagaagatgcagctgaagcagatgaaggagatggagctgcttcggaggctggaggagcccaggacagggcaggagctcacttcccagtgcctgggctcccagagagccttcatgaaggaagctaactcattacctgcggtgctcacgttggggtctcctgaatgggaagaagaggaggagatggatcttagagcctgtaaggagttgaggcctttctcgaacccggagctggggctgagggatgcactccagtgcctcaacagcagtgactggcagatgaaggagaagggtctggtgagcatccagcgcttggcagcctgtcactcagaggtcctcaccgggaagctgcacgacgtgtgcttggtggtgactggggaggtcaccaacctgcggtccaaggtgtctcacctggccatcagcaccttgggagacctcttccaggccttgaagaagaatatggaccaggaggccgaggagatcgcccgctgcttgctgcagaagatggcggacaccaacgagttcatccagagagcagccggccagtctctgagggctatggtggagaatgtgacccttgcccgctccctggtggtcctcacctcggcgggtgtctaccaccggaaccccttgatccggaaatacgcggctgagcacctctcagctgtgctggagcagatcggcgctgagaagcttctctcgggcaccagagacagcacagacatgttggtgcacaacctggtgaggctggcacaggactccaaccaggacaccagattttatggccggaagatggtgaatatcttgatggcgaacactaagtttgatgcatttctgaagcaatctctcccatcttacgacttgcagaaggtcatggcggccattaaacagcagggaatagaagataatgatgaacttccctctgccaaaggccgcaaggtgttgaggagtctggtggtgtgtgagaacgggctgcccatcaaggaggggctcagctgcaatggcccaaggctggtggggctgcgctccacactgcagggccgcggggagatggtggagcagctacgggagctgacacggctgctggaggccaaggacttccggtcccggatggaaggcgtggggcagctcctggagctctgcaaggccaagacggagcttgtcactgcccacctggtccaggtctttgatgctttcaccccaaggcttcaggattccaacaagaaagtgaaccagtgggcgctggagtccttcgccaagatgatccccctcctcagagagagcttacaccccatgctgctctccatcatcatcactgttgcagacaacctcaactccaagaactcagggatttacgctgctgccgtggctgtgctggatgcgatggttgagagcctggacaacctttgccttctaccagcgcttgctgggcgagtgcgtttcctgagtggccgtgcggtgctggatgtcacagatcgcctggcagtgctggtggcctcagtttacccccggaagcctcaagctgtagagcggcatgtccttcccatcctctggcacttcctgaacaccgccaccaggaatggcaccctgcctggacccagcgggaacatccgcggggtggtgtgccggctgtccaggagcctccaggagcacatgggctcccgcctgctggactttgccgccagccagccaaagcacgtcctcaagacgctccaggaactcttagactcagagtccttgggaggcagccgcaaggccactgacagaggggtggcccctgacagcaagacaactggcagctcatacccttttcagctggattaaagatggatctgaaatgggcaattattatttatcttatttttttgatggactattctcctggttactttcccccttagagttccagatgtacatggtatattttgaagtagaaataaaagaattacttatttttct

SEQ ID NO: 3487 - DNA, 493 bp, Homo sapiens
tttcactccggctggccctggctcatctccttgaggaggaagtgtgtgtcctctcctgcacgcctctccttcctggggagccctggctcacagctggagccagcaggcctggaggctgcagaccctggactgggacttgttgcttttgagagctcccctgaagcctggctcctcaggtcccggatgttacaggtcagagccctccagacccccaaggactgtactcactgcccagaaatagctgctgcctctgggcaaccttgtaggcaccttctccacccaggacatgggcacccgtgacgatgtccccgaagccaaggtcctggtccccgtggccgtgtactgcgggagcatccctcggaccagtgctgggccccgggtgctcccgcctggaagcatcaactccagtctgcctcatggagaaggttctctccagcctgagccaagagccctgctgaacaacgaggaaccgtcacagctcctgcgtggactc

SEQ ID NO: 3488 - DNA, 6247 bp, Homo sapiens
cgcccggtggcagctgtggggtctagggctcagacgggggccattttgccagaggctgcctcccggagttgggggcggcctggcggcaggctgaagctgttcttttgcctcttctgcagcttggggcttggagaggatctggaagtctgggctccatcgagccctttggagacggcaatggtttcttccaaccaccaccacctgacaaccctgcatggcggctgccccctccgcgctgcttctgctgccgccctttccagtcctctctacctatcggctccagagccgcagtcgtccttccgccccagagaccgatgatagtcgagttgggggcattatgagaggagagaaaaactactacttccgtggagctgcgggggaccacggttcctgccccactacaacttcgcctctggcctcggccctcttgatgccctcggaggcagtctcaagcagctggtctgagtctggaggcggtttgtcagggggagatgaagaggacactcggctccttcaactcctccgcactgcccgggatccttctgaggccttccaggctttgcaagctgctttgccgcggcggggcggtcgacttggcttcccccgacgcaaggaagctttgtatcgggcactgggccgagtgcttgtggaaggaggtagtgatgagaagcggctctgcttgcaacttctctcggacgttctccggggtcagggggaggcaggccagcttgaagaggcctttagcttagcacttttgcctcaactagttgtctcgttacgggaagagaatccagccctgcggaaagatgcgctgcagatccttcatatatgtctgaaacgtagtcctggagaggtgctgagaacgcttatacaacaaggactggaaagtaccgatgcccgacttagagcttccacagcactactgcttcccatcttgcttactactgaggacttgttgcttggtctggatctcaccgaggtgataatatccctagcccgaaagcttggtgatcaggagacagaagaagaatctgagacagctttctccgcacttcaacaaattggggagcgacttggccaagacaggtttcaatcttacatttctcgtctgccctctgccctgaggagacactacaatcgccgcctggagtcccagtttggaagtcaggttccttattatttggaacttgaagcctctggatttcctgaagatccccttccctgtgcagtgactctttccaacagcaatcttaaatttgggattattcctcaggagctgcattcacgattattggatcaggaagactataagaaccggacccaggccgtcgaagaactaaagcaggtgctgggaaaatttaaccctagttctactcctcattctagtcttgttggcttcattagtttgctatataatttgttagacgattctaacttcaaagtggtgcatggcacacttgaagtcctgcatttactggttattcgccttggagagcaggtacagcagttcttgggaccagttatagcagcttctgtcaaagtgctggcggacaacaagttggtgatcaaacaagaatacatgaaaatcttcctcaagctaatgaaggaagtaggacctcagcaggtgctttgtttactcctggaacatctcaaacataagcattccagagtgagagaggaggtggtgaacatttgcatctgctccctgctgacctatcctagtgaggattttgacttgcccaaactgtcctttgatcttgccccagctcttgtagatagcaaacgcagggtacgccaagcagctttagaagcttttgccgtattggcatcatcaatgggctcaggtaaaaccagcatcctttttaaagctgtggatacagttgaactgcaagataatggagatggagtgatgaatgctgtgcaggccagattggctaggaaaaccttaccaaggctcacagagcagggatttgtggaatatgcagtactgatgccatcttctgccgggggtaggtcaaaccatttggcacatggagcagatacggactggcttttggctggtaacagaactcagagtgcacactgtcactgtggtgaccacgtgagggatagcatgcacatttatggatcttacagcccaactatctgtacccgaagggtattaagtgcaggaaaaggaaaaaataaattaccatgggaaaatgagcaacctggaatcatgggagaaaaccagacctccacttccaaggatatagagcagttttcaacatatgatttcatcccatctgcaaaattaaagctttctcaaggaatgccagtcaatgatgatttatgttttagcagaaaaagagtatcaagaaacttatttcagaatagtcgggattttaacccagattgtcttcctttatgtgctgctggtactactgggactcatcaaacaaatctttctgggaaatgtgcacaacttggattttcacaaatatgtggtaaaactggcagtgtgggttctgacttacaattcctagggacaactagcagtcatcaagaaaaagtgtatgctagcctcaattttggcagtaagacacagcaaacatttggtagtcaaacagagtgtacttcctcaaatggtcaaaatccaagtccaggagcttacatccttccatcctatcctgtctcatcacctcgaactagtccaaagcatacatctcctcttattatatctccaaagaagtctcaagataattctgttaatttctcaaattcctggcctcttaaaagcttcgaaggactatcaaagccaagtccacagaagaagcttgtcagccaaaaatcgtctgatcctacgggtagaaatcatggagaaaattctcaagaaaaacctccagttcagcttacacctgccttggtgagatcgccatcttcccgacgaggtctaaatgggacaaagcctgttcctcccataccaaggggaataagccttttgcctgataaagctgatttaagcacagtgggacacaaaaagaaagagcctgatgatatttggaagtgtgaaaaagatagtcttccaattgatctttcagaattaaatttcaaggataaagatttggatcaagaagagatgcatagctctcttaggtcccttcgtaatagtgcagctaagaaaagagcaaaactgagtggcagtacttcagatcttgaaagccctgattctgcaatgaagctcgacttgacgatggactccccgtctctgtcttcctcaccaaacatcaattcttacagtgaaagtggagtttacagccaagaatcattgacttcttctctgtctacaactccccaggggaagagaataatgtcagacatatttccaacatttgggtcaaaaccttgtccaacaagactttcttctgcaaagaaaaaaatttctcatattgctgaacaaagccccagtgcagggtcatcatcaaatccacagcaaatttccagttttgacttcacaaccacaaaggctttatcagaagactcagtagtagttgttggaaaaggcgtatttggaagtttaagttcagcaccagcaacctgcagccaatcagtgatatcttctgtggaaaatggggatacattttcaattaaacaaagtattgaaccaccatcagggatttatggaagatcagtccagcaaaatatttcatcatatcttgatgttgagaatgaaaaagatgctaaagtttctatttctaaatctacttataacaagatgagacaaaagagaaaagaagagaaagaactgtttcacaataaagattgtgaaaagaaggaaaaaaattcctgggaacgaatgagacatacaggaactgagaaaatggcatctgaaagtgaaacacctactggagctatttcacagtataaagaaaggatgccttctgtcactcatagtccagaaataatggatctgtcagaactacgaccattctctaaaccagaaatagcactgacagaagccctgaggcttttggctgatgaggattgggagaagaaaattgagggactgaattttattagatgcttagctgcttttcattctgagatactgaacacaaagttgcatgaaacaaattttgcagttgttcaagaggtgaaaaatttacgttctggagtttctcgtgctgctgtggtctgtttaagtgatcttttcacttatttgaaaaagagcatggatcaagagctagataccacagtaaaagttttgttgcacaaggctggtgaatcaaatacatttataagagaagatgttgacaaagcattgagagctatggttaataatgtaactcctgcacgtgcagttgtttctcttatcaatggtggacaaaggtattatggtcgaaagatgctgttcttcatgatgtgtcatcctaactttgaaaaaatgcttgaaaagtatgtcccatctaaagatttgccatatattaaggactctgttagaaacttacagcaaaagggtttgggggagataccattagatactccttcagcaaaaggaagacgatctcatactggcagtgttggaaatacaagatcatcatctgtttctagagatgctttcaattcagctgaaagagctgtaactgaagttcgtgaagtcaccagaaaatcagtccctcgtaattccttagaaagtgctgagtaccttaaactcataactggcttattaaatgcaaaagactttcgtgatcgtattaatgggattaagcagcttttatcagatacagaaaataatcaagaccttgttgttggaaacattgtgaagatttttgatgcttttaaatctcgacttcatgattctaatagtaaagtaaatctggtggctctggaaacaatgcacaaaatgattcctctacttagagaccacttatctcctataatcaacatgctaattccagcaatagtggataacaatctgaattccaagaatccaggcatctatgcggctgctacaaatgttgttcaggcactgagtcagcatgtagacaattacttacttctacagccattttgcacaaaagctcagtttttaaatggaaaagcaaaacaggacatgacggaaaagcttgctgatattgttacggaactttatcaaaggaagccgcatgccacagagcagaaagtgttggttgttttatggcatctcttaggaaatatgacaaatagtggctctctgcctggagctggaggaaatatacgaacagccacagctaaattatcaaaagcactctttgcacagatgggtcagaatctgttaaatcaggctgcatctcaaccaccacatatcaaaaagagtttggaggaattactcgatatgacaattttaaatgaattatgaatcttcgataaaatactgtatgatgaacaaaagtgtttacatgatgacaaatggaactttctaaaagttatgttatcagtgcctgcacttcacatccagcaaattaagtcaatggctatttttatttgcagcctatgagtacacatctgtcctatatcaaccttaccacttatattcatcacataaaaacctaaaatattcatgaataattcatgaaatctgagtcacatgggatgaattcaattttaatatttttgagaaaagtcctgctcatttgcactattctatagaaactacaatttgttgccctatatgtaaaattagaattgtaattaaaaatacacattttattatgtaatcatgttctggtatgtctcatttctcagccttattttataacgtggaagtcattgaactatgttatcagaaactaagtttgtatattatttgtgaaaaacatgtatttctgaatcagtccgctaatatgattgtgcagtattagcttgcttttgctgctgtgttaatgtcatatatttgcttaccttttgggttcaattatctacataattgtgaaatttaacaagttataataaagcatgacaaccaaagttttagaaaacattaaacattttaaatgcacgtttaaaaaacgtgttgaatgtaacccccctatttttgtgtgcaaacactaaattttattgctttatgttttgacctttataaaggtgttattctgctgcccagttttgtaattctcaaaaatagtgccaggtcttctatagcttttttcagaattcatgggcttacaagtactgtatgcatctttaaaaagaaaaggaatgttataaaataaaaggatttatttcttta

SEQ ID NO: 3489 - DNA, 6140 bp, Homo sapiens
agacgggggccattttgccagaggctgcctcccggagttgggggcggcctggcggcaggctgaagctgttcttttgcctcttctgcagcttggggcttggagaggatctggaagtctgggctccatcgagccctttggagacggcaatggtttcttccaaccaccaccacctgacaaccctgcatggcggctgccccctccgcgctgcttctgctgccgccctttccagtcctctctacctatcggctccagagccgcagtcgtccttccgccccagagaccgatgatagtcgagttgggggcattatgagaggagagaaaaactactacttccgtggagctgcgggggaccacggttcctgccccactacaacttcgcctctggcctcggccctcttgatgccctcggaggcagtctcaagcagctggtctgagtctggaggcggtttgtcagggggagatgaagaggacactcggctccttcaactcctccgcactgcccgggatccttctgaggccttccaggctttgcaagctgctttgccgcggcggggcggtcgacttggcttcccccgacgcaaggaagctttgtatcgggcactgggccgagtgcttgtggaaggaggtagtgatgagaagcggctctgcttgcaacttctctcggacgttctccggggtcagggggaggcaggccagcttgaagaggcctttagcttagcacttttgcctcaactagttgtctcgttacgggaagagaatccagccctgcggaaagatgcgctgcagatccttcatatatgtctgaaacgtagtcctggagaggtgctgagaacgcttatacaacaaggactggaaagtaccgatgcccgacttagagcttccacagcactactgcttcccatcttgcttactactgaggacttgttgcttggtctggatctcaccgaggtgataatatccctagcccgaaagcttggtgatcaggagacagaagaagaatctgagacagctttctccgcacttcaacaaattggggagcgacttggccaagacaggtttcaatcttacatttctcgtctgccctctgccctgaggagacactacaatcgccgcctggagtcccagtttggaagtcaggttccttattatttggaacttgaagcctctggatttcctgaagatccccttccctgtgcagtgactctttccaacagcaatcttaaatttgggattattcctcaggagctgcattcacgattattggatcaggaagactataagaaccggacccaggccgtcgaagaactaaagcaggtgctgggaaaatttaaccctagttctactcctcattctagtcttgttggcttcattagtttgctatataatttgttagacgattctaacttcaaagtggtgcatggcacacttgaagtcctgcatttactggttattcgccttggagagcaggtacagcagttcttgggaccagttatagcagcttctgtcaaagtgctggcggacaacaagttggtgatcaaacaagaatacatgaaaatcttcctcaagctaatgaaggaagtaggacctcagcaggtgctttgtttactcctggaacatctcaaacataagcattccagagtgagagaggaggtggtgaacatttgcatctgctccctgctgacctatcctagtgaggattttgacttgcccaaactgtcctttgatcttgccccagctcttgtagatagcaaacgcagggtacgccaagcagctttagaagcttttgccgtattggcatcatcaatgggctcaggtaaaaccagcatcctttttaaagctgtggatacagttgaactgcaagataatggagatggagtgatgaatgctgtgcaggccagattggctaggaaaaccttaccaaggctcacagagcagggatttgtggaatatgcagtactgatgccatcttctgccgggggtaggtcaaaccatttggcacatggagcagatacggactggcttttggctggtaacagaactcagagtgcacactgtcactgtggtgaccacgtgagggatagcatgcacatttatggatcttacagcccaactatctgtacccgaagggtattaagtgcaggaaaaggaaaaaataaattaccatgggaaaatgagcaacctggaatcatgggagaaaaccagacctccacttccaaggatatagagcagttttcaacatatgatttcatcccatctgcaaaattaaagctttctcaaggaatgccagtcaatgatgatttatgttttagcagaaaaagagtatcaagaaacttatttcagaatagtcgggattttaacccagattgtcttcctttatgtgctgctggtactactgggactcatcaaacaaatctttctgggaaatgtgcacaacttggattttcacaaatatgtggtaaaactggcagtgtgggttctgacttacaattcctagggacaactagcagtcatcaagaaaaagtgtatgctagcctcaattttggcagtaagacacagcaaacatttggtagtcaaacagagtgtacttcctcaaatggtcaaaatccaagtccaggagcttacatccttccatcctatcctgtctcatcacctcgaactagtccaaagcatacatctcctcttattatatctccaaagaagtctcaagataattctgttaatttctcaaattcctggcctcttaaaagcttcgaaggactatcaaagccaagtccacagaagaagcttgtcagccaaaaatcgtctgatcctacgggtagaaatcatggagaaaattctcaagaaaaacctccagttcagcttacacctgccttggtgagatcgccatcttcccgacgaggtctaaatgggacaaagcctgttcctcccataccaaggggaataagccttttgcctgataaagctgatttaagcacagtgggacacaaaaagaaagagcctgatgatatttggaagtgtgaaaaagatagtcttccaattgatctttcagaattaaatttcaaggataaagatttggatcaagaagaggtcagacatatttccaacatttgggtcaaaaccttgtccaacaagactttcttctgcaaagaaaaaaatttctcatattgctgaacaaagccccagtgcagggtcatcatcaaatccacagcaaatttccagttttgacttcacaaccacaaaggctttatcagaagactcagtagtagttgttggaaaaggcgtatttggaagtttaagttcagcaccagcaacctgcagccaatcagtgatatcttctgtggaaaatggggatacattttcaattaaacaaagtattgaaccaccatcagggatttatggaagatcagtccagcaaaatatttcatcatatcttgatgttgagaatgaaaaagatgctaaagtttctatttctaaatctacttataacaagatgagacaaaagagaaaagaagagaaagaactgtttcacaataaagattgtgaaaagaaggaaaaaaattcctgggaacgaatgagacatacaggaactgagaaaatggcatctgaaagtgaaacacctactggagctatttcacagtataaagaaaggatgccttctgtcactcatagtccagaaataatggatctgtcagaactacgaccattctctaaaccagaaatagcactgacagaagccctgaggcttttggctgatgaggattgggagaagaaaattgagggactgaattttattagatgcttagctgcttttcattctgagatactgaacacaaagttgcatgaaacaaattttgcagttgttcaagaggtgaaaaatttacgttctggagtttctcgtgctgctgtggtctgtttaagtgatcttttcacttatttgaaaaagagcatggatcaagagctagataccacagtaaaagttttgttgcacaaggctggtgaatcaaatacatttataagagaagatgttgacaaagcattgagagctatggttaataatgtaactcctgcacgtgcagttgtttctcttatcaatggtggacaaagccatttacacattgctgtaagaaggtgtacagcccagcatttatcagatgtattggaatttatggaaccagaacgtattttatctgcagcaaaggatatggctgaacgcatattaccagctgctgctaagtttgctcaagacagttcacaagaaaccaggtattatggtcgaaagatgctgttcttcatgatgtgtcatcctaactttgaaaaaatgcttgaaaagtatgtcccatctaaagatttgccatatattaaggactctgttagaaacttacagcaaaagggtttgggggagataccattagatactccttcagcaaaaggaagacgatctcatactggcagtgttggaaatacaagatcatcatctgtttctagagatgctttcaattcagctgaaagagctgtaactgaagttcgtgaagtcaccagaaaatcagtccctcgtaattccttagaaagtgctgagtaccttaaactcataactggcttattaaatgcaaaagactttcgtgatcgtattaatgggattaagcagcttttatcagatacagaaaataatcaagaccttgttgttggaaacattgtgaagatttttgatgcttttaaatctcgacttcatgattctaatagtaaagtaaatctggtggctctggaaacaatgcacaaaatgattcctctacttagagaccacttatctcctataatcaacatgctaattccagcaatagtggataacaatctgaattccaagaatccaggcatctatgcggctgctacaaatgttgttcaggcactgagtcagcatgtagacaattacttacttctacagccattttgcacaaaagctcagtttttaaatggaaaagcaaaacaggacatgacggaaaagcttgctgatattgttacggaactttatcaaaggaagccgcatgccacagagcagaaagtgttggttgttttatggcatctcttaggaaatatgacaaatagtggctctctgcctggagctggaggaaatatacgaacagccacagctaaattatcaaaagcactctttgcacagatgggtcagaatctgttaaatcaggctgcatctcaaccaccacatatcaaaaagagtttggaggaattactcgatatgacaattttaaatgaattatgaatcttcgataaaatactgtatgatgaacaaaagtgtttacatgatgacaaatggaactttctaaaagttatgttatcagtgcctgcacttcacatccagcaaattaagtcaatggctatttttatttgcagcctatgagtacacatctgtcctatatcaaccttaccacttatattcatcacataaaaacctaaaatattcatgaataattcatgaaatctgagtcacatgggatgaattcaattttaatatttttgagaaaagtcctgctcatttgcactattctatagaaactacaatttgttgccctatatgtaaaattagaattgtaattaaaaatacacattttattatgtaatcatgttctggtatgtctcatttctcagccttattttataacgtggaagtcattgaactatgttatcagaaactaagtttgtatattatttgtgaaaaacatgtatttctgaatcagtccgctaatatgattgtgcagtattagcttgcttttgctgctgtgttaatgtcatatatttgcttaccttttgggttcaattatctacataattgtgaaatttaacaagttataataaagcatgacaaccaaagttttagaaaacattaaacattttaaatgcacgtttaaaaaacgtgttgaatgtaacccccctatttttgtgtgcaaacactaaattttattgctttatgttttgacctttataaaggtgttattctgctgcccagttttgtaattctcaaaaatagtgccaggtcttctatagcttttttcagaattcatgggcttacaagtactgtatgcatctttaaaaagaaaaggaatgttataaaataaaaggatttatttctt

SEQ ID NO: 3490 - DNA, 3777 bp, Homo sapiens
acgtggtgcccttggttacgcccggtggcagctgtggggtctagggctcagacgggggccattttgccagaggctgcctcccggagttgggggcggcctggcggcaggctgaagctgttcttttgcctcttctgcagcttggggcttggagaggatctggaagtctgggctccatcgagccctttggagacggcaatggtttcttccaaccaccaccacctgacaaccctgcatggcggctgccccctccgcgctgcttctgctgccgccctttccagtcctctctacctatcggctccagagccgcagtcgtccttccgccccagagaccgatgatagtcgagttgggggcattatgagaggagagaaaaactactacttccgtggagctgcgggggaccacggttcctgccccactacaacttcgcctctggcctcggccctcttgatgccctcggaggcagtctcaagcagctggtctgagtctggaggcggtttgtcagggggagatgaagaggacactcggctccttcaactcctccgcactgcccgggatccttctgaggccttccaggctttgcaagctgctttgccgcggcggggcggtcgacttggcttcccccgacgcaaggaagctttgtatcgggcactgggccgagtgcttgtggaaggaggtagtgatgagaagcggctctgcttgcaacttctctcggacgttctccggggtcagggggaggcaggccagcttgaagaggcctttagcttagcacttttgcctcaactagttgtctcgttacgggaagagaatccagccctgcggaaagatgcgctgcagatccttcatatatgtctgaaacgtagtcctggagaggtgctgagaacgcttatacaacaaggactggaaagtaccgatgcccgacttagagcttccacagcactactgcttcccatcttgcttactactgaggacttgttgcttggtctggatctcaccgaggtgataatatccctagcccgaaagcttggtgatcaggagacagaagaagaatctgagacagctttctccgcacttcaacaaattggggagcgacttggccaagacaggtttcaatcttacatttctcgtctgccctctgccctgaggagacactacaatcgccgcctggagtcccagtttggaagtcaggttccttattatttggaacttgaagcctctggatttcctgaagatccccttccctgtgcagtgactctttccaacagcaatcttaaatttgggattattcctcaggagctgcattcacgattattggatcaggaagactataagaaccggacccaggccgtcgaagaactaaagcaggtgctgggaaaatttaaccctagttctactcctcattctagtcttgttggcttcattagtttgctatataatttgttagacgattctaacttcaaagtggtgcatggcacacttgaagtcctgcatttactggttattcgccttggagagcaggtacagcagttcttgggaccagttatagcagcttctgtcaaagtgctggcggacaacaagttggtgatcaaacaagaatacatgaaaatcttcctcaagctaatgaaggaagtaggacctcagcaggtgctttgtttactcctggaacatctcaaacataagcattccagagtgagagaggaggtggtgaacatttgcatctgctccctgctgacctatcctagtgaggattttgacttgcccaaactgtcctttgatcttgccccagctcttgtagatagcaaacgcagggtacgccaagcagctttagaagcttttgccgtattggcatcatcaatgggctcaggtaaaaccagcatcctttttaaagctgtggatacagttgaactgcaagataatggagatggagtgatgaatgctgtgcaggccagattggctaggaaaaccttaccaaggctcacagagcagggatttgtggaatatgcagtactgatgccatcttctgccgggggtaggtcaaaccatttggcacatggagcagatacggactggcttttggctggtaacagaactcagagtgcacactgtcactgtggtgaccacgtgagggatagcatgcacatttatggatcttacagcccaactatctgtacccgaagggtattaagtgcaggaaaaggaaaaaataaattaccatgggaaaatgagcaacctggaatcatgggagaaaaccagacctccacttccaaggatatagagcagttttcaacatatgatttcatcccatctgcaaaattaaagctttctcaaggaatgccagtcaatgatgatttatgttttagcagaaaaagagtatcaagaaacttatttcagaatagtcgggattttaacccagattgtcttcctttatgtgctgctggtactactgggactcatcaaacaaatctttctgggaaatgtgcacaacttggattttcacaaatatgtggtaaaactggcagtgtgggttctgacttacaattcctagggacaactagcagtcatcaagaaaaagtgtatgctagcctcaattttggcagtaagacacagcaaacatttggtagtcaaacagagtgtacttcctcaaatggtcaaaatccaagtccaggagcttacatccttccatcctatcctgtctcatcacctcgaactagtccaaagcatacatctcctcttattatatctccaaagaagtctcaagataattctgttaatttctcaaattcctggcctcttaaaagcttcgaaggactatcaaagccaagtccacagaagaagcttgtcagccaaaaatcgtctgatcctacgggtagaaatcatggagaaaattctcaagaaaaacctccagttcagcttacacctgccttggtgagatcgccatcttcccgacgaggtctaaatgggacaaagcctgttcctcccataccaaggggaataagccttttgcctgataaagctgatttaagcacagtgggacacaaaaagaaagagcctgatgatatttggaagtgtgaaaaagatagtcttccaattgatctttcagaattaaatttcaaggataaagatttggatcaagaagagatgcatagctctcttaggtcccttcgtaatagtgcagctaagaaaagagcaaaactgagtggcagtacttcagatcttgaaagccctgattctgcaatgaagctcgacttgacgatggactccccgtctctgtcttcctcaccaaacatcaattcttacagtgaaagtggagtttacagccaagaatcattgacttcttctctgtctacaactccccaggggaagagaataatgtcagacatatttccaacatttgggtcaaaaccttgtccaacaagactttcttctgcaaagaaaaaaatttctcatattgctgaacaaagccccagtgcagggtcatcatcaaatccacagcaaatttccagttttgacttcacaaccacaaaggctttatcagaagactcagtagtagttgttggaaaaggcgtatttggaagtttaagttcagcaccagcaacctgcagccaatcagtgatatcttctgtggaaaatggggatacattttcaattaaacaaagtattgaaccaccatcagggatttatggaagatcagtccagcaaaatttcatcatatcttgatgttgagaatgaaaaagatgctaaagtttctatttctaaatctacttataacaagatgagac

SEQ ID NO: 3491 - DNA, 1651 bp, Homo sapiens
cggggcctgtcccaggtctgcagtggggaacctgccgggccacgttggtggggcctgggccgcaccttcggtcagtgtggaggcccggtggctctggcccgactgggtggcgggtgtgggggcaggctggggcctgggggaggggcgaggtgccgtgggtggcggccgaggaggcatgaaattgctgcagatgcttcttcgggggaatccctgctgcccgcagcctgagatcagcccgcaaggcagctcggtgcccttccttggagctgccggccaccagcagagcctaccctcttcatggaaagcctcgtgcagtggccccctggtgatggcatccgacagtgatgtgaagatgctgctgaacttcgtgaacctggcgtccagcgacatcaaggcagccctggataagtccgcaccctgccgccgctccgtggaccatcgcaagtacctgcagaagcagctcaagcgcttctcccagaagtattcccggctcccgcggggccttcctggcagagctgctgagccctacctgaaaagggggtctgaggaccggcccaggaggctgctcctggatttgggccctgattccagccccggcgggggtgggggctgcaaggagaaggtgctgaggaacccctacagggaggaatgtcttgctaaggagcagctcccacagaggcagcatccagaagctgcccagcctggccaggtgcccatgaggaaaagacagctgcccgcttccttctgggaagagccaaggcccacccacagctaccatgtggggctggaggggggactgggccccagggagggacctccctatgagggtaagaaaaattgcaagggcttggagcccctgggacctgagactaccctggtgtccatgtctccaagggccctggctgaaaaggagccgctcaagatgcctggggtctccttggtgggccgcgtcaatgcctggagttgctgccccttccagtaccatggacagcccatctatccgggccccctgggggcactgcctcagagtcctgtccccagcctgggcctttggaggaagagcccagcctttcccggggagctggcgcacctctgcaaggatgtggacggcctggggcagaaggtgtgcaggcccgtggtgctgaaacccatccccaccaagccagccgtgcccccacccatcttcaatgtctttggctacctctagccacgcggagagggcctcagcccccacctctggcctgcaggagtgtcgaggtccccgaggcgctctcctgtgaggaggtggctgggccacagtgtggcctcttccgtttgtgtgcgcatgggagtggagggcaggattggggcagggctcctcaggcagtgacccttcagccttgcagccttggaagctgggaggctggacctggttggcccctccccaggcaggccagggcccagcagcttgtcccgctgtccctgtgcagaccataggtactgggatgttgcccttccttgccttgcagtcaccccagaagccagagagacgcatctgtttacctgccacccactctgcgagccaatctcagttgttgttcttgttcttcttgttctttgtaaatattgagaaagttaaaagaataaagacatttcttttggagtttccata

SEQ ID NO: 3492 - DNA, 1816 bp, Homo sapiens
agttgagatcaaacagacttttcattcctggttggtgcctgggagagtgacgaggcctatcagtactggaggacacagtcaagtgtttggtggaagaacagcccacattaagagctttggaaagactttcgtaagacaccaactcacctcccacggagtccacgggcctggtggggaggcttactactggctaagaaaggagagacagcttcatgagcgggcagtgcagaatgggccagcagggctgcaggtgccgtgggatctcaaggaagctgggagctgagctgagtggctctaaaatgtcttgatgcccttagaagagagaagatcttctggagagaggaatgatgcagcccccacaaatcacagaaggcctggggagaaaagggcgagcacagcaaagcaggtcagctcggtgcccttccttggagctgccggccaccagcagagcctaccctcttcatggaaagcctcgtgcagtggccccctggtgatggcatccgacagtgatgtgaagatgctgctgaacttcgtgaacctggcgtccagcgacatcaaggcagccctggataagtccgcaccctgccgccgctccgtggaccatcgcaagtacctgcagaagcagctcaagcgcttctcccagaagtattcccggctcccgcggggccttcctggcagagctgctgagccctacctgaaaagggggtctgaggaccggcccaggaggctgctcctggatttgggccctgattccagccccggcgggggtgggggctgcaaggagaaggtgctgaggaacccctacagggaggaatgtcttgctaaggagcagctcccacagaggcagcatccagaagctgcccagcctggccaggtgcccatgaggaaaagacagctgcccgcttccttctgggaagagccaaggcccacccacagctaccatgtggggctggaggggggactgggccccagggagggacctccctatgagggtaagaaaaattgcaagggcttggagcccctgggacctgagactaccctggtgtccatgtctccaagggccctggctgaaaaggagccgctcaagatgcctggggtctccttggtgggccgcgtcaatgcctggagttgctgccccttccagtaccatggacagcccatctatccgggccccctgggggcactgcctcagagtcctgtccccagcctgggcctttggaggaagagcccagcctttcccggggagctggcgcacctctgcaaggatgtggacggcctggggcagaaggtgtgcaggcccgtggtgctgaaacccatccccaccaagccagccgtgcccccacccatcttcaatgtctttggctacctctagccacgcggagagggcctcagcccccacctctggcctgcaggagtgtcgaggtccccgaggcgctctcctgtgaggaggtggctgggccacagtgtggcctcttccgtttgtgtgcgcatgggagtggagggcaggattggggcagggctcctcaggcagtgacccttcagccttgcagccttggaagctgggaggctggacctggttggcccctccccaggcaggccagggcccagcagcttgtcccgctgtccctgtgcagaccataggtactgggatgttgcccttccttgccttgcagtcaccccagaagccagagagacgcatctgtttacctgccacccactctgcgagccaatctcagttgttgttcttgttcttcttgttctttgtaaatattgagaaagttaaaagaataaagacatttcttttggagtttccata

SEQ ID NO: 3493 - DNA, 842 bp, Homo sapiens
ttgcacaactgcttccagccggacggagctcggccggctgcgccggggcctgtcccaggtcagctcggtgcccttccttggagctgccggccaccagcagagcctaccctcttcatggaaagcctcgtgcagtggccccctggtgatggcatccgacagtgatgtgaagatgctgctgaacttcgtgaacctggcgtccagcgacatcaaggcagccctggataagtccgcaccctgccgccgctccgtggaccatcgcaagtacctgcagaagcagctcaagcgcttctcccagaagtattcccggctcccgcggggccttcctggcagagctgctgagccctacctgaaaagggggtctgaggaccggcccaggaggctgctcctggatttgggccctgattccagccccggcgggggtgggggctgcaaggagaaggtgctgaggaacccctacagggaggaatgtcttgctaaggagcagctcccacagaggcagcatccagaagctgcccagcctggccaggtgcccatgaggaaaagacagctgcccgcttccttctgggaagagccaaggcccacccacagctaccatgtggggctggaggggggactgggccccagggagggacctccctatgagggtaagaaaaattgcaagggcttggagcccctgggacctgagactaccctggtgtccatgtctccaagggccctggctgaaaaggagccgctcaagatgcctggggtctccttggtgggccgcgtcaatgcctggagttgctgccccttccagtaccatggacagcccatctatccgggccccctgggggcactgcctc

SEQ ID NO: 3494 - DNA, 1162 bp, Homo sapiens
tttgtatctggagaggcgctcctgattggcctgaggggccccccagctccggggagttgtcctccattcagcccactcaagggttgcacaactgcttccagccggacggagctcggccggctgcgccggggcctgtcccaggtctgcagtggggaacctgccgggccacgttggtggggcctgggccgcaccttcggtcagctcggtgcccttccttggagctgccggccaccagcagagcctaccctcttcatggaaagcctcgtgcagtggccccctggtgatggcatccgacagtgatgtgaagatgctgctgaacttcgtgaacctggcgtccagcgacatcaaggcagccctggataagtccgcaccctgccgccgctccgtggaccatcgcaagtacctgcagaagcagctcaagcgcttctcccagaagtattcccggctcccgcggggccttcctggcagagctgctgagccctacctgaaaagggggtctgaggaccggcccaggaggctgctcctggatttgggccctgattccagccccggcgggggtgggggctgcaaggagaaggtgctgaggaacccctacagggaggaatgtcttgctaaggagcagctcccacagaggcagcatccagaagctgcccagcctggccaggtgcccatgaggaaaagacagctgcccgcttccttctgggaagagccaaggcccacccacagctaccatgtggggctggaggggggactgggccccagggagggacctccctatgagggtaagaaaaattgcaagggcttggagcccctgggacctgagactaccctggtgtccatgtctccaagggccctggctgaaaaggagccgctcaagatgcctggggtctccttggtgggccgcgtcaatgcctggagttgctgccccttccagtaccatggacagcccatctatccgggccccctgggggcactgcctcagagtcctgtccccagcctgggcctttggaggaagagcccagcctttcccggggagctggcgcacctctgcaaggatgtggacggcctggggcagaaggtgtgcaggcccgtggtgctgaaacccatccccaccaagccagccgtgcccccacccatcttcaatgtctttggctacctctag

SEQ ID NO: 3495 - DNA, 1072 bp, Homo sapiens
aatcaaacccgagatgacagttgagatcaaacagacttttcattcctggttggtgcctgggagagtgacgaggcctatcagtactggaggacacagtcaaggtcagctcggtgcccttccttggagctgccggccaccagcagagcctaccctcttcatggaaagcctcgtgcagtggccccctggtgatggcatccgacagtgatgtgaagatgctgctgaacttcgtgaacctggcgtccagcgacatcaaggcagccctggataagtccgcaccctgccgccgctccgtggaccatcgcaagtacctgcagaagcagctcaagcgcttctcccagaagtattcccggctcccgcggggccttcctggcagagctgctgagccctacctgaaaagggggtctgaggaccggcccaggaggctgctcctggatttgggccctgattccagccccggcgggggtgggggctgcaaggagaaggtgctgaggaacccctacagggaggaatgtcttgctaaggagcagctcccacagaggcagcatccagaagctgcccagcctggccaggtgcccatgaggaaaagacagctgcccgcttccttctgggaagagccaaggcccacccacagctaccatgtggggctggaggggggactgggccccagggagggacctccctatgagggtaagaaaaattgcaagggcttggagcccctgggacctgagactaccctggtgtccatgtctccaagggccctggctgaaaaggagccgctcaagatgcctggggtctccttggtgggccgcgtcaatgcctggagttgctgccccttccagtaccatggacagcccatctatccgggccccctgggggcactgcctcagagtcctgtccccagcctgggcctttggaggaagagcccagcctttcccggggagctggcgcacctctgcaaggatgtggacggcctggggcagaaggtgtgcaggcccgtggtgctgaaacccatccccaccaagccagccgtgcccccacccatcttcaatgtctttggctacctctagccacg

SEQ ID NO: 3496 - DNA, 1854 bp, Homo sapiens
agcgcagcgagccaggcccggaactagtaggctgcgccgcgcgcgccgcgccggggcgggagctgggtctgggcggcgggcaggagctggcgggggcgcacgggcagcgctgcggacagcccgggagccgcggcgatggcggtgcaggcggcgctcctcagcacgcaccctttcgtgcccttcggcttcgggggctccccggacgggctagggggcgccttcggagccctggacaagggctgctgtttcgaggacgatgagaccggggctccggcgggtgcgctgctgtcgggagccgaaggaggggacgtgcgcgaggccacccgcgatctactcagcttcattgactcggcgtccagcaacatcaagctggcgctggacaagccgggcaagtcgaagcggaaggtgaaccaccgcaagtacctgcagaagcagatcaagcgctgcagcggcctcatgggcgccgcgccccccggcccgccctccccgagcgccgccgacacgccagccaaacggccgctggccgcccctagcgccccgacagtcgcggccccggcccacggcaaggctgccccccggcgggaggcgtcgcaggccgccgcggccgccagcttgcaaagccgaagtctggccgcgctcttcgactcgctgcgccacgtccccgggggtgccgagccggcggggggtgaggtggctgcgccggcggccgggctaggaggtgcgggcactgggggcgcgggaggggacgtggcaggccccgcgggggccacggcgatcccaggggccaggaaggtcccgctgcgggcacgcaatctgcctccgtccttcttcacggagccgtcccgggcaggcggcggcgggtgtggcccgtcggggccggacgtgagcttgggcgacctggagaagggcgcggaggccgtggagttctttgagctgctggggcccgactacggcgccggcacggaggcggcagtcttgcttgccgccgagcctctcgacgtgttccccgccggagcctccgtactgcggggacccccggagctggagcccggcctctttgagccgccgccggcagtggtgggaaacctactgtaccccgagccctggagcgtcccgggctgctccccgaccaaaaagagccccctgactgccccccgcggcggcttgaccttgaacgagcccttgagccccctgtaccccgccgctgcggattctcccggcggggaggacgggcggggccatttggcctctttcgcccccttctttccagactgcgccctgcccccgccgccgccgccccatcaggtgtcctacgattacagcgcgggctacagccgcaccgcctattccagcctttggagatccgacggggtttgggaaggggcgccgggggaggagggggcgcaccgggactgacttcgaggcacgcttcccttcattagagacggctgtggagagcgccgcgcctccgtgggtttctcctaaatctgaagaacgatgggaaaatgcacgtggagatgaaaccagatttttaaaaattcaattaataaaagcaacttcagaaaaaagagatgaagacgagttggggattgtttaatcacaacctcaagtgttaaaacaaaaacaaacaaacacgtttgtaggttcttactggaccagaggagtcaagaaaccaagatggtttggggtatggggtggggacggcaaaaggggtaagagctggcttctgtagccacctgtcccttctatttttcagcgaaggtcagtgtatttagtgtaattaccccttctaaacagtgtcctagtccctcccttccctctccttgagtgcattttgaattaaagcctatattg

SEQ ID NO: 3497 - DNA, 2786 bp, Homo sapiens
tgaaataggagccaaggtatgctatgagccaaggattatgagtaatccagttttgtgcactttaagccatttgaaaaacagaaaagcaaaacaacaaaataatttttaagaaattgaatatagggtgttatgctctgaatgtgtccccctaaaattaatcaccaatgtcataagattaggaagtagggctttaaggtagtgattcagtcatgaagggagagtgttcacgaatgagtttaggatccttacacaaggactggatggagtgggcttcccctgttttgcccttccaccttctgccatgtgaggacacagtgcatctcctcctgaagacacagtgcacaagataccatcttggatgcagagaccagaccctcaccagacaccaatcctgctggcaccttgatcttggacttctagcctatggaactgtaagattggggaagatgccaggtgatagaatccaccctgcctctgacagcatccaatctggagcaaaggcttatttcaaccctcccccaagctcccaatacaagcccaaattctggaacaggtcctttccaacacctccttcagagaagctccctggctccaggcagtgcttgctcccctcactgcagcaggaagcctaacttgcgaactgcaggtgtgctccaggtggtcactggatgcaaggcattgacagatggatcccatcgatacccccactgcaaaaccatagtgcagtgaatagaagacacttctctgcaccccaaaagctccatgctgattgtgagaaggaaatgctggatggaggggttcctggaactactgtgagggtttcttttgatttctcctgcttagaaatggtgagagaactttggatgtggaacgtggaggaggaggaacacgaagtggggatctccacttggggtggtcagcactgcgggtgcccagcaaagtcactgcctggtccacatcccggaggggtctctgcgcctcagtcggcatcgcagctgatggtgaaacttttggtgtggcagaagagtgtccacaaacttcggaagatcgctgctcagagtgaggaatggagttgtgttttgaataaaatatccacgcatccttttgtgagcaaggagcatgatggtacttagacctaccatttctcgttatggtggttgcggttacagtggggctggggtgtttacctggagcctggacatccactgggacatgatacccactgggaattttttgtgtcaatctggtctctgatgtccacctggggattgggtatccacctaaggcctgatgtttacctggagccagatgtgcacctgagacctgatgtctatctgtggccttatgttcccctggggaccgatgcacacctgaaggataggtattcatctggggcctgatacccaccagtagtatgggtgtcaaccttggggctagtgttcagctggcgtccactgtctacttggggcctggtgtacacatggggcctgggcatccacctgagacttgatgtttaatatggtctggagttcttttggggcctgttgtaccctggagcctgggtgtacacctggagcctgatgtcccaggtgaacaactgggtcccaggtgatcttcaggccctaggtgaaaactccaggctctaagtggacaaccaggctccaggctgatgtttactggggccagatgtctaccaggccccaggtgaaatccccaggctccaaatggacaacatagccccaggttccaggtagacattggaatccaaatcaacaccaggccccagatggacacccaggcctgtggtggacatcagactgcagaaggtcatctggctcgaggtggacatcaagccccaggtggatacctagtccccaggtggatatcaggccccactttgacaccagtccctgggtagataccttggcctcaggtggatatccagtctctagctaagcatcaggctccagggggacccaggccctagctgactggggactagtgttcatatggggccacatgtccatctgggccctaggtgtcaacttgtagcctgatgtcaacctggaagctggtgttcaccagagaggactaaagtcctcctggtgcctggtgtccaacttgggactttgtgtccacctggagaccgatgtccacttgggaccagatgtccagctggagcaagatgtccacctgcagcctaaaacttcacctaaggcctgatgttccccagggcctacagagcctatgtatctacctagggacttgtgtccaggtggggcctgaattccacctggggcctggaattaacctgggacctgatgtccacctgagacgtgggtgttcctctggagtctgatatctatctggggcccgggtgtcctcctgtggtctgatgtccacttgtaggctggtgtccacctggggcctgggtgtccacctaggaacctgatgtatacctgaagtccagtgtctacgtgggtactgatgtctaccaggaaagtgatataaacctggggcctgatagccacctgggccctgagtgtccacatatgttctgatttctcttttggccttagtgtagggcctgagtgccacctgcttcctgatgttcaccaggaacctaggtattcacttgggagccctgggggcctctgcccttttggccgcgttgtctcctggcttttagggtggtgggattctcggctctgattgcagcaggtggattcacttagctctcctccccttttagcattactgtcttctgtaataaacctctcactttg

SEQ ID NO: 3498 - DNA, 992 bp, Homo sapiens
aaagtaggagccctccatggcagtgcttgagtgtcggggctctgagtctccggcctgacctctccacgtggtcgacgggaacgtccccagatgccaggattcgcaaagggctgaccaggatggcgaaaccttaggcagagtccggggaaagcagcacggcatcccagcctcaggcctgcccggacggtgttggttggggtaagattggggaagatgccaggtgatagaatccaccctgcctctgacagcatccaatctggagcaaaggcttatttcaaccctcccccaagctcccaatacaagcccaaattctggaacaggtcctttccaacacctccttcagagaagctccctggctccaggcagtgcttgctcccctcactgcagcaggaagcctaacttgcgaactgcaggtgtgctccaggtggtcactggatgcaagaaatggtgagagaactttggatgtggaacgtggaggaggaggaacacgaagtggggatctccacttggggtggtcagcactgcgggtgcccagcaaagtcactgcctggtccacatcccggaggggtctctgcgcctcagtcggcatcgcagctgatggtgaaacttttggtgtggcagaagagtgtccacaaacttcggaagaacagaaacgcctacagttgcggccccctgtagtgcaatttgtgtcagtctagggagagtggatttggagcccaaccaccattgaggaaaatccatctgacggacatgagcctcactcaggttctcatctacttccttggggtttgccccgcctccctcaggagtttggaaccacatactgttctggaggggacctctcactgctgcagaacctgtcctccaggacacccacaagtgttcatcttggtcatggctaattaacttaccatatggtagtgaactacattctggggccccaatattttgtttattttttaaaaataaaattagtaccattgtttattttc

SEQ ID NO: 3499 - DNA, 992 bp, Homo sapiens
aaagcaggagccctccttggcagtgcttgggtgtcggggctctgaggctccggcctgacctcttcacggggtcgacgggatcgtctccggatgccaggagtcccaaagggccgaccaggatgaggaaaccccaggcggagtccgggggaagcagcacggcatcccagcctcaggcctgcccggacggtgatggttggggtaagattggggaagatgccaggtgatagaatccaccctgcctctgacagcatccaatctggagcaaaggcttctttcaaccttcccccaagctcccaatacaagcccaaattctggaacaagtcctttccaacacctccttcagagaagctccctggctccaggcagtgcttgctcccctcactgcagcaggaagcctaacttgcgaactgcaggtgtgctccaggtggtcactggatgcaagaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaagaacagaaacgcctacagttgcggccccctgtagtgcaatttgtgtcagtctagggagagtggatttggagcccaaccaccattgaggaaaatccatctgacggacatgagcctcactcaggttctcatctacttccttggggtctgccccgcctccctcagaagtttggaaccacatactgttctggaggggacctctcactgctgcagaacctgtcctccaggataccgacaagtgttcatctcggtcgtggctaattaacttaccatatggtagtgaactcccttctggggccccaatattttgtttatttttaaaaaataaaattagtaccattgtttattttc

SEQ ID NO: 3500 - DNA, 515 bp, Homo sapiens
ggcaagagggcgcgtggcagcccaaggccatggcgggacacccaaaagagaaggtgattccagatgaggtccatcagaaccagatcttgcgggaactgtacctcaaggagctacgaacccagaaactctacacgcagtatcacgtgaatcccctccgcaagattcatacagtcaccaggaagcccatgtcttggcatgataacctggaggaacctgcagatgccaggtttctgaatctcattcaccatgctgcccagggaccaaggaagaagtacccagagacacagactgaaaaccaggaagttggatgggacttagagcccttgatcaacccagaacgccatgaccgcaggctgaatcacttcagggtctgcagtgacatcactctgtacaaggctaaaacgtggggcttaggagatgatcaccacaagtagcatcccagcggatgagcccatctgtggatctaatgccttaagtgtgcacagcccagagaaataaaatactactttaaaacg

SEQ ID NO: 3501 - DNA, 4141 bp, Homo sapiens
ggtaacggcggctcccgcgtcctcctccatgtccccgcctatccccgccgcagcccgccccgtctcctcctccctccgcagcctcgccgagtcctcggtgcgggctgcgagcgggacccgcggagctgcgctgtcctcgacgcctccgccaggcgcgggccgaggagcctccaagagctggcccggcccccggccgccgccgcccaaccccgggcatctgccccgcgccgttgtccccgcggcttcgggccggcgggaccgccccgtcccttccaggggtgacccgggggtcgcgggtgggacggcgcctgcggccgagtctggggggcgccgggtgtcgggtcgggaagcggccgccgcgactcttgcctcccgggcgtcgttgctccacgggcctgcctccacccgcggggacaggtgccccggctggggtctgttgggaagatggcgaccccgggcatgagctggcagcagcactattacggcggctcggcggccaaattcgcgccctcgccggccaccgcacagctggctgggcacagcatggactacagccaggagatgcacctgaaaatgagcaagaaaatcgcccagctcaccaaggtaatatatgctttaaacactaaaaatgatgagcatgaatctgcaattcaagccctcaaagatgctcatgaagaagaaattcaacaaattcttgctgaaacaagagaaaaaatattgcagtataaaagcaaagtaacagaggagctagaccttagaagaaagattcaagttttagaatcatcattagaagatcacataaaaatgaagcagcaggctttgacagaatttgaagcttataagcacagagttgaggacatgcaactttgtgcagaagcccagcatgtccaacgcatagtgaccatgtctagagaagtcgaagagattagaaggaaatttgaagaaaaattacggagctttggacaacttcaagtacagtttgaaaaagacaaacgattggcattggaagacttgcaagctgctcacagacgggagatacaagagctattgaagtcacagcaggatcacagtgcctcagtaaataaaggccaggaaaaggcagaggaactacacagaatggaggtggagtccctaaacaaaatgcttgaggagctaagacttgaacggaagaaactaattgaggattatgaaggcaagttgaataaagctcagtccttttatgaacgtgagcttgatactttgaaaaggtcacagctttttacagcagaaagcctacaggccagcaaagaaaaggaagctgatcttagaaaagaatttcagggacaagaagcaattttacgaaaaactataggaaaattaaagacagagttacagatggtacaggatgaagctggaagtcttcttgacaaatgccaaaagcttcagacggcacttgccatagcagagaacaatgttcaggttcttcaaaaacagcttgatgatgccaaggagggagaaatggccctattaagcaagcacaaagaagtggaaagtgagctagcagctgccagagaacgtttacaacagcaagcttcagatcttgtcctcaaagctagtcatattggaatgcttcaagcaactcaaatgacccaggaagttacaattaaagatttagaatcagaaaaatcgagagtcaatgagagattatctcaacttgaagaggaaagagcttttttgcgaagcaaaacccaaagtctggatgaagagcagaagcaacagattctagaactggagaagaaagtaaatgaagcaaagagaactcagcaagaatattatgaaagggaacttaaaaacctgcaaagtagattggaagaggaggtgactcaattaaacgaggcccattctaagactttggaagaattagcttggaagcaccatatggcaattgaagctgtccacagtaatgcaattagggataagaaaaaactgcaaatggatttggaagaacaacataacaaagataaactaaacctggaagaggataaaaatcagcttcaacaagagctagaaaacctaaaggaagtactggaagacaagttgaatacagccaatcaagagattggccacctccaagatatggtaaggaaaagtgaacaaggtcttggctctgcagaaggacttattgctagtcttcaggactcccaggaaaggcttcagaatgagcttgacttgactaaagacagcctaaaggagaccaaggatgctctattaaatgtggagggtgagctagaacaagaaaggcaacagcatgaagaaacaattgctgccatgaaagaagaagagaagctcaaagtggacaaaatggcccatgacttagaaattaagtggactgaaaatcttagacaagagtgttctaaacttcgtgaagagttaaggcttcaacatgaagaggataagaagtcagcaatgtctcaacttttgcagttgaaagatcgagagaaaaatgcagcaagagattcatggcagaagaaagtagaagatctcttaaaccagatttccttgctgaaacagaatctggagatacagctttcccagtctcagacttctttgcaacaactgcaagcccagtttacgcaagaacgacagcggcttacgcaagagcttgaagaattagaggagcaacatcagcaaagacacaaatcattaaaagaagcacatgtccttgcatttcaaactatggaagaggaaaaggaaaaggagcaaagagctcttgaaaatcatttacaacagaagcattctgcagagcttcaatcactaaaagatgcacacagagagtcaatggagggcttccggatagaaatggaacaggaacttcagactcttcggtttgaattagaagatgaaggaaaggctatgcttgcttccttgcgctcagaactcaaccatcaacatgcagctgcaattgatttgttacggcataatcatcatcaagaattggcagctgctaaaatggaattagagagaagcatagacatcagcagaagacagagtaaggagcacatatgtagaattacagatctacaagaggaattaagacacagagagcatcacatctctgaattggataaggaggttcagcaccttcatgagaatataagtgccctaaccaaagaactggaatttaaggggaaagaaattctcagaatacgaagtgaatctaaccaacagataaggttgcatgaacaagatttaaacaagagacttgaaaaagagttggatgtcatgacagcagaccacctcagagagaaaaatatcatgcgggcagattttaataagactaacgagctactcaaggaaataaatgccgctttacaagtgtcattagaagaaatggaagaaaaatatctaatgagagaatcaaaaccagaagatatacagatgattacagaattaaaagccatgcttacagaaagagaccagatcataaagaaactaattgaggataataagttttatcagctggaattagtcaatcgagaaactaacttcaacaaagtgtttaactcaagtcctactgttggtgttattaatccattggctaagcaaaagaagaagaatgataaatcaccaacaaacaggtttgtgagtgttcccaatctaagtgctctggaatctggtggagtgggcaatggacatcctaaccgcctggatcccattcctaattctccagtccacgatattgagttcaacagcagcaaaccacttccacagccagtgccacctaaagggcccaagacatttttgagtcctgctcagagtgaagcttctccagtggcttctccagatccccagcgccaggagtggtttgcccggtacttcacattctgaaagaattgtgttggcacagctctgtatagactgttactaagagcatgactttatacagattgttatgtaaataggctttcctatgtcaaacactgtgaatgagaaagtatttgtctctccaacttgaaaatgcactgtatttcctgtgatatttattggaatcattctataaggtactatattatgtgtgtaattataactgttatttttatttgagatggaagagtctttaacctttgtaattactgcataataaattttgttagaatcaaac

SEQ ID NO: 3502 - DNA, 3700 bp, Homo sapiens
aaatctcacagtgctcatttttaaaagggtacacaaaaaaatctcaattccaaagaatttggatcagccaagagaaggcatgggaaaatatcaaatgtttgtatgattacctgggcaaccttttctgtgctatgtaaatgtgtaatgactaatcaaccaggacggccaagggatttgtttctagagataggcaattttcatttgtgcctgtgattggctcagctctgcgtgtgaagagggaaaaggcttccgtttatttagcataatgatggaccaaaacaaaagaagaaatcatttcactcatgcttaggtaatatatgctttaaacactaaaaatgatgagcatgaatctgcaattcaagccctcaaagatgctcatgaagaagaaattcaacaaattcttgctgaaacaagagaaaaaatattgcagtataaaagcaaagtaacagaggagctagaccttagaagaaagattcaagttttagaatcatcattagaagatcacataaaaatgaagcagcaggctttgacagaatttgaagcttataagcacagagttgaggacatgcaactttgtgcagaagcccagcatgtccaacgcatagtgaccatgtctagagaagtcgaagagattagaaggaaatttgaagaaaaattacggagctttggacaacttcaagtacagtttgaaaaagacaaacgattggcattggaagacttgcaagctgctcacagacgggagatacaagagctattgaagtcacagcaggatcacagtgcctcagtaaataaaggccaggaaaaggcagaggaactacacagaatggaggtggagtccctaaacaaaatgcttgaggagctaagacttgaacggaagaaactaattgaggattatgaaggcaagttgaataaagctcagtccttttatgaacgtgagcttgatactttgaaaaggtcacagctttttacagcagaaagcctacaggccagcaaagaaaaggaagctgatcttagaaaagaatttcagggacaagaagcaattttacgaaaaactataggaaaattaaagacagagttacagatggtacaggatgaagctggaagtcttcttgacaaatgccaaaagcttcagacggcacttgccatagcagagaacaatgttcaggttcttcaaaaacagcttgatgatgccaaggagggagaaatggccctattaagcaagcacaaagaagtggaaagtgagctagcagctgccagagaacgtttacaacagcaagcttcagatcttgtcctcaaagctagtcatattggaatgcttcaagcaactcaaatgacccaggaagttacaattaaagatttagaatcagaaaaatcgagagtcaatgagagattatctcaacttgaagaggaaagagcttttttgcgaagcaaaacccaaagtctggatgaagagcagaagcaacagattctagaactggagaagaaagtaaatgaagcaaagagaactcagcaagaatattatgaaagggaacttaaaaacctgcaaagtagattggaagaggaggtgactcaattaaacgaggcccattctaagactttggaagaattagcttggaagcaccatatggcaattgaagctgtccacagtaatgcaattagggataagaaaaaactgcaaatggatttggaagaacaacataacaaagataaactaaacctggaagaggataaaaatcagcttcaacaagagctagaaaacctaaaggaagtactggaagacaagttgaatacagccaatcaagagattggccacctccaagatatggtaaggaaaagtgaacaaggtcttggctctgcagaaggacttattgctagtcttcaggactcccaggaaaggcttcagaatgagcttgacttgactaaagacagcctaaaggagaccaaggatgctctattaaatgtggagggtgagctagaacaagaaaggcaacagcatgaagaaacaattgctgccatgaaagaagaagagaagctcaaagtggacaaaatggcccatgacttagaaattaagtggactgaaaatcttagacaagagtgttctaaacttcgtgaagagttaaggcttcaacatgaagaggataagaagtcagcaatgtctcaacttttgcagttgaaagatcgagagaaaaatgcagcaagagattcatggcagaagaaagtagaagatctcttaaaccagatttccttgctgaaacagaatctggagatacagctttcccagtctcagacttctttgcaacaactgcaagcccagtttacgcaagaacgacagcggcttacgcaagagcttgaagaattagaggagcaacatcagcaaagacacaaatcattaaaagaagcacatgtccttgcatttcaaactatggaagaggaaaaggaaaaggagcaaagagctcttgaaaatcatttacaacagaagcattctgcagagcttcaatcactaaaagatgcacacagagagtcaatggagggcttccggatagaaatggaacaggaacttcagactcttcggtttgaattagaagatgaaggaaaggctatgcttgcttccttgcgctcagaactcaaccatcaacatgcagctgcaattgatttgttacggcataatcatcatcaagaattggcagctgctaaaatggaattagagagaagcatagacatcagcagaagacagagtaaggagcacatatgtagaattacagatctacaagaggaattaagacacagagagcatcacatctctgaattggataaggaggttcagcaccttcatgagaatataagtgccctaaccaaagaactggaatttaaggggaaagaaattctcagaatacgaagtgaatctaaccaacagataagattagaagaaatggaagaaaaatatctaatgagagaatcaaaaccagaagatatacagatgattacagaattaaaagccatgcttacagaaagagaccagatcataaagaaactaattgaggataataagttttatcagctggaattagtcaatcgagaaactaacttcaacaaagtgtttaactcaagtcctactgttggtgttattaatccattggctaagcaaaagaagaagaatgataaatcaccaacaaacaggtttgtgagtgttcccaatctaagtgctctggaatctggtggagtgggcaatggacatcctaaccgcctggatcccattcctaattctccagtccacgatattgagttcaacagcagcaaaccacttccacagccagtgccacctaaagggcccaagacatttttgagtcctgctcagagtgaagcttctccagtggcttctccagatccccagcgccaggagtggtttgcccggtacttcacattctgaaagaattgtgttggcacagctctgtatagactgttactaagagcatgactttatacagattgttatgtaaataggctttcctatgtcaaacactgtgaatgagaaagtatttgtctctccaacttgaaaatgcactgtatttcctgtgatatttattggaatcattctataaggtactatattatgtgtgtaattataactgttatttttatttgagatggaagagtctttaacctttgtaattactgcataataaattttgttagaatcaaa

SEQ ID NO: 3503 - DNA, 6622 bp, Homo sapiens
gaaccagcaggagaggaaaaagggtgggcgcgcgggtgggcccgggaggcggagaccttcgggaagctggggccacgcggcggtgcaggcgacgggactgcagtgccacctctcccgagaaacccacacgctcgcacgcccgcgcgcgcacgcacgtgcacacggtgggcagggagaaaacgagagagtctgagtgctgggcgcgttttagcgatggcttctgctctcaacagcaaaattaacccgcccggcacttgccagggctccaaagccgacggtggcgccggctggagaatggactgtgatccccagatgcacgtgaaaatgtgcaagaagatcgcccagctcaccaaggtgatttatgccctgaacacccgccaggatgaggctgaggccagcatggaggcgctgcgggaagcgcaccaggaggagctccagaatgcggtggcagagaccaaggccaggctcctgcaggaacagggctgcgcagaggaggaagcccttctacagcgcatccaggccctggagagcgccctggagctgcaaaagaggctgacggaggaggcgctggctgagtcggcctcgtgcaggctggagacgaaggagagagagctgagggtggaggcagagcacgccgagcgagtcctcacgctctccagggaaatgctggagctcaaggctgactacgagaggaggctccagcacctgacgagccacgaggctaccccgcagggccggctgccccaggagagccctgaaaccaagtcggagccaggccagggcccggagatgcaggaggtcctgctagaggtgcagcggctgcgagtggagaaccagcagctgagcaaggactacgcccgcaaggccgaggagctgcaggccacctacgagagggaaaacgaggccatccggcaggccatgcagcagtcggtgagccaggccctgtggcagtggcaggagaaggagtcggacctccgcaagaacttccaggtccaggagtcagccctgcaggctcaggtccggaagctggaaggagacctggagcacagaggccgcaagataagtgacctgaagaagtacgcccagaagctgaaggagaggattcaggacctggatgtgcagcttaaggaggctcgacaggagaattcagagttgaaaggcactgcaaaaaaacttggggagaagctggctgttgccaaagacagaatgatgctgcaggagtgtcgtgggacacagcagacagatgccatgaagactgagttagtttcagagaacaaagtcctgcgggaagagaatgacttggaagccggcaatcttcatcctcagcaggatcaaagctgtctcaaggagtgcccttgcatgaaaggaggcacagatatgcagaccaagaaagaggcaagtgctgagacagaatatatgaagcaacaatatgaagaagaccttcgtaaaatcaaacatcagacagaagaggagaagaaacatctcaaagaccagctagtgaagcgactagaagacttggtaaagaagcacaccgtggaaatcaaatccgttcgctcgtccgtggaggctgaaagaaagaaactgcagagggaagtagaagcacagttggaggaagtgaggaagaaatcagaaaaggagataaagcagctggaagaagagaaagcagccctcaatgtgaagcttcagaattctctgcttgaggttttaaggctggaagaatttatccaacaaaataagacacgccccacaggagctgaggaaagtccccaggaattaggccgccagcactgcagcattctggagacccaggatccatgcttgaagctggatgaaacttcgccgagaggagaggagtatcaagataagttagcagctgaagaaggaaccagcagtgatgaagaagaaaggaccaaagtgcttctcaaggagggaagtgacccacaacctccactgggctctttgttgaaggagaaaacatccaaaatccagcgtctagaggaggactggcaaagccagaaggccaaattgcaagcccaggtctcacagatgcagcaggctctggagcagtgcaccagcaactacagggaggacctgcaggcactcaagcagctctcggacctggagagggagaagctgcagcgtgagctccaggagaccactcagcagaaccacgccatgaaagcccagctcgaggcttcccaccagagagccctgcgcatgctggagaaggccagacatcaggaactcaaggccacagaggaacgcttgaagaaggaatccagccacagcctccagatccaacaccagacacaccgactggagctccaggccttggaggaaaaggccaggcaagagctgcaggaggagcgtgagaggatgcaggcacagcaggccctgctgctagagtcgctcagacaggagctgtcggagcagcaagctgcctgttctgggcaccagaaggacttggaggcactgcaggccgagctgagggctctgggcagacagcaagccagcagccagtgtccaggagacagcaaggatcacataatcgccacagaggagcggggcggcccgggccaggccggctccccaccgggcgctgctgggcagggttccggcgagggatgcgggctctgggaggagaacgcgcagctccaggacgcggtgcggcggctgcgcgcggaggtggagcagcatcagcaggaggcgcagaagctccgagaccagcgcaggttcctggaggagactcagcaagcccagcgggccagggaggtggagacactgcgccaggaacaccggaaggagatgcaggccatggtggcagatttcagtagtgcccaggcccagctccaggcccggctggctgccctggaagccgaactgaaagattccggagagaagccagggaagggagcgtccaggcccgaggaccttcagctcattggccgcctgcagacccgcctgaaggagagagaggacatcatcaagcagctcacggaagagagaagatttcactacgcagcattccccagtgccatgtcccaccggaatcggtctttctctttcaatcctcacccgggatatttgaccccttccatgaagaaaaagaaggtggaggacgtgcccagccgcgtggtcagcgtgccgaacctcgcctcctatgcaaagaactttctgagtggcgatctgagttccaggattaatgcccctccaataactacatcacccagcttggacccaagccccagctgtggccggacctacaaacccaaccagtctacagatgcaaaaactgccacaaggaccccagatggtgaaacggcccaagccaaagaagtccagcagaaacagggctctccgcaccaggaatggttcaccaagtacttttctttctaagctaacctttgggatacatcacagaggatacttgaaaaacatttattttaaatcatccgattgaaggaatgaactaacaccaaccaaccaaataatatgcttatgatttatatatgatagctaaaacaaattttggcgttaacacttcatactgttctgccaggcacagcagctcacgcctgtaatcccatcactttgggaggctgaggcagatggactgcttgagtccaggaatttgagaccagcctggccaatatggtgaaaccccatctctacaaaatatacaaaaattagccaggcatggtggcgtgtgcctgtggtcccaggtacttgggggactgaggcgggaggatcacttgaacctaggaggcagaggttgcagtgagccaagttcgaactcctgcattccaaccagcctgggtgacagagggagaccctgtctccaaaaaaaaaaaaaaaaaaaaaaaaaaaaaaaaaaaaaaaaaaaattgacattaaaccagtgttattaaaagtcatctataggaaaatgttattagcgttactaatgacccataccttgtatttctagtgtccataacatcatactccattttgtggaacatcagactttgtgatttccatgatctatttcaaaagtggttgtacttgtccttaggatgctagtcaactccactggaaagctgtttctatgtaaaatgatgcaattccaaaatgcacatctaacctcaataggaagacaaataacagttaaacaggaaagccaactaaaaacaaaccaaacctaccagaaatggatggtagcatgcttggactgaatactttcacttccttggtctaagacaagcagcagattatagatgggataacacccacctctaaaagggctttgcaaggattaagcaagataacataaattaacatgaattggaattaagtaccacaaggtttttctgtaaataaccaatcctagcccagttataggtctcagtgtaatgaccatagtgccaacatgatcacttgtgaaggtctctagattatctgttctttgaagtcaaagatcttctagactgggcacatggctcatgcctgtaatcccaacactttgggaggctgagatgggaggagagcttgaggccaggaatttgagaccagcctgggcaacacagcgagacctccatctctacaaaaaaataattagcccaaagaaaacccagctacttggaagtctgaggtaggacagcatgagcccaagagttcgagaccagcctgggcaagatagtgagatcccatctctacagattaaaaaaatatatatatatatcccctgaacctctggtctttgggtttgagccatttgcctcatggtgtgttgcttcttcactgcatgaattcccagtgggttaaaggaaccgcaatggctgttcacggtgctgaccttgctctcagtccacactgatttgtcttaccttctgacagagcaatgtgatttgacaagactcaataacaacttttagggggcaaaatattttttcagtctttggtgctggcccagaaggtggcccacaaaccaatgttaattctatgcattgtcaaatctttgctctttgaataaaactttgaataactgggcaataaaaatggttgacttgtattgattttccacagaaaggtaaaattagatgaagacagcttagaaatagaaagttcagttcacattaacctcaatcacaccatcttaaaaaaaaaaaagctgattacatataactgtcaaacttacgtattaaaggtaaatttactgcctaatcaaaacgaggctccaatgcatttttaaatgcaaacaaacacttgtcaccatacattaacacaccatactgtttttcactaccaaatattttttgtgagtttcccgcttagagtgtcttagttcgttcaggctgctctaacaaaatatcttacttatactggataatttataaacaatagaaatatgtcactcacagtcctagaggctaagtccaagatcaaggcaccagcagatatggagtctggggagggcccattcttcagaaatgggtgcctgctacgtgtccttacatggtggaagaggcaagagcgcctccctgagcctcttttgtaagggtacttatcctactcatgagggtgaagccctcatgactccattgcttcccaaaagccccacctcttaatactattacattgacattaggttccaacatatgaattttggaagggacatcaacattcaggacatagcagtgaaccctgtaggactgctctttattttgtgctttcaaaaagactacatacaggtggttctatttttgtgtgttgaaacactttcccaggctgcactttgcatttctgtccttaaactcagcatgatccctgggcaaggagaaaattttactagttgagatcgtacataggttttgactcctttcttgctgcaggtgactgaaaagatctttcagtcttaaatttctaaattctaccctgcaatgattatatctttgttaacaaaatctttgcatgcttccataattttttattgaggccatatgccttgggtattgaagtaaggcatttaaggacacaaacttaagctttttgtttgttattaccaaactgccattcagaaagtttctaacaatttacacccttaccagcagtaaatgaacctactgtgccctaacactattgacaaagaaatacaatttgatagataaaacattctattttagtttgcataatgattccatcaatctctcaacagcagagcggtctagagatgacagtgatggcgtagaggtgacagtgaagatgaagagaaattatccaattcgggattaagttaagagagagaaaaaaacagtatttaatggtaaatctcttcaggctgtattatgacaggggtggaagagttaatatgttcctgcagcaaaactgaaaggaatactatctgttccacatgaaagcaaactgttttgtaattggggtaggtaaaaatggattcacccagtcaatggctgcacaccacatacctgagcccttaactgctctaacactgatgtaatatccaacccaacatttgtgattgaggctacttggttaatttttctccaggatccatctggattctgcagatgaggctggcaaattaaatggaactatgatagggaccatcttactgtatctgtcagat

SEQ ID NO: 3504 - DNA, 1446 bp, Homo sapiens
ggattgcgcggctgatgtttagaacgcctagtcaagccaaccggctcgctcttgtttcagcaaaccctgacttacgtctcctatttgacttgaggcggcacagtggccaagtcgattggccgtggcaagtgaccctccctgtggctgaagtgttctgaggactggcgagagaggcgcgccatgcttgccccctgctcaggttgggagcttggctgcttccgtctctgtctccgtcaggtccgactgtgggctggcgctgggcgctgggcttgctgggcttgccaagccaggccgtacagctcaggtgggagcgagcgctggcccggatcggagactgaggtccctccgcctggcccggggcgccgaactctgaaggagtggacactgcagggtcaaaaattgcatgttcaaacaaaaggaggcaaagtgatctgtctgggaacagtttatggaaatatagatattcatgcatcagataaaagtgctgtgaccatagataaactgcagggaagttctgttactgtatctaccgaagatggtttgctgaaagccaagtatctttatacagaatcatcatttctgtcttctgctgctggggatattacattaggaagtgttcatggtaatataacattacaaagcaagatgggtaacatcacagtagattcgtcttctggatgtctaaaagcctcaactaatcagggtgccatagatgtttatgtcagccaactggggaaagtggaattgaaatcccataaaggttctattattgtcaaggtcccatcttcacttcaagctcatttacagttatcagggaaagaggttgatgtgaactcagaagtccatgttcaggaaatggctgaagttcgtaaagatgatgttgtaacagtgactggactcatgaatcaagcaagcaaacgtgaaaaatggattaaggctgatgccccaaaaggcactgtaagttttagaaggcaaagttggtttcagtccctgaaactgcaggactaaaactgatttgagttggatttatgatttttaacaatgattcgcagatctgtgactacaaaaatgtaaatcccaccattcatataaaggttgaaaacaacaaattgagaatgaatactggtgaactgttttgggaggctttttcaaaatttgtgctttgctattgtattcattttctactgctctgtaacaaattaccacaaatttagcagcataaaataatactcatttacagctatgtctaggttctccgctcagggaatcacaaggctagaaatcaagattttggccaggctgagttctcatctggagtctctgggaagaaatctacttccaacttcattcagattattgggaaaatccagttccttgtgactggatgactgaggtctccattttcttgctggctgtcagccagcaatcactctaagcttctagagg

SEQ ID NO: 3505 - DNA, 1179 bp, Homo sapiens
atgcttgccccctgctcaggttgggagcttggctgcttccgtctctgtctccgtcaggtccgactgtgggctggcgctgggcgctgggcttgctgggcttgccaagccaggccgtacagctcaggtgggagcgagcgctggcccggatcggagactgaggtccctccgcctggcccggggcgccgaactctgaaggagtggacactgcaggtgagcccgtttggtcggctgcgggcgcggctcccgtgccacctggccgtgaggcccctggaccccctcacctacccggatggcgaccgcgtgctggtcgcggtgtgcggcgtggagggcggcgtgcggggcctggacggcctgcaggtgaagtacgacgaggatctggaggagatggccattgtgtctgatactatccacccccaggcgtccgtggaggtgaacgcgcccctgaagtttggtttagatatcaagtcatcagggtctggctgtgtaaaagttcaaagtattgagggtgataattgcaaaattgaaacagagcatgggactagtatcttgcagtctgttaagggtcaaaaattgcatgttcaaacaaaaggaggcaaagtgatctgtctgggaacagtttatggaaatatagatattcatgcatcagataaaagtgctgtgaccatagataaactgcagggaagttctgttactgtatctaccgaagatggtttgctgaaagccaagtatctttatacagaatcatcatttctgtcttctgctgctggggatattacattaggaagtgttcatggtaatataacattacaaagcaagatgggtaacatcacagtagattcgtcttctggatgtctaaaagcctcaactaatcagggtgccatagatgtttatgtcagccaactggggaaagtggaattgaaatcccataaaggttctattattgtcaaggtcccatcttcacttcaagctcatttacagttatcagggaaagaggttgatgtgaactcagaagtccatgttcaggaaatggctgaagttcgtaaagatgatgttgtaacagtgactggactcatgaatcaagcaagcaaacgtgaaaaatggattaaggctgatgccccaaaaggcactgtaagttttagaaggcaaagttggtttcagtccctgaaactgcaggactaa

SEQ ID NO: 3506 - DNA, 1030 bp, Homo sapiens
aaatcccaacttgcccctggggattgcgcggctgatgtttagaacgcctagtcaagccaaccggctcgctcttgtttcagcaaaccctgacttacgtctcctatttgacttgaggcggcacagtggccaagtcgattggccgtggcaagtgaccctccctgtggctgaaggagtggacactgcaggtttagatatcaagtcatcagggtctggctgtgtaaaagttcaaagtattgagggtgataattgcaaaattgaaacagagcatgggactagtatcttgcagtctgttaagggtcaaaaattgcatgttcaaacaaaaggaggcaaagtgatctgtctgggaacagtttatggaaatatagatattcatgcatcagataaaagtgctgtgaccatagataaactgcagggaagttctgttactgtatctaccgaagatggtttgctgaaagccaagtatctttatacagaatcatcatttctgtcttctgctgctggggatattacattaggaagtgttcatggtaatataacattacaaagcaagatgggtaacatcacagtagattcgtcttctggatgtctaaaagcctcaactaatcagggtgccatagatgtttatgtcagccaactggggaaagtggaattgaaatcccataaaggttctattattgtcaaggtcccatcttcacttcaagctcatttacagttatcagggaaagaggttgatgtgaactcagaagtccatgttcaggaaatggctgaagttcgtaaagatgatgttgtaacagtgactggactcatgaatcaagcaagcaaacgtgaaaaatggattaaggctgatgccccaaaaggcactgaatggagcagaagtcatattcttctgagccaggcctcaagatgccttgcagcttctacctttagcccttagcctcttggaatgtgttactgcccttgaagcagctcagctagcttgctggaggatgagaccgcatgaagcaggaggaagctgtcccagctgggtccc

SEQ ID NO: 3507 - DNA, 7127 bp, Homo sapiens
atgttcttcaaaatgaaaaatgagatagacaatgaccctgaatcagaaaaatgcatcaaggattccaccatcatgagaagagagccccaaaatatccttagtcctttgatgctccctaaccttgagatcccattctcagtaaaggatatcatctctaggattgagcgcgcacagctccatcgagccagagaggacattgatatgcagctgagtgaaataatgaacaatgtgcatcggataatgactcgctatactcttgtttttaactcgtcctctgaaaggaatgtctcccttacagaacataagaaaaaacagagaaccaattttcttgagaaaatggctacttacgctaagactattgaaataagagaaaagactcttgccaacattctggcctggttggaagaatggaatgatgttttgtctgagatgactctaatggatgttgatgaacaccaccactggatagcacaaatggagttgttaccggacacgttaaaagctattgagaacaatgtcaagatactaagcagatttagtacatctttcctcgacgaaaagaagaaacaaaagaaaaaaatattatctagaggtactctatggaaatcttggaaagaaagagttataaaacgaccttcaacagcccgtgctttaagaccagatcagatgattagtgatcaacttgcaacaaatacaaaggtttcagaaatccaaggtatgctacaggaactcataggcaccacaatgttcagtacattggaaaacaatgctattaaatatatatcatcaacaatagtaaacctttctacagctttgagtatgctaaatgatgaattaaaatgtgttaacttccaaagttccactgtgtatgcacatgagacaagtgaagcagaaaaggagctctctctgaagataatacgagatctcagtaacgaaaatgaaatgcttcagcagaaacttcaagatgcagaagaaaaatgtgaacaacttattcgatccaaaattgttatagaacaactatatgcaaaattgtccacatcatcaaccttgaaagtgttacctggaccttctccacagtcatccagggcgataatcaaagttggtgatactgaggacaatatggacaatattttagacaaggaacttgaaaatattgtagatgaagtccaaagaaaagagaccaaggactctgggataaaatgggactccactatttcatatacagcccaagctgaaagaactccagatttaactgaactacgacagcaacctgttgcttctgaagatatttccgaagacagcactaaagataacgtatcattgaagaaaggtgatttctatcaggaagatgagactgatgagtatcaatcatggaaaagaagccacaaaaaagccacatatgtatatgagacctctggaccaaatctgagtgataataaaagtggacagaaagtctcagaggccaaacctagtcaatactatgagctacaagtactgaaaaagaaaagaaaagaaatgaaatccttttctgaagataaatcaaagtcacccactgaagcaaaaagaaaacatctctctttaactgaaacaaagagccaaggtggcaaaagtggaacaagtatgatgatgttggagcaatttaggaaggtcaaacgtgaatctccatttgacaaacgtccaactgcagcagagattaaagtggaacccaccactgagtcattggacaaagagggcaaaggtgaaattagaagcctagtggagccactcagtatgatccaatttgatgatactgctgagccacagaaaggaaaaataaaaggaaagaaacaccatatctcttcaggaactatcacaagcaaagaagaaaaaactgaagagaaggaagagttgaccaaacaagtcaagtctcatcaacttgttaaatcactctcaagagtggctaaagagacttcagaatctaccagagttctagaaagtccagatggcaaaagtgaacagagtaacctcgaagaatttcaggaagccataatggctttcctaaaacagaaaattgataacataggaaaggcttttgacaaaaagactgttccgaaggaagaggagttattaaaaagagcagaagctgaaaaattaggaatcataaaggcaaaaatggaggaatatttccaaaaagtggctgaaactgtgactaaaatcttgagaaaatacaaagatacaaaaaaggaagaacaagttggagagaaacctataaaacaaaaaaaggtagtctcatttatgccaggattgcattttcagaagtcaccaattagtgcaaaatctgaaagcagtaccctcctctcatatgagagcacagatccagtaattaacaatttaatacaaatgatcttggctgaaatagaaagtgaaagagatattccaacagtctcaacagtacagaaagaccacaaggagaaggaaaaacaaaggcaggagcaatatttgcaagagggtcaagaacaaatgtctggcatgagtctcaaacagcagttgctgggagaaagaaatctcttgaaggagcactatgagaagataagtgagaattgggaagaaaaaaaggcatggctccagatgaaggagggaaagcaagaacaacagagccagaaacagtggcaggaagaagagatgtggaaggaagagcaaaaacaggcaactccaaagcaggctgagcaagaggaaaagcaaaagcaaagaggacaggaggaagaagagcttccaaagtcaagcctgcagcggctggaagaagggacccaaaaaatgaaaacacaagggttgctcttggaaaaggagaatggacagatgaggcagattcagaaggaagcgaaacatttggggccacacaggagaagggagaaagggaaggaaaagcagaagccagagagagggctagaggacctcgaaaggcagatcaaaacaaaggatcagatgcagatgaaggaaacacaacctaaagagctagaaaaaatggtcatccaaactccaatgacattatctcccaggtggaagagtgtattgaaagatgtacagcggtcatatgaaggaaaagagtttcagaggaatctgaagacattagagaaccttcctgatgaaaaggagcccatatcaatcacacctcccccctccctacaatactccctgcctggagctcttcctatttctggccagcctctcactaaatgcattcatctcacacctcagcaggcccaggaagtggggatcacactcactcctcagcaggcccaggctcaggggatcacgctcacccttcagcaggcccaggaactagggatccctctcacccctcagcaggcccaggccctggagatccttttcacccctcagcaggcgcaggccctggggatccctctcacccctcagcagacccaggttcaagggatcactctcacccctcagcaggaccaggccccggggatctctctcaccactcagcaggctcagaaactagggatccctcttacccctcagcaggcccaggccctggggatccctctcacccctcagcaggctcaggaattggggatccctctcacccctcagcaggcccaggccctgagggtctctctcacccctcagcaggctcaggaattggggatccctctcacccctcagcaggcccaggccctggggatcactctaacccttcagcaggcccagcaattggggatccctctcacccctcagcaggcgcaggctctcggaatcactctcacccctaagcaggttcaggaactggggatccctcttactcctcagcaggcccaggccctggggatcactctcacccctaagcaggctcaggaattggggatccctctcaaccctcagcaggcccagaccctggggatccctctcacccctaagcaggcacaggctctggggatccctttcacccctcagcaggcgcaggccctggggatccctctcacccctcagcaggcgcagactcaggagatcactctcacccctcagcaggcccaggccttggggatgcctctcaccactcagcaggctcaggaactggggatccctctcacccctcagcacgctcaggccttggggatgcctctcaccactcagcaggctcaggaactggggatccctctcacccctcagcaggctcaggccttggggatgcctctcaccactcagcaggctcaggaactggggatccctctcacccctcagcaggctcaggaattggggatccctttcacccctcagcaggcacaggctcaggagatcactctcacccctcagcaggcccaggccctggggatgcctctcaccgctcagcaggctcaggagctggggatcactctcacccctcagcaggctcaggaattggggatccctctcacccctcagcaggcccaggccctggggatccctctcatccctccgcaggctcaggaattggggatccctctcacccctcagcaggcccaggccctggggatccttctcatccctccgcaggctcaggaattggggatccctctcacccctcagcaggcccaggccctggggatccctctgatccctccgcaggctcaggaattggggatccctctcacccctcagcaggtccaggccctggggatccctctcatccctccgcaggctcaggaattggagatccctctcacccctcagcaggcccaggccctggggatccctctcacccctcagcaggcgcaggaactggggatccctctcacccctcagcaggcgcaggaactggggatccctctcacccctcagcaggcgcaggctcaggggatccctctcacccctcagcaggcccaggctctggggatctctctcacccctcagcaggcgcaggctcaggggatcactctcacccctcagcaggcccaggcactgggagtccccatcaccccagtaaatgcctgggtgtcagctgtcactcttacctctgagcaaacccacgctttggagtcccctatgaacttagaacaggctcaagaacagttattgaagttaggggttcctctcaccttagataaagcccataccttgggatcgcccctcacccttaagcaagtccagtggtcccatagaccatttcagaaatcgaaggcttctctccccactgggcaatccatcatatcaagattgtctccaagtcttaggctgtccctggcatcatcagctcctactgctgagaagtcctctatattcggggtctcttctactcctttgcagatatcaagggttcccctcaaccaaggcccctttgcccctgggaagcccctagaaatggggattctttctgagcctgggaagcttggggcaccacagactcttcgttcctctggacagaccctggtatacggaggtcaatccacttctgcgcagttcccggcaccacaggcccctccctcccctgggcagctcccaatatctcgggcccctcccactccagggcagccctttatagctggagttccacccacttctggacagattccaagtctctgggctcctctttctcctgggcagcccttagttcctgaagcctcttccatccctggggacctcctggaatctggacccttaaccttctctgagcagctccaggaattccagcctcctgccactgctgagcaatctccctatctgcaggctccttctacccctgggcagcatctggcaacatggacccttcctgggcgagcttcttcattatggatccctcccacctctagacatcctcccacactatggccgtccccagcccctggaaagccccagaaaagttggtccccttctgttgctaagaaaagattggcaattatttcttctctgaaatctaaatcagtattgatccatcctagtgctccagatttcaaggtagctcaagttcctttcaccactaagaagttccaaatgtcggaggtctctgacacttccgaagaaacccagatacttcgagacacttttgctatagaatcatttagaacatttcagtcccatttcaccaaatataggacaccagtataccaaaccccttacactgatgaaagggcccttctcactctcatgaagccaacaacatcaccatcttctctcactactctactcagaacatcacagatttcacctttggaatggtaccagaaatcccgattccctcctatagacaagccctggatactgagttcagtttcagataccaagaaacccaaagtaatggtgcccccttcctctcctcaagaacttgaagaaaagaggtattttgttgatgtggaggctcagaagaagaacctgatactattaaatcaggctataaaaacttgtggactcccttcacagctacacacaatggctaggactctcataattgagatacttcatatggacacagttcagttgggatacttattccgcaagtacattgcctataggctgatccagcatgccaggaacaacataatgaaacgactaaaagccatccaaaatactgggaaaggctatgaggccaggaacctccacatgatgctgagcagacttgatgactacgggaaaaaggtgatgcaggtctggactgagaagcagaagtctctagggcagaaacggaatcagtgcctgaagaaaatgatacacgtattcaaccagctcaaaaagatacatgaattgaatcttagtcaacctatccccttaatcatcgaagaaaagcagatacctgcctctaccacatttgttcaaaagccattcttaaaattactaatggaagaggacagaacctctgacatatgcaagaaatttaggcaacaagaggaccagacagaggccatctggaatgttgatctgtccacttcaagctacccaatagcagagaagacatctatgcattcactctgggcccagctgggtgggtacccagatattcccaggctgcttcagttagaagtgcagtctaccttccgaaaatctcttgcatccctccaatcacgggttaagaagattcccaaatgactgtaaaattaaatacaagcatgttgaaagtacatttcagtatctttcagtaaaatgcctattttgttctc

SEQ ID NO: 3508 - DNA, 2116 bp, Homo sapiens
ttcaccactaagaagttccaaatgtcggaggtctctgacacttccgaagaaacccagatacttcgagacacttttgctatagaatcatttagaacatttcagtcccatttcaccaaatataggacaccagtataccaaaccccttacactgatgaaagggcccttctcactctcatgaagccaacaacatcaccatcttctctcactactctactcagaacatcacagatttcacctttggaatggtaccagaaatcccgattccctcctatagacaagccctggatactgagttcagtttcagataccaagaaacccaaagtaatggtgcccccttcctctcctcaagaacttgaagaaaagaggtattttgttgatgtggaggctcagaagaagaacctgatactattaaatcaggctataaaaacttgtggactcccttcacagctacacacaatggctaggactctcataattgagatacttcatatggacacagttcagttgggatacttattccgcaagtacattgcctataggctgatccagcatgccaggaacaacataatgaaacgactaaaagccatccaaaatactgggaaaggctatgaggccaggaacctccacatgatgctgagcagacttgatgactacgggaaaaaggtgatgcaggtctggactgagaagcagaagtctctagggcagaaacggaatcagtgcctgaagaaaatgatacacgtattcaaccagctcaaaaagatacatgaattgaatcttagtcaacctatccccttaatcatcgaagaaaagcagatacctgcctctaccacatttgttcaaaagccattcttaaaattactaatggaagaggacagaacctctgacatatgcaagaaatttaggcaacaagaggaccagacagaggccatctggaatgttgatctgtccacttcaagctacccaatagcagagaagacatctatgcattcactctgggcccagctgggtgggtacccagatattcccaggctgcttcagttagaagtgcagtctaccttccgaaaatctcttgcatccctccaatcacgttcttcaggttgaacatcttcatttctgggctactactatgaccactcaagaaagagtatcttctgctctacattactggaaacacaaaggttcaacaaccctggggtaggctgagtcatgaaagggacatcattatgggcccctaacatgatggcaaagtggcacagtctgcctttcccagtctaaacccgaagatgcctcagaaggaagaaataaatgagtataatgaaggaaactaaaaaccagcagacacccctgaagaattagaaggtggttatgattggtaatgaagggaaatcataatgttaccagtagagggttgtgactgcaagttgtccaggttcttggcattttgaacaaagaattgggcaaaatgcccagcaaagcaaataaagaatgaagcaacagaagaacgaaagcagggatttattgagaacaaaagtacactccacagtgcaggagtggcccgagcagctgctcaaggacctggatacagaatcttcttgggtccaaataccctctagaagttgcctattgatcacttcatgctcacctcatgtaaataaagcggtagcctgcaatcagtctgattggttgcagcaaaaagcaaccaatcagaggctagggtgaagttacaaacttatactcctatttttttttttttttgagacagagtttcgctcttgttgcccaggctggagtgccatggtgcgatctcggttcttgaaattctgcctcccaggttcaagcgattctcctgcctcagcttcccgagtagctgggtttacaggcatgcaccaccatgcctggctaattttgtatttttagtagagacagtgtttctccatgttggtcaggcggtttcgaactcccagcctgaggtgatccacctgccttgccgtcccaaagtgctgggattacaggcatgagccaccacgccaggtctcaaagttacacttttatgcaaacaaagactggcctgcaatcagtctgattcattgagggcagccaatttcccatctgcctc

SEQ ID NO: 3509 - DNA, 2944 bp, Homo sapiens
agttggaacctggtgtttggcagttaccagaggagctgtgcctgggcagagggtacccaggagacaccctggtgcccttaacctccaaagcaggcaacattgtgtgtccaggcctgtggaccagaaacacaggatgttttgtgactgacagagtgatccaaaatggagaaggatgaccccccacagttggtgactcccacatcagtgaaagccatcatcctgaggattgaggctgcccagctaactcgggctcaagaggatatttctacccagctctcagacattttggacaatgtcaattgtgtcatcaaccgcttccaggaagaattaggatatgatttaaaagaaaatgccaaatctcagcagagagatccaaagggcaagaagagattcatcttgctggaaaaaattgcctccttctccaaagatgctatgatgaaggagaagcacctgtatgacattctccgctggctgggtgactggggtgacactctgacctatgagattgggcccaggaagagtgaagaggaagcagcagctctggacgaatggattgaagtgacggagaaagtgttaccgctgtccctcattgccaccaaaagaggcatcgagtcactcactgccctttgctccactctcattgaaggacaaaagaaaaggtcacaagtgtccaaacgcaccttctggcagggctggcagggaagaagcccacagacatctccatcccatcctcagccactaagcccagaacagatgctccaggaccagcataccatgaacacgaaggcctcggaggtgacgtccatgctgcaggagctcctggactctaccatgttcagcaagggggaggtcagggccatcaggtacatggccactgtggtggagaacctcaacaaggccttgatcctccaacacaaggagaacaggagcctggagaccaaatacaggcacctgcaaatgcaggcgaccaaagagctcagcagccagaggctgcacttccagcagttcatggaggtccttgagagcaggagggatgctctgctgaagcaggtagagatcttagggggaaggtaccatgaccttctcctgatgaagcaggccttggagttccagctgaagaaggctcagaatgctacaggtcaggcagaagacctggctgaggtttctgttgactccccaggtccctctgagagagagaccctcccaaggaaagaaacagtcatggaggaaagccaacaggaaccgatgaaggaggagcagttgttctcgccacttcccccaagtcccatggccatgatacgggacagtggtgctatagctgcagggcaccagccactttccaccatgactgtgcgctcgagggtcgcagatgtgttcggcagcaaggacactgagagccttgagcctgtgcttttacccttagtagatcgcaggtttcctaagaaatgggaaagaccggtggcagaaagcttaggccacaaagacaaagaccaggaggactacttccagaagggaggactccaaattaagttccactgtagcaagcagctgtctctagagagctccaggcaggtgacctctgagagccaagaggagccctgggaggaggaattcggccgggagatgcggaggcagctgtggctggaggaggaggagatgtggcagcagcggcagaagaagtgggccctgctggagcaggagcatcaggagaagctgcggcagtggaatctggaagacctggccagggagcaacagcggagatgggtccagctagaaaaggagcaggagagcccacggagagagccagagcagctaggggaggatgtggagaggaggatcttcacacccaccagtcgatggagggacttggagaaggcagagctatcattagtgcctgccccaagccggacccaatctgctcaccaaagcaggaggccacacttgcccatgtctcctagtacccagcagcctgccctgggaaagcagagacctatgagttcagtggagtttacctacagaccacggacccgccgagttcccacaaagcccaagaaatctgcctcctttcctgtcactgggacatccatccgaaggctgacctggccctctttgcagatatcccctgcaaatattaagaagaaggtgtaccacatggacatggaggcccagaggaagaacctgcagctcctgagtgaggagtctgagttgaggctgccccactacctgcgcagcaaagcactggagctcaccaccaccaccatggagctgggcgcgctcaggctgcagtacctgtgccataagtacatcttctatagacgcctccagagcctccggcaagaagcgatcaaccatgtacaaatcatgaaagaaacggaggcttcctacaaggcccagaacctctacatcttcctggaaaacattgaccgcctgcagagtctcaggctgcaggcctggacggacaagcagaaggggctggaggagaagcaccgagagtgcctgagcagcatggtgaccatgttccccaagctccagctggagtggaacgttcacctgaacatccctgaggtcacctcgccaaagccaaagaaatgcaagttgcctgcagcctcaccccggcacatccgccccagtggccccacctacaagcagccctttctgtctaggcaccgggcatgtgtgcccctgcagatggcccgccaacaggggaagcagatggaggctgtctggaagaccgaggtggcctcctccagttacgcaatagaaaaaaagacccctgccagccttccccgggaccagctgaggggacacccagatattccccggctgttgacactggacgtgtagtcctcctgccacaaaagcctgaacttcctgaaggcccagtaaggtgcgaggctgatggtcaatgtggattctccccaataaatctctctccaggctttaa

SEQ ID NO: 3510 - DNA, 1901 bp, Homo sapiens
gggcaccagccactttccaccatgactgtgcgctcgagggtcgcagatgtgttcggcagcaaggacactgagagccttgagcctgtgcttttacccttagtagatcgcaggtttcctaagaaatgggaaagaccggtggcagaaagcttaggccacaaagacaaagaccaggaggactacttccagaagggaggactccaaattaagttccactgtagcaagcagctgtctctagagagctccaggcaggtgacctctgagagccaagaggagccctgggaggaggaattcggccgggagatgcggaggcagctgtggctggaggaggaggagatgtggcagcagcggcagaagaagtgggccctgctggagcaggagcatcaggagaagctgcggcagtggaatctggaagacctggccagggagcaacagcggagatgggtccagctagaaaaggagcaggagagcccacggagagagccagagcagctaggggaggatgtggagaggaggatcttcacacccaccagtcgatggagggacttggagaaggcagagctatcattagtgcctgccccaagccggacccaatctgctcaccaaagcaggaggccacacttgcccatgtctcctagtacccagcagcctgccctgggaaagcagagacctatgagttcagtggagtttacctacagaccacggacccgccgagttcccacaaagcccaagaaatctgcctcctttcctgtcactgggacatccatccgaaggctgacctggccctctttgcagatatcccctgcaaatattaagaagaaggtgtaccacatggacatggaggcccagaggaagaacctgcagctcctgagtgaggagtctgagttgaggctgccccactacctgcgcagcaaagcactggagctcaccaccaccaccatggagctgggcgcgctcaggctgcagtacctgtgccataagtacatcttctatagacgcctccagagcctccggcaagaagcgatcaaccatgtacaaatcatgaaagaaacggaggcttcctacaaggcccagaacctctacatcttcctggaaaacattgaccgcctgcagagtctcaggctgcaggcctggacggacaagcagaaggggctggaggagaagcaccgagagtgcctgagcagcatggtgaccatgttccccaagctccagctggagtggaacgttcacctgaacatccctgaggtcacctcgccaaagccaaagaaatgcaagttgcctgcagcctcaccccggcacatccgccccagtggccccacctacaagcagccctttctgtctaggcaccgggcatgtgtgcccctgcagatggcccgccaacaggggaagcagatggaggctgtctggaagaccgaggtggcctcctccagttacgcaatagaaaaaaagacccctgccagccttccccgggaccagctgaggggacacccagatattccccggctgttgacactggacgtgtagtcctcctgccacaaaagcctgaacttcctgaaggcccagtaagcgcctcagcgaaccaaaggaaggaatgccaggaacctacaaatgaatccgcttagcttgttcaaaaaaagtcaagcgagtcactccctggaacccaaataagccagaaggatcaagacagccccagtctccactgcatccctcagccagtgattctcaaccttctgagggacggaaacccacagagaacttggtcaaaatgcaggttcccagctggtgcttttaaagaaaccctctgggggttgctgagtactcctagaactttgagaaacactgcttccctcctgcagtccccaaactctacattttaataaaatagaggttggtttattttaaaa

SEQ ID NO: 3511 - DNA, 3088 bp, Homo sapiens
gtgtttggcagttaccagaggagctgtgcctgggcagagggtacccaggagacaccctggtgcccttaacctccaaagcaggcaacattgtgtgtccaggcctgtggaccagaaacacaggatgttttgtgactgacagagtgatccaaaatggagaaggatgaccccccacagttggtgactcccacatcagtgaaagccatcatcctgaggattgaggctgcccagctaactcgggctcaagaggtagcccctgagatgaaggaatcactcttacattgggatctgatgcggagactgggggctgatcccaggtttgagtgagattccagctctgggtcctcagaggccctgggatattcagcaacctgggtctgcagacagattagtataaattatctctctcctaaacttggcatatacagggatatttctacccagctctcagacattttggacaatgtcaattgtgtcatcaaccgcttccaggaagaattaggatatgatttaaaagaaaatgccaaatctcagcagagagatccaaagggcaagaagagattcatcttgctggaaaaaattgcctccttctccaaagatgctatgatgaaggagaagcacctgtatgacattctccgctggctgggtgactggggtgacactctgacctatgagattgggcccaggaagagtgaagaggaagcagcagctctggacgaatggattgaagtgacggagaaagtgttaccgctgtccctcattgccaccaaaagaggcatcgagtcactcactgccctttgctccactctcattgaaggacaaaagaaaaggtcacaagtgtccaaacgcaccttctggcagggctggcagggaagaagcccacagacatctccatcccatcctcagccactaagcccagaacagatgctccaggaccagcataccatgaacacgaaggcctcggaggtgacgtccatgctgcaggagctcctggactctaccatgttcagcaagggggaggtcagggccatcaggtacatggccactgtggtggagaacctcaacaaggccttgatcctccaacacaaggagaacaggagcctggagaccaaatacaggcacctgcaaatgcaggcgaccaaagagctcagcagccagaggctgcacttccagcagttcatggaggtccttgagagcaggagggatgctctgctgaagcaggtagagatcttagggggaaggtaccatgaccttctcctgatgaagcaggccttggagttccagctgaagaaggctcagaatgctacaggtcaggcagaagacctggctgaggtttctgttgactccccaggtccctctgagagagagaccctcccaaggaaagaaacagtcatggaggaaagccaacaggaaccgatgaaggaggagcagttgttctcgccacttcccccaagtcccatggccatgatacgggacagtggtgctatagctgcagggcaccagccactttccaccatgactgtgcgctcgagggtcgcagatgtgttcggcagcaaggacactgagagccttgagcctgtgcttttacccttagtagatcgcaggtttcctaagaaatgggaaagaccggtggcagaaagcttaggccacaaagacaaagaccaggaggactacttccagaagggaggactccaaattaagttccactgtagcaagcagctgtctctagagagctccaggcaggtgacctctgagagccaagaggagccctgggaggaggaattcggccgggagatgcggaggcagctgtggctggaggaggaggagatgtggcagcagcggcagaagaagtgggccctgctggagcaggagcatcaggagaagctgcggcagtggaatctggaagacctggccagggagcaacagcggagatgggtccagctagaaaaggagcaggagagcccacggagagagccagagcagctaggggaggatgtggagaggaggatcttcacacccaccagtcgatggagggacttggagaaggcagagctatcattagtgcctgccccaagccggacccaatctgctcaccaaagcaggaggccacacttgcccatgtctcctagtacccagcagcctgccctgggaaagcagagacctatgagttcagtggagtttacctacagaccacggacccgccgagttcccacaaagcccaagaaatctgcctcctttcctgtcactgggacatccatccgaaggctgacctggccctctttgcagatatcccctgcaaatattaagaagaaggtgtaccacatggacatggaggcccagaggaagaacctgcagctcctgagtgaggagtctgagttgaggctgccccactacctgcgcagcaaagcactggagctcaccaccaccaccatggagctgggcgcgctcaggctgcagtacctgtgccataagtacatcttctatagacgcctccagagcctccggcaagaagcgatcaaccatgtacaaatcatgaaagaaacggaggcttcctacaaggcccagaacctctacatcttcctggaaaacattgaccgcctgcagagtctcaggctgcaggcctggacggacaagcagaaggggctggaggagaagcaccgagagtgcctgagcagcatggtgaccatgttccccaagctccagctggagtggaacgttcacctgaacatccctgaggtcacctcgccaaagccaaagaaatgcaagttgcctgcagcctcaccccggcacatccgccccagtggccccacctacaagcagccctttctgtctaggcaccgggcatgtgtgcccctgcagatggcccggctcttggcactgtgcttaaggggcctggtggctgaacttgctctggtgatggaggactttgaccttctgcacgtcctctagcgagctctctggcaagcatgcagagtgtctgacattcttctcctgctttggtaacaatttcatcttcttaaaggcaaagaaagcctgcacgggccaagctgtgaagccaagagggttggaagacaaatatatatgtgtgtgt

SEQ ID NO: 3512 - DNA, 621 bp, Homo sapiens
agtgcctgagcagcatggtgaccatgttccccaagctccagctggagtggaacgttcacctgaacatccctgaggtcacctcgccaaagccaaagaaatgcaagttgcctgcagcctcaccccggcacatccgccccagtggccccacctacaagcagccctttctgtctaggcaccgggcatgtgtgcccctgcagatggcccgccaacaggggaagcagatggaggctgtctggaagaccgaggtggcctcctccagttacgcaatagaaaaaaagacccctgccagccttccccgggaccagctgaggggacacccagatattccccggctgttgacactggacgtgtagtcctcctgccacaaaagcctgaacttcctgaaggcccagtaaggctcttggcactgtgcttaaggggcctggtggctgaacttgctctggtgatggaggactttgaccttctgcacgtcctctagcgagctctctggcaagcatgcagagtgtctgacattcttctcctgctttggtaacaatttcatcttcttaaaggcaaagaaagcctgcacgggccaagctgtgaagccaagagggttggaagacaaatatatatgtgtgtgta

SEQ ID NO: 3513 - DNA, 3397 bp, Homo sapiens; identical to SEQ ID NO: 2384

SEQ ID NO: 3514 - DNA, 2822 bp, Homo sapiens
ctggtttatcaggggatccccaaagaaagcaaggggaccaaggccgggactgctggggtgaaggtccgggaggctgagcacaggccatggaaaggaatgacatcatcaacttcaaggctttggagaaagagctgcaggctgcactcactgctgatgagaagtacaaacgggagaatgctgccaagttacgggctccaggaggaggagaggctcctgcaggagctgctggagctgtaccaggttgactgatgcggcaagctaccctcagaggtcccagtggtcactggaggcagttttttggttgttgtcttgggggttctgcaggaccataataagaaacccacacctggttcccttctcaacttggaattttcagagcaaaaacaggaatcaagtcttccccacttctccagtccctcagtgtctcgctgttttgaactgtgtgtatccatggacagtcaagagctcaggaagttgagagcggttttgtttcccacccttagagtctgccaagcctctagcccactggccttgagagatgagtgtgtgcccaaccaaatgctggctataccagttacagcctccactcataaaagggaaaaagcaaaatctttatggtaaacaaacactgatctccacagctcttaacaagaatgtttatagccccaaaccaatgaatggacatgtaatcaacaaatgatcaaatactacatcatttgaggtgttgaattttcccctagagactcagttcttgtgcaggttgggcctgggaaagtcccaagccatcagctcaggtccagccagcctcccggatggccagatatgcaggagggtgggtttccttcatcccccaggttgatgaaagacttttccaccaggctggcagggcagggcctggagcactgaggcagagatctccctgcccgagcacctcggcccgcccttctcattccggtttcctttgacccattcttgggtgagcgccagtgttctagaaaggggagtaaaggccaggttctagaatggctttccccccccaccctgagatcaggtctggaatgttagaagggcatcttgtacatccactgggaataaattgccttgcacttggcggcttcctctgcagattgttgctgcttttcctggctgcataatcctttcctcatctagaggcttccgcttagcagagctttctaggagccctatgagcctttaatgccctggttttgccctgcccctctgacccctgcctccttcaggtatgcacctggccctcaccactgtgctcctgtgggcatgggggctccaggcctttgaaattgtggagaaggaaaacatttttcagaggaccccctgccctgctttcctgatgtttgaaaatgcagcctacctggccgacatgagctttgagcttccctgtcactgcaaacccgaagaggtgccagctgtagtctggttctaccaaaagcacctaggtagcagccacaccaaagtgctgacggactttgatgggcgggtgctgacggaggcagcccaggtacgtgtgggcagcgacatgctgacccgcttcagcatccgcatgttcagcttgttggttttcagggctcagtctgaggactcaggcctgtacttctgcggcacccgcaagggggactacttttacgcctacgatgtggacatccagaacagtgagggaatggtggccactttccaggacaagggccaggagccctttgcagatgaatactatgggcacctccatgtcttcaccaccttctgggaatggaccccctgtgaccgctgcggagtgcgtggggagcagtggcgcatcggcctctgctacctgcagagcccagacctctccccacgctacctcaaggccgtgcccgatgtggtgtcttgtggctcaagggctgtgccaaggaagctgcggaccaaggccagggaccacacgcctgaggtgctggttcggagctgcttagtaccctgtgagaagacaaagaccatccgggagggcgtgctggccatcattaactatgtgtccaaagtgggcagccggccctgggtgccccaggtgcccattcagttccaccagcagagactgggccatggactcatcatctcctgtcctggggcccggccagagcatgcagtggcctgggacaaagaccgccagcacctctaccgcacacagtacctgaagggtgtcaacaggtccatgagggtgttcattgaccacggcaaccagctccacatccgcttcacccagctggatgaccggggcatctactattgctggaggcagggtgtgctagttgctggcttccggctgggtgtgacatctcatgggcactacccagcctcgttctcagatcctgagactcgctcggctgtggagctcaccctgataggctacctgctcatcacagcagtctttgtcaccattcacttctgtcgttgctgctgctacttatttcactgttgtcccagcttctccccctaggagctctcttcagctctgaagaccagttgtccttcaatgtgtttgttaaatgataccagatgtctctgggtgggtaccctgggttgggacaggtggtaggaacatgtggacaaatctgttacagcctgctccccattttcatgggcaggtctgggacctgatctgagaagtggaggggcctgaggctggtgggagattggggactgagctcaggatggaagtagggcacatgtgtttcctgacttcacatttaggtcagagaaggaaagtgtgaactcagatttatccagtggtaaacactgatcagtgttgaatcatg

SEQ ID NO: 3515 - DNA, 2733 bp, Homo sapiens
atactgcgccggacagacccagttgcctggtgctgcggcccggcgtgggcctcgtgggcagagccagagccagagccatggacagcctcttcgtggaggaggtggccgcctccttggtcagggagttcctcagcagaaagggcttaaagaagacatgtgtgaccatggaccaggaacgcccacgctctgacctcagcataaacaacagaaatgatcttcgaaaggttttgcatcttgaatttctctataaggagaacaaggcaaaggaaaatcctctaaaaacaagccttgaactcatcaccagatactttctggatcactttggaaatacggctaacaatttcactcaagataccccaatccctgcactctcagttccaaagaaaaataacaaagtgccatcaagatgctcagagactacactggtaaatatatatgacctttcagatgaagatgcaggatggagaacatcattgtcagaaacaagcaaagccagacatgacaatcttgatggagatgtacttggtaattttgtatcatctaaaaggcccccgcacaaaagtaagcccatgcagacggtcccgggtgaaactcctgtgttgacttctgcatgggagaagatagacaagcttcactcggagccttccttggatgtgaagaggatgggagagaattccaggccaaagtctggtctgattgtgcgaggcatgatgtctgggcccatcgccagctccccacaggattcttttcacagacactatctgagacggtcctcaccgtcaagcagctccacccaaccccaagaagagagccggaaggtccctgagctctttgtctgcacccaacaggacattctggcttcgagcaacagctccccctccaggacctccctgggtcagcttagtgaactgaccgtagaaaggcagaaaaccactgccagcagccctccccatctgcccagcaaacggctgcccccatgggacagggccaggccgagggatccctccgaggacaccccagcagtggacggcagcacagacacggacaggatgcccttgaagctctacttgcctggtggtaattccaggatgacccaggagaggctggaaagagcgttcaaacggcagggcagccagcccgcacctgtcaggaaaaatcagttgctgccgtctgacaaggtggatggtgagctgggtgccctgcggctcgaggatgtggaggatgagttgataagggaagaggtcatcctgtcgccagtcccatcagtgctcaagttgcagacagcatcaaaaccaattgacctctcagtagcaaaggaaataaagacccttctgtttggttccagcttttgctgtttcaatgaagaatggaaacttcagagtttttcctttagtaacacagcctcattaaaatacggcatagtgcagaacaagggtggtccttgcggagtcctggcagctgtccaaggctgtgtcctacagaaactcctgtttgaaggagatagcaaagccgactgtgctcagggactgcagccttcagatgcccaccggacccgctgcctcgtcctggccctcgcagacattgtgtggcgggcagggggccgagagagagccgttgttgcactggcttcgagaacacagcagttcagtccaacagggaaatacaaagcagatggagtcttagaaacacttacgcttcacagtttgacctgctatgaggacctggtgacttttcttcaacaaagcattcatcagtttgaagtgggcccctatggctgcatcctgctcaccctttctgccatcctgtccaggtctacagagctcatccgccaggactttgatgtccccaccagccacctgattggagcacatggctactgtacacaggaacttgtcaatctgctcctgactgggaaagctgtgtccaacgttttcaacgatgtggttgagctggattctggggatgggaacatcacacttctcagaggcattgctgcacgcagtgatattggcttcttatctctctttgagcattacaacatgtgccaggttggctgcttcctgaagaccccgaggttccccatctgggtggtttgcagtgagagccacttcagcatcctctttagcctgcagccggggctcctgcgtgactggaggactgagaggctctttgacttgtactactacgatggcctggccaaccagcaggagcagatccggctgaccattgacaccacccaaaccatctctgaggacacagacaacgaccttgtcccacccctcgagctctgcatcagaaccaagtggaagggggcatcagtgaactggaacggctcagaccccatcctgtgaccgttggatgtgggtaaaccctgtggtccaccactcatcacctcatcaccgaggatgacagctgaaccccaagcctctggggcaggtctcatgtaccccaacctgggtcagcatgactgcagaagcatccagagcctccctgccccttccatgaagggcccacccaagactgtgctggggacccagtgtgttgctgggtcccctcccagctgagctgtgactgctgagtactggaaggaggttgccagggtctctgctacctttgtctgcatccctcccttgctccctgctgggtggtccctcacccaggcctccaatgtggttggccctggggactcattacttctggtagctggctttctataaaaatgggtcaaaccca

SEQ ID NO: 3516 - DNA, 2609 bp, Homo sapiens
gagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgatctccttcttctccttgctttcggtgctctgtgtcatgcttagcatggctggctctgttctctcctgtaagaatgctcaactggcccgagacttccaacagtgctctctggaaggaaaggtctgtgtgtgctgtccctctgttcccctcctccggccctgtccagagtcggggcaggaactgaaagttgcccctaactccacctgtgatgaagcccgaggggccctcaagaacctgctcttcagcgtctgtgggctcaccatttgtgccgctataatctgtacactctctgctattgtctgctgcatccaaatcttctccctggacctcgtgcatacgcagctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgagctgaggcggcgggtcccccggggagggggccgcccagccgcagccccgcccacccgagccccgactcgtcgcttcagcgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttg

SEQ ID NO: 3517 - DNA, 3057 bp, Homo sapiens
gttaccatcgagaccggggctgtgtatgctcgaggtgcagggagctaatgtataaggagttaaatgaactcttgctgctgccaaatatgttgttatcactaactgcaccgctgctgtcattagtgctgctgccaacactgcaagccctgctgctgccagtgccaattctgctgatgccttgggctctccatgtcccagggtgattccatagacaagcagctgcttttagatttcacttgctcattacctgtagatcctttgccttaggactcaagcttaagcccatgaagcctgggatagaagacaattggaggctgcaaagttggctttcacagtgcaagcctttgattcccaatgggggactcaggatcaagacgatctaccctggtctcccggttgccaatattcagaagaagtattaacagaagacatgattctcttccttcttcaccttcttccagtaatacagttggtgtccacagttcctctccttccagcactaactcaagctcaggtagcacaggtaaacggaggagcatattccgtactccttccattagcttccaccataagaaggggagtgagcctaagcaagagcctaccaaccagaaccttagtatttcaaatggtgctcaacctggtcacagcaatatgcagaaactgagtttggaagaacatattaagaccaggggaagacattctgttggttttagtagttcacgaaataagaagataacaagatctttgacagaggattttgaaagggaaaaagagcactcaactaacaagaatgtctttataaattgtctaagttctggcaaaagtgaaggggatgattctggtttcacagaagaccaaactcgtcgttctgttaagcagtcaacaaggaagctactccctaaatctttttcatctcactataaattttctaagccagttctacagagccaatccatttcattggtacaacagtctgaattctcattggaagttacacagtaccaagagagagaacctgtattagtaagagcttcgccatcctgttctgtggatgtaacagaacgggcaggaagctctttacaatctcctttgctttctgctgatcttaccacagctcagacaccttcagaatttttagccttgactgaagattctgtgtctgaaatggatgcattttctaaaagtggaagcatggcatcccactgtgacaactttggccacaatgattctacctctcagatgtccctcaattctgctgctgttacaaagacaacaacagaacttacgggaactgttccctgtgcaattatgtctcctgggaaatataggttagagggtcaatgtagcactgaatctaattcattaccggaaacctctgctgctaatcagaaggaagtgttattacaaattgctgaactacctgctacaagtgtgagccactcagagagtaacctaccagcagatagtgaaagagaagaaaatatagggttacaaaatggtgaaacaatgctggggacaaactccccaaggaaacttggattttatgagcaacataaagcaatagcggaacatgtaaaagggatccatcctatttcagattcaaagataatacctacttctggtgatcatcatatttttaacaaaacatcacatggatatgaagcaaatcctgccaaagttcttgccagtagtctcagtccatttcgtgaaggaagatttatagagaggagactgcgatcctcgtcagaaggcactgcagggagtagcagaatgattttgaaaccgaaagatggaaatatagaagaagttaatagtttaagaaagcaaagagcaggttcttcatcttcaaaaatgaacagtttggatgttttgaataatttgggatcttgtgaactggatgaagatgatctaatgcttgatcttgaatttttagaggaacagagtcttcacccttctgtttgccgggaggactcatatcactctgtcgtctcatgtgccgcagtagttcttactcctatggaaccaatgatagaaatgaagaaaagagaagaaccagaatttcctgagccttccaaacagaatctttccctgaaattaacaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagagagtgcagacatgagtccagcaagcagtaccacgtcacttcctgttagtcctcttactgaagagccagtgcctttcaaggatataatgaaagatgaatgctcgatgctcaagctgcagctgaaagagaaggatgaactcatttcccaacttcaggaagagctgggaaaagtccggcatttacagaaggcttttgcttcaagagtagataaatccacacagactgaactactatgctatgatggtttaaacttgaaaagactagagacagtacaaggagggagagaggctacatatcgaaatcgaattgtgagccaaaatctcagcacaagggacagaaaagcaatacatactcccaccgaggaccgttttaggtattcggcagcggaccagacaagcccctacaaaaacaagacctgtcaactcccaagtctctgtttaagtaatttcctgaaggacaaggaactagcagaagttatcaaacattcaagaggaacttatgaaaccctcacttcagacgttacacagaacttacgggccaccgttgggcagagctctctgaagccaacagctaagacagaagggctctccacgttcttagagaaaccaaaggaccaagttgctacggcccgacagcattcgacctttacaggcaggtttggacagccacccagagggccaatctctttacacatgtacagcaggaagaatgtgtttctccaccacaatttacacagcactgagctgcaaactctaggccagcaggatgggtaa

SEQ ID NO: 3518 - DNA, 3927 bp, Homo sapiens
gttaccatcgagaccggggctgtgtatgctcgaggtgcagggagctaatgtataaggagttaaatgaactcttgctgctgccaaatatgttgttatcactaactgcaccgctgctgtcattagtgctgctgccaacactgcaagccctgctgctgccagtgccaattctgctgatgccttgggctctccatgtcccagggtgattccatagacaagcagctgcttttagatttcacttgctcattacctgtagatcctttgccttaggactcaagcttaagcccatgaagcctgggatagaagacaattggaggctgcaaagttggctttcacagtgcaagcctttgattcccaatgggggactcaggatcaagacgatctaccctggtctcccggttgccaatattcagaagaagtattaacagaagacatgattctcttccttcttcaccttcttccagtaatacagttggtgtccacagttcctctccttccagcactaactcaagctcaggtagcacaggtaaacggaggagcatattccgtactccttccattagcttccaccataagaaggggagtgagcctaagcaagagcctaccaaccagaaccttagtatttcaaatggtgctcaacctggtcacagcaatatgcagaaactgagtttggaagaacatattaagaccaggggaagacattctgttggttttagtagttcacgaaataagaagataacaagatctttgacagaggattttgaaagggaaaaagagcactcaactaacaagaatgtctttataaattgtctaagttctggcaaaagtgaaggggatgattctggtttcacagaagaccaaactcgtcgttctgttaagcagtcaacaaggaagctactccctaaatctttttcatctcactataaattttctaagccagttctacagagccaatccatttcattggtacaacagtctgaattctcattggaagttacacagtaccaagagagagaacctgtattagtaagagcttcgccatcctgttctgtggatgtaacagaacgggcaggaagctctttacaatctcctttgctttctgctgatcttaccacagctcagacaccttcagaatttttagccttgactgaagattctgtgtctgaaatggatgcattttctaaaagtggaagcatggcatcccactgtgacaactttggccacaatgattctacctctcagatgtccctcaattctgctgctgttacaaagacaacaacagaacttacgggaactgttccctgtgcaattatgtctcctgggaaatataggttagagggtcaatgtagcactgaatctaattcattaccggaaacctctgctgctaatcagaaggaagtgttattacaaattgctgaactacctgctacaagtgtgagccactcagagagtaacctaccagcagatagtgaaagagaagaaaatatagggttacaaaatggtgaaacaatgctggggacaaactccccaaggaaacttggattttatgagcaacataaagcaatagcggaacatgtaaaagggatccatcctatttcagattcaaagataatacctacttctggtgatcatcatatttttaacaaaacatcacatggatatgaagcaaatcctgccaaagttcttgccagtagtctcagtccatttcgtgaaggaagatttatagagaggagactgcgatcctcgtcagaaggcactgcagggagtagcagaatgattttgaaaccgaaagatggaaatatagaagaagttaatagtttaagaaagcaaagagcaggttcttcatcttcaaaaatgaacagtttggatgttttgaataatttgggatcttgtgaactggatgaagatgatctaatgcttgatcttgaatttttagaggaacagagtcttcacccttctgtttgccgggaggactcatatcactctgtcgtctcatgtgccgcagtagttcttactcctatggaaccaatgatagaaatgaagaaaagagaagaaccagaatttcctgagccttccaaacagaatctttccctgaaattaacaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagagagtgcagacatgagtccagcaagcagtaccacgtcacttcctgttagtcctcttactgaagagccagtgcctttcaagaccacataccctagggaattctgaaaacctgactaacatcaattgaagattggggttcaggaggcctagatgatccaccatgacttattcaaaagttgaagatgaaaggaaagaataaagactctttccatccagttctctagtctgaaaggaaaagaaataggcaaaggacagtaggcttttctatatcattatattcattcaaatgattctcttaaaataataatgaactaaggaggctctgtaagcaagacaaacggtcaggaggcctccttgctccaagaatactccctttttactttattaaaatggtttgtaaaggtaaactaaattgactaaagtatcaatatttccatatatgcgtgatcttttagagaccataaactgtcagtgtattaggctgttcttgcatggctataaagaaatacctgagactaggtgatttataagaaaaggggtataattggcccacagttctgcagactgtacaggaagcatagtagcatgtgcttctggggaggcctcaggaagcttccaatcgtggcggaaggcaaagggaagcaggcacattgcatggtgagaacagaaacaagaacaaggaagggtggctgggaggcgccacataattttaaattaccagatctcacaagaactcactatccggaagacagcacccagccatgagggatccaccctcatgattcaaacacctcccaccaagccccacctccagcactggggatcacaactcgacatgagatttgagcagagacaaatttccaaactatatcactcagaatctggaatagaaagagtatgcaccataacacttttattctctacagaaacagacactgtgctgagctcaaaaaatagtgattcatcaaatatgaatgtgcaaacctcttttgtactgtatctgtggaatcctggttactggggctttgagcccctgtcccataaaatctctgtaatactaacctaactcatggcatttctttaaaatcaaatttaatgaaatgatggacataaagcccatggaactgagtgtgtaatcttctcttatttgattagatgttaaacttgaaacacttttttttgataaaatatgaaatacataaatgagttaaattgttgtgactttccttataagattgaaaacaataaggtgtttttaatactttttttctgtgttctcttgaaagtagctttacatgtattaagcaatcctggctttagatattagggacaataaaaatatctgcaattttcccagttttatatagccattgtttgcaagtatgaaaacctgtcttttgttactgaaatattatcttttattttggcttttttgataacttttatgtttgccttgagcaagtcacttatcttttctatttgtgttttctatttcagtttatttatgaaagacagtaataatgattgtgatgtaccttacaaaaaaagataaaatcgtattgaagagactgttgaatatgaacgcagtgtattaaatgcccgatataggaacaaaaataaaatgaagaacatttctattataaa

SEQ ID NO: 3519 - DNA, 2385 bp, Homo sapiens
gttaccatcgagaccggggctgtgtatgctcgaggtgcagggagctaatgtataaggagttaaatgaactcttgctgctgccaaatatgttgttatcactaactgcaccgctgctgtcattagtgctgctgccaacactgcaagccctgctgctgccagtgccaattctgctgatgccttgggctctccatgtcccagggtgattccatagacaagcagctgcttttagatttcacttgctcattacctgtagatcctttgccttaggactcaagcttaagcccatgaagcctgggatagaagacaattggaggctgcaaagttggctttcacagtgcaagcctttgattcccaatgggggactcaggatcaagacgatctaccctggtctcccggttgccaatattcagaagaagtattaacagaagacatgattctcttccttcttcaccttcttccagtaatacagttggtgtccacagttcctctccttccagcactaactcaagctcaggtagcacaggtaaacggaggagcatattccgtactccttccattagcttccaccataagaaggggagtgagcctaagcaagagcctaccaaccagaaccttagtatttcaaatggtgctcaacctggtcacagcaatatgcagaaactgagtttggaagaacatattaagaccaggggaagacattctgttggttttagtagttcacgaaataagaagataacaagatctttgacagaggattttgaaagggaaaaagagcactcaactaacaagaatgtctttataaattgtctaagttctggcaaaagtgaaggggatgattctggtttcacagaagaccaaactcgtcgttctgttaagcagtcaacaaggaagctactccctaaatctttttcatctcactataaattttctaagccagttctacagagccaatccatttcattggtacaacagtctgaattctcattggaagttacacagtaccaagagagagaacctgtattagtaagagcttcgccatcctgttctgtggatgtaacagaacgggcaggaagctctttacaatctcctttgctttctgctgatcttaccacagctcagacaccttcagaatttttagccttgactgaagattctgtgtctgaaatggatgcattttctaaaagtggaagcatggcatcccactgtgacaactttggccacaatgattctacctctcagatgtccctcaattctgctgctgttacaaagacaacaacagaacttacgggaactgttccctgtgcaattatgtctcctgggaaatataggttagagggtcaatgtagcactgaatctaattcattaccggaaacctctgctgctaatcagaaggaagtgttattacaaattgctgaactacctgctacaagtgtgagccactcagagagtaacctaccagcagatagtgaaagagaagaaaatatagggttacaaaatggtgaaacaatgctggggacaaactccccaaggaaacttggattttatgagcaacataaagcaatagcggaacatgtaaaagggatccatcctatttcagattcaaagataatacctacttctggtgatcatcatatttttaacaaaacatcacatggatatgaagcaaatcctgccaaagttcttgccagtagtctcagtccatttcgtgaaggaagatttatagagaggagactgcgatcctcgtcagaaggcactgcagggagtagcagaatgattttgaaaccgaaagatggaaatatagaagaagttaatagtttaagaaagcaaagagcaggttcttcatcttcaaaaatgaacagtttggatgttttgaataatttgggatcttgtgaactggatgaagatgatctaatgcttgatcttgaatttttagaggaacagagtcttcacccttctgtttgccgggaggactcatatcactctgtcgtctcatgtgccgcagtagttcttactcctatggaaccaatgatagaaatgaagaaaagagaagaaccagaatttcctgagccttccaaacagaatctttccctgaaattaacaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagagagtgcagacatgagtccagcaagcagtaccacgtcacttcctgttagtcctcttactgaagagccagtgcctttcaaggattattataaaaggcccttt

SEQ ID NO: 3520 - DNA, 5847 bp, Homo sapiens
gtctcaacatgactgactgggaagcggtggctcgggcagagcagctccgctggcgcaggcaggaggagcaggaggattattaaataacgcagctggactctgtgcaactgggagtggagaggagcccaacagccgagaaggggagggagggcagaggagggggaccaggaaggacacccccgtgccccgaagacataaatccctgagtgcccgggaggagccttaacaagcgcacggagccctcaaggctgcaaagttggctttcacagtgcaagcctttgattcccaatgggggactcaggatcaagacgatctaccctggtctcccggttgccaatattcagaagaagtattaacagaagacatgattctcttccttcttcaccttcttccagtaatacagttggtgtccacagttcctctccttccagcactaactcaagctcaggtagcacaggtaaacggaggagcatattccgtactccttccattagcttccaccataagaaggggagtgagcctaagcaagagcctaccaaccagaaccttagtatttcaaatggtgctcaacctggtcacagcaatatgcagaaactgagtttggaagaacatattaagaccaggggaagacattctgttggttttagtagttcacgaaataagaagataacaagatctttgacagaggattttgaaagggaaaaagagcactcaactaacaagaatgtctttataaattgtctaagttctggcaaaagtgaaggggatgattctggtttcacagaagaccaaactcgtcgttctgttaagcagtcaacaaggaagctactccctaaatctttttcatctcactataaattttctaagccagttctacagagccaatccatttcattggtacaacagtctgaattctcattggaagttacacagtaccaagagagagaacctgtattagtaagagcttcgccatcctgttctgtggatgtaacagaacgggcaggaagctctttacaatctcctttgctttctgctgatcttaccacagctcagacaccttcagaatttttagccttgactgaagattctgtgtctgaaatggatgcattttctaaaagtggaagcatggcatcccactgtgacaactttggccacaatgattctacctctcagatgtccctcaattctgctgctgttacaaagacaacaacagaacttacgggaactgttccctgtgcaattatgtctcctgggaaatataggttagagggtcaatgtagcactgaatctaattcattaccggaaacctctgctgctaatcagaaggaagtgttattacaaattgctgaactacctgctacaagtgtgagccactcagagagtaacctaccagcagatagtgaaagagaagaaaatatagggttacaaaatggtgaaacaatgctggggacaaactccccaaggaaacttggattttatgagcaacataaagcaatagcggaacatgtaaaagggatccatcctatttcagattcaaagataatacctacttctggtgatcatcatatttttaacaaaacatcacatggatatgaagcaaatcctgccaaagttcttgccagtagtctcagtccatttcgtgaaggaagatttatagagaggagactgcgatcctcgtcagaaggcactgcagggagtagcagaatgattttgaaaccgaaagatggaaatatagaagaagttaatagtttaagaaagcaaagagcaggttcttcatcttcaaaaatgaacagtttggatgttttgaataatttgggatcttgtgaactggatgaagatgatctaatgcttgatcttgaatttttagaggaacagagtcttcacccttctgtttgccgggaggactcatatcactctgtcgtctcatgtgccgcagtagttcttactcctatggaaccaatgatagaaatgaagaaaagagaagaaccagaatttcctgagccttccaaacagaatctttccctgaaattaacaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagagagtgcagacatgagtccagcaagcagtaccacgtcacttcctgttagtcctcttactgaagagccagtgcctttcaaggatataatgaaagatgaatgctcgatgctcaagctgcagctgaaagagaaggatgaactcatttcccaacttcaggaagagctgggaaaagtccggcatttacagaaggcttttgcttcaagagtagataaatccacacagactgaactactatgctatgatggtttaaacttgaaaagactagagacagtacaaggagggagagaggctacatatcgaaatcgaattgtgagccaaaatctcagcacaagggacagaaaagcaatacatactcccaccgaggaccgttttaggtattcggcagcggaccagacaagcccctacaaaaacaagacctgtcaactcccaagtctctgtttaagtaatttcctgaaggacaaggaactagcagaagttatcaaacattcaagaggaacttatgaaaccctcacttcagacgttacacagaacttacgggccaccgttgggcagagctctctgaagccaacagctaagacagaagggctctccacgttcttagagaaaccaaaggaccaagttgctacggcccgacagcattcgacctttacaggcaggtttggacagccacccagagggccaatctctttacacatgtacagcaggaagaatgtgtttctccaccacaatttacacagcactgagctgcaaactctaggccagcaggatgggtaattaaatcaccgtattcctgtctttgggtaggataaagatggttagtgtttctcgtgcatagttcatattaaaattgtcatgtactttttcttacattttagttataaacagagttgtgttgttgggttttttttcttagtcataaacaaagacttgtgggttttttttttccaagagtgaaagtttgagcatgttaattgaactaggttgcattgccttgaagactttactatataggtgtataataaatgggaccatcatgatcgtttatatagtccataatttatttattttttatctctatcacttactgatatgcattaaggtttcagaagataatatcaaatagcaatctgttcactgttaatggtgttactataaaagtagacctgatgaaaaatagataaaggaattataaagaattttaaattatataattaatagaaggaggaaaaaagagaaatgttaacgtcttatatttggtggtatatttatttgaagaatgtggcttgcttgcatgtaacctagagatgtgtttgtctctattacatacattcaagctcatcttgtgatactagtaagggggaaatggctgtattttttttcctttaaacgtttagttcatactagttcacaaaggatttcagacagagtaattgctagccaaatagagaatgacagctctgatctttgaaaaattttgcttttagtttttgttattgatgttgaagtaccgtgacataacacaaggtgataaagttggttgaattttgtcagatgatgcataaatactgacatgctatattctttgagccactgtcatggcaatataaacattttttcaaaatttcaaggatgaaacatcctaagaaaattattctttttctttactttccttattttttaaaatgttcttttttatgtaaatccaattttggtttatatacatcaacccatatctataattttatgaactgaagaacagaaagtcagtattttagtagccagcatacaatattctgactatgcagaaatctagatttggaacaaaagtaaagtaaatgtgaacattggcaatttaatcttagaaataagcttctaacaggaatatttaaaacccatttgatggcaaatatttctctttgacaaataaggcccaaatatgttataatatgttatatacttatgtgcactttagatcaatatatgaattgatctatggataattccatcatgttcaattagtagcagagcagaatcaaagagtacaattgaatacataaataaataatttttaaaagactaataggaatcaaggctgcagttttcttatacacatcagagctgttaagtacatccacattagccatagtccatgcaaattgaaactgtcatacctactgcatgatctgtttcccttgcattttctaacagaatctgtcagcgtgcacaagcaagatgaacaaagggaaattgagatagcagttttagcatggcatctgacaacttgcttaaattaaagctgtgtgcaaaatgcatctcctattataaaaatgtatttgtgccctgtgctttggggaaaagccattagacactccacccctgagctttaactactgaactttgatacatttgcaaacttagattggaactgataaagtaaggagtcgagtggatatgttgtacttgtaattttggttttccaaaggaacacacatgtgcatcaaggcagacatttgccaaatgttttctttctttgcgtgtttgtaattctgccaaaagagaacaatatacactgcaaattgcttgacttaatgagattgccatctaaagttcccaccatactttggaagctataatgatcatgcagatatacactttgggctgggcaatatttaagaaatgataggaaaatagaaaaatcatgattattaattgtggaattcagcttgatttgtcctaaatgttggtgtctgttgctagagtattttaaatctgtacataaataagcatgataaaataatcaaggattttttcccaggatatggaagaactatgtatcacaaataatgtttttgatttggacttttggagttgatagttttgttttcctggaagatagacttttgaattatactttataaaaataatctatttatagaagatctgtcatttaatagacattttaagagatgttttaaacgctagtattttcttgaaaaatcttttttaaagctgaatcattcaaaagaaaacctggattaaacagttcgattttaaaaggaagggtattttttggaaatatcatcttaaagctgttttgtatcagtattttcaacattgttataatattatttgtaatactaagtgtaactcaggcctggagaaggtgtaagcccactatgctaatgtacatcagtaactgtaaaacaggggttctttgtaagttcctcttgtgtatatatagtaacttataacaatggcatgtgggcattctttcagtgaattgctttctttgtactaaaatctctagttttctaagacagttccatgtataaaaatgatttatgcatttctccaaggcggtacatatccaaagacatgacaccagggggaaaaagtgcttgtttttctgatggaagcagtggtcttttcttttctttcctctttcttttgtgcatgtgtatgtgtagctaagcctaaataaccctgtaaaatttctgctgcaaattgtctcttctgaatttagaatgtgttttaaaggaacacttaggaagagaaataccttgaagaaaagctgtttccacctgaaataaactgttcccatttttataattattggaacatgaaactgta

SEQ ID NO: 3521 - DNA, 7664 bp, Homo sapiens
gcgatgctggttgctgcggctcgggcggcggggctggcggggatgtgacgggcggcccttcgtctcaccttccgtcctcgggcccgcaggtcgcagggcggcctgcagctgggccgcggccgaggaggcagcgcgacctccgcacgattctttcaacttttaagaacaaatgcaccttatagctcatggaagaaaaaacacaaatcaagacatttttgggttccaagttgccaaagtatggaacaaaatctgtaagaagtacattgcagccaatgccaaatgggacacctgttaatttattaggaacttccaagaatagtaatgtcaaaagttacatcaaaaataatggctctgattgtccatcatctcattcatttaattggaggaaagcaaataaatatcagctttgtgcacaaggtgtcgaagagcctaacaatactcaaaattcacatgataaaataattgatcctgaaaaacgtgttcctactcaaggaatgtttgataaaaatgggataaagggaggtttgaaaagtgtttctttattcacatcaaagttagcaaagccatccactatgtttgtgtcatctacagaggagttaaaccaaaagtctttttctggaccatctaatttgggtaaattcaccaaaggcacattattaggaaggacttcatattcttcgatcaatactccaaaatcacagttgaatggattttatggaaaccgatcagctggtagcatgcaaaggcctagagcgaactcctgtgccaccagaagcagttctggagaaagcttagctcaatccccagacagtagtaaatctattaattgtgaaaaaatggtaaggtcacaaagtttttcacattccattcagaattcattccttccaccttcatctataaccagatcacattcctttaatagagctgtggatcttacaaagccttatcagaaccaacagctatccattagagtgcctctacggtcaagtatgctaacaagaaattcccggcagccagaagtactcaatgggaatgaacatttggggtatggatttaataggccttatgctgctggtggaaagaagttggctttaccaaatggcccaggtgtaacttctactttaggttatagaatggttcatccctctctactgaaatctagccgatctccattttctgggactatgacagttgatggaaataaaaattcacctgctgacacatgtgtagaggaagatgctacagttttggctaaggacagagctgctaataaggaccaagaactgattgaaaatgaaagttatagaacaaaaaacaaccagaccatgaaacatgatgctaaaatgagatacctgagtgatgatgtggatgacatttccttgtcgtctttgtcatcttctgataagaatgatttaagtgaagactttagtgatgattttatagatatagaagactccaacagaactagaataactccagaggaaatgtctctcaaagaagagaaacatgaaaatgggccaccacaggatatgtttgattcccccaaggaaaatgaaaaagccttcagtaaaactgatgaatggatagatataagtgtctctgacaggagtgaatgtacaaaacatacttctgggaataatttggtttcaccagatacagactacagagctggttcttcgtttgaactctctccatctgatagctctgatggaacatacatgtgggatgaagaaggcttggaacccattggaaatgtccatccagttgggagctatgagtcctctgaaatgaacagcatagatattttgaataatcttgaatcatgtgaccttgaggatgatgatcttatgcttgatgtggatctgcctgaggatgcacctcttgaaaatgtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcaaactgaaacgtctcctgcatcagcatgatggaagtggttcattgcatgatattcaactgtcattgccatccagtccagaaccagaagatggtgataaagtatataagaatgaagatttattaaatgaaataaaacaacttaaagacgaaataaagaaaaaagatgaaaagatccaactattagaacttcagcttgcaactcagcatatctgccaccaaaaatgtaaagaggaaaaatgcacttatgctgataaatatacccaaacaccctggagacgaattcctggtgggtattctgctccctccttctctccttggcagggctccttccaggggatcccacggactgttccaccgcaccgcagacagacctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttctactagtttggctccttcattttatatcctggttgaagtacatgccatttgagcataattatctcaggtaaacacgaaagtttgcttacccatttcagaggcctgccaaaggcccaaatcatgttatccatccctctccacgtcagaaaattcataatattttactgagcaggcaagaagtgtgctttgctggtttagtcctattaaggtctgtatttattgtggttgtcagaacctcaccccttttcacttgtctctcctgtgaatatggctactattttaactaaagatatggtgataatggaagatggtagtctgtaagcagagttctggccagtgttttgtatatttaaaaggtctatgcaaaagctttgtgatgaataaaggagattaggcttttaatggaaagtctatgtaagttttatttttccttgccagggtcagtcagctaatgttactgttgattcatttcccaaattccccagactgaaagtgtttcttattacatataaatcagttatatattcctttacatcttgttttacaaacacatgtgcatgcacacacacatatacacacacataccatttatgtttgtatttgttactgggtaaattttggagcgcttgagatacaccttgaaacctgtacctaaagatgtattcatttgtaacatatgttggtgctagagttttgctggtaattcaggcttgaacccttaggcttgtggatccatgatagccattttaaggttccacagcattatgtctttaattgtaatatttatatttattgattttctgctaatatctgaagactgaaataatgaacttgaaacatttgcacaaaactttgatggggtataaatataccatatatagggattgtaaactattttctatagcaaaacaagttaaaatattttgagaaaaataacaaatttaaataagactatcttgagaaagctggagttcataatattctccccctcccccatctccagtctcctaggtttcccttttctgtgttttttgtttttttctgtttgttttttgagacagagtcttgctccattgcccaggctggattacagtggcgcaatctcggctcactgcaacttctgcctcccgggttcaagcgattctcctgcctcagcctcctgagtagctgggactacaggcatgtgccaccatgcctggctaatttttttgtatttttagtagagatgagatttcaccttgttggtcaggctggtctcgaactcctgacctcaagtgatccacccacctcgtctatggtgtatttttgaaagacaattttttaaaggtagatttgggaaaaaaatagaattgaagatgggaaattttgttttattaaaaaggtgctagaagatgtttcaaagacaatattcttattttaatacgctgtagaaggtaggtgtggaacctccatgctaccatgtgcacaaacctaattatgctttgggtcacttgtcagttcagtaaatctgccttcctcttctcccaaatcatgtcatctttaggttgttcacctgcagctgctttaaatgaattagtatctttcagatagataaccttacaaggagaatgtttgttttgagcagctgaccaaaaatatatcaaacaggattatggccaaaaagtcactcaaatttctagagattcctttaaaagatgtatgttgatgaaattgcccctttataagaaaaacaacagcaagtcttttagtagaaatttgaaagaagtgtttgctaccattttgacccattattcccttacctatcagatgaatttgccattcactggatagaaaccattcttggatttggtaagaggtgagcaagacaaatcttgtaccatactcttatgtaccagcacttctgatggagaagcagtgaagttcagaacgttcttcacatagtccagatactgttagagtcaggcaaatcagcaaagcactttgttatggagatgacccatgatggctgcagttgtaagtgggcatacatgttctatcattttgaaggagaaagaaaaccgttctcacatgttgcaaatatgtgaatcatactatattcccctaaagtaaaaccagtgacttagtggtttttggtttatttagaagttggtttagacccttatgaaacattatttacgagttggccttatccttaagggaaaagttctaaatttttaaatttatttttaattccctagtctgagggaaatgtctttattgtccattacataaaaatgttgactccagtaatttatttttctctattttttcctccatgtatttactccatttttctctattttttccttccctgatggatttgcagaaatgttaaccaattagctcaacttttctctacctttgttgagtcttaatcttttagaagataggcttatcgtatatttatgaagcataatatattaaaagaaaacaaatctaggatgcttgcatgacataaagtatttgcctgcagttttcattaaaaactgcaagaatatcatgcttgtctgcttcttagtaaatgttaagtctgaaatggaagtgaggatgtaactctactgaataatcaaagatcatcttagatttggcttgatctgtgtttattgcttctattaatgtaaatcaactctgtgccaaatcctcctccacaaaccatttattgtcttagttctagtggtatcaatgaagatagttacagtatatgaattctaagtcctgaggaagaaattttatggggtttgttaagtttcacattcgtgaaagaggaaattagtagagtattcagactttgatatttggctgttaatgggatgcatatcaaatttttaaaagaaggcttggcctaaggagtttattggtacaggtgcagatgattttaaggcattaaaggattatagagttatgtcatttagactgtttctaataactgagaccatctaacatttttcttttggagtctcatttttatttgtgcaatattttcaggcatataggctactgttcattgtatttatatatatattagaatttactaagtactttaacaagtaaaaatctgaatatgaaagaaaatatcagatttgcactttaaatgagcttaattgcttgaagttgtgcctgaaatatcgaattgcctcctattgggtgtggctttgttgaaataaatttgtaattgttgctgtttgaagatatcagtacagctgttcacagaaatatattcccagcatgtcacttttccattaaagcactaagttttctttgaatgttccattgttccgataagtattttacttttttctcagtacatcagagagagcgtgatccccctacagctgtcacttccaaatgttcctgtagcataaatggtgttacagacactgaggtgcactcttggtttctgagcagagttgtcatactggtttcctggtctctagggcactggggatgtactttgaaatcaccgaacaggcttgcaattaagatcaataaggctgcagcaccatttcaatttactttccatcttacccagtagtttttgtgtttttaaattcgtttgggtggttatgtttgcatgcttaagcacacatttgaaaattaattatagctgtactacccgatgtttttccttggggatgatggccttgttcctttttaaattctgatgcttgaattctattttctagtgatttttcacatctccctttaagtttttgctgcagcaatttgagagagtacttttgattaaatgattctgatggtgggcaccaatctacaactatgtcattaactgaagatacatgttttaatcttgttgggaataagcttacccactttctccttggtaaagcgtttacttaacaaaataatacccgagaatgtaaggtctctaagtcattactaacaaagagcaaaaataatatctgcagtattgtttttcccattgattttaagtcagtttagagtacaaactgtatattagaatttgcctgtaaaatgaattctaaaaagcagatgtaaagtctctcctgaaaatgttggcatagtaaataaaaataaagttcataattataaaa

SEQ ID NO: 3522 - DNA, 3468 bp, Homo sapiens
gcgatgctggttgctgcggctcgggcggcggggctggcggggatgtgacgggcggcccttcgtctcaccttccgtcctcgggcccgcaggtcgcagggcggcctgcagctgggccgcggccgaggaggcagcgcgacctccgcacgattctttcaacttttaagaacaaatgcaccttatagctcatggaagaaaaaacacaaatcaagacatttttgggttccaagttgccaaagtatggaacaaaatctgtaagaagtacattgcagccaatgccaaatgggacacctgttaatttattaggaacttccaagaatagtaatgtcaaaagttacatcaaaaataatggctctgattgtccatcatctcattcatttaattggaggaaagcaaataaatatcagctttgtgcacaaggtgtcgaagagcctaacaatactcaaaattcacatgataaaataattgatcctgaaaaacgtgttcctactcaaggaatgtttgataaaaatgggataaagggaggtttgaaaagtgtttctttattcacatcaaagttagcaaagccatccactatgtttgtgtcatctacagaggagttaaaccaaaagtctttttctggaccatctaatttgggtaaattcaccaaaggcacattattaggaaggacttcatattcttcgatcaatactccaaaatcacagttgaatggattttatggaaaccgatcagctggtagcatgcaaaggcctagagcgaactcctgtgccaccagaagcagttctggagaaagcttagctcaatccccagacagtagtaaatctattaattgtgaaaaaatggtaaggtcacaaagtttttcacattccattcagaattcattccttccaccttcatctataaccagatcacattcctttaatagagctgtggatcttacaaagccttatcagaaccaacagctatccattagagtgcctctacggtcaagtatgctaacaagaaattcccggcagccagaagtactcaatgggaatgaacatttggggtatggatttaataggccttatgctgctggtggaaagaagttggctttaccaaatggcccaggtgtaacttctactttaggttatagaatggttcatccctctctactgaaatctagccgatctccattttctgggactatgacagttgatggaaataaaaattcacctgctgacacatgtgtagaggaagatgctacagttttggctaaggacagagctgctaataaggaccaagaactgattgaaaatgaaagttatagaacaaaaaacaaccagaccatgaaacatgatgctaaaatgagatacctgagtgatgatgtggatgacatttccttgtcgtctttgtcatcttctgataagaatgatttaagtgaagactttagtgatgattttatagatatagaagactccaacagaactagaataactccagaggaaatgtctctcaaagaagagaaacatgaaaatgggccaccacaggatatgtttgattcccccaaggaaaatgaaaaagccttcagtaaaactgatgaatggatagatataagtgtctctgacaggagtgaatgtacaaaacatacttctgggaataatttggtttcaccagatacagactacagagctggttcttcgtttgaactctctccatctgatagctctgatggaacatacatgtgggatgaagaaggcttggaacccattggaaatgtccatccagttgggagctatgagtcctctgaaatgaacagcatagatattttgaataatcttgaatcatgtgaccttgaggatgatgatcttatgcttgatgtggatctgcctgaggatgcacctcttgaaaatgtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcaaactgaaacgtctcctgcatcagcatgatggaagtggttcattgcatgatattcaactgtcattgccatccagtccagaaccagaagatggtgataaagtatataagaatgaagatttattaaatgaaataaaacaacttaaagacgaaataaagaaaaaagatgaaaagatccaactattagaacttcagcttgcaactcagcatatctgccaccaaaaatgtaaagaggaaaaatgcacttatgctgataaatatacccaaacaccctggagacgaattcctcctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttct

SEQ ID NO: 3523 - DNA, 934 bp, Homo sapiens
agtgccttgggtacaactatgtctgagtaggcagccggtaacacaatgtctcccttgtgcaaagtaactctcttagtgagtgctcagatatgtgaggaaaaagtatttggtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcaaactgaaacgtctcctgcatcagcatgatggaagtggttcattgcatgatattcaactgtcattgccatccagtccagaaccagaagatggtgataaagtatataagaatgaagatttattaaatgaaataaaacaacttaaagacgaaataaagaaaaaagatgaaaagatccaactattagaacttcagcttgcaactcagcatatctgccaccaaaaatgtaaagaggaaaaatgcacttatgctgataaatatacccaaacaccctggagacgaattcctggtgggtattctgctccctccttctctccttggcagggctccttccaggggatcccacggactgttccaccgcaccgcagacagacctcaagtactacagccttccagcagccttcccagacccacagatcacacccagggaaaactaataaagccacaacgtatcgaggcccgcagtgaatgctcaatccaagacatgcatca

SEQ ID NO: 3524 - DNA, 4083 bp, Homo sapiens
ctggacggagaaactgggctaatgtgacagacagcaacaagagtaaggcagttgcttcgctattgagagaaagaaccatatgaagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggaaaatgaacacttgaaaaagttccaagtgacgtgggaactgcataataaacacctgtttgaaaatctggtcttttcggagccacttcttcagagcaacttgcccgcactggtgtcacagatcaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcaggaccttcagaccagtgtgaataagagcattgatactggcacccttgtccagtcctggcttcgaggggctgctatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaacttttgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcgggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattgatgatgtctttctacctaaagatattgacctagacagtgtggatatggatgagacagagagggaagtggaatatttcaaaaggttctgcttggattctgctagacagacccgacaaagactgtctatcaactggtccaattttagcttgaaaaaagccacctttgctgcccactgaatgaggactccctggagaggg

SEQ ID NO: 3525 - DNA, 4110 bp, Homo sapiens
ctggacggagaaactgggctaatgtgacagacagcaacaagagtaaggcagttgcttcgctattgagagaaagaaccatatgaagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggaaaatgaacacttgaaaaagttccaagtgacgtgggaactgcataataaacacctgtttgaaaatctggtcttttcggagccacttcttcagagcaacttgcccgcactggtgtcacagatcaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcagatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcgggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattgatgatgtctttctacctaaagatattgacctagacagtgtggatatggatgagacagagagggaagtggaatatttcaaaagagacggggtttcgccacattgcccaggctggtctcgaactcctggcctcaagtgatctgcccacctcagcctcccaaagcgccagaattacaggttctgcttggattctgctagacagacccgacaaagactgtctatcaactggtccaattttagcttgaaaaaagccacctttgctgcccactgaatgaggactccctggagaggg

SEQ ID NO: 3526 - DNA, 2913 bp, Homo sapiens
gcggcggcggcggcggcgtgtggagcgagggagcggcgcgagcggcggcatgacgcggaggcggagcaggccgagcggcggtgcgggcaggcgcgagcgggctcgggccgcggggccgcagaagccccaggcgcccgagcccccgccgccgccaagcctggaggcgggagcgggtgcaggccctccggaggcgccggcggagcccgaccacgacggccccagggaggatgacgaacccaacctggtgcccggcccgcaggtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatctccttgtcacacacatcctgcaaatcacagtcttgtggagatgactctcattcgtcctcgtcttcctcctcatcatcctcatcctcgtcctcctcttcctgccctgggaactcgggagactgggatcctagctcgttcctgtcggcacataagctctcgggcctctggaattccccacattccagtggggccatgccaggcagctctcttgggagtcctcctaccatccccggtgaggctttccccgtctcggagcaccaccagcactcagacctcactgctccccctaacagccccaccggccaccacccgcagccagcatctctaatcccgtctcaccccagctcctttggctccccaccccacccacacctgctgcccaccaccccggcagcacctttccctgcccaggcttcagagtgccctgttgctgctgccactgccccccacactccagggccatgtcagagctcccatctaccctccaccagcatgccgctcctgaagatgcccccaccattctcggggtgcagccacccctgcagcgggcactgtggtgggcactgcagtgggcctctcctcccacccccgagctctcagccactccctagcactcacagggatcccgggtgcaaggggcacaagtttgcacacagtggcctggcttgccagctgccccagccctgcgaggcagatgaggggctgggtgaggaagaggatagcagctctgagcgaagctcctgcacctcatcctccacccaccagagagatgggaagttctgtgactgctgctactgtgagttcttcggccacaatgcggaaaaggagaaggcccagttggcagcagaagctctaaagcaggcaaatcgtgtttctggaagccgggagccaaggcctgccagggagaggctcttggagtggcccgaccgggaactggatcgggtcaacagcttcctgagcagccgtctgcaggagatcaaaaacactgtcaaagactccatccgtgccagcttcagtgtgtgtgagctcagcatggacagcaatggcttctctaaggagggggctgctgagcctgagcctcagagtctacccccctcaaacctcagtggctcctcagagcagcagcctgacatcaaccttgacctgtcccctttgactttgggctcccctcagaaccacacgttacaagctccaggcgagccagccccaccatgggcagaaatgagaggcccccacccaccatggacagaggtgagggggccccctcccggtatcgtccccgagaacgggctcgtgaggagactcaacaccgtgcccaacctatcccgggtgatctgggtcaagacacccaagccgggctaccccagctccgaggagccaagctcaaaggaagttcccagttgcaagcaggagctgcctgagcctgtgtcctcaggtgggaagccacagaagggcaagaggcagggcagtcaggccaagaagagcgaggcaagcccagccccccggcccccagccagcctagaggttcccagtgccaagggccaggtcgctggccccaagcagccaggcagggtcctagagcttcccaaagtaggcagctgtgctgaggctggagaggggagccgggggagccggccaggaccaggttgggctggcagtcccaaaactgagaaggagaagggcagctcctggcgaaactggccaggcgaggccaaggcacggcctcaggagcaggagtctgtgcagccctcaggcccagcaaggccacagagcttgccccagggcaagggccgcagccgccggagccgcaacaagcaggagaagccagcctcctccttggacgatgtgttcctgcccaaggacatggacggggtggagatggatgagactgaccgagaggtggagtactttaagaggttctgtttggattctgcaaagcagactcgtcagaaagttgctgtgaactggaccaacttcagcctcaagaaaaccactcctagcacagctcagtgaggccctgcccaggctgagctgcttcagggcgtcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattttgtttttttccaattctttacttttgatactgtgaagatctttcgtgccgaaagataaagcaacatttggacacagag

SEQ ID NO: 3527 - DNA, 4846 bp, Homo sapiens
cacaatgacatgcagacctgcatattggagctggacggagaaactgggctaatgtgacagacagcaacaagagtaaggcagttgcttcgctattgagagaaagaaccatatgaagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggaaaatgaacacttgaaaaagttccaagtgacgtgggaactgcataataaacacctgtttgaaaatctggtcttttcggagccacttcttcagagcaacttgcccgcactggtgtcacagatcaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcagatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcgggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattgatggagtttcgctcttgttgcccagtctggggtacaatggtgcaatcttggctcactgcaaccttcgcctcccaggttcaagcgattgtgctgcctcagcctcccaagtagttggaattacagatgatgtctttctacctaaagatattgacctagacagtgtggatatggatgagacagagagggaagtggaatatttcaaaaggttctgcttggattctgctagacagacccgacaaagactgtctatcaactggtccaattttagcttgaaaaaagccacctttgctgcccactgaatgaggactccctggagagggacacgcgagaggcaggccaggctgcaccaccccaagagccacgcccctcgctggcgccccagagccgtggtgcttgccaagggctgtgcggagctggtgctgcctgaaaccccagaccgagaagttgatgctcggcccacgccgttagctcgtgtgcgtgtagtctgtgcgtgagactccttcgattgtagctctgtgctgtcggattggaacagtagttcccgccaagtcctcccaccaccgcggcctcggaggcctgggccgtggccagataggagtttgcatcatccacgtggctccgttgcctctgcattgcgccctgtcctgtcatgtgtcctcaccggggtatcggccgtcactcagctctcctgtgcccctgcgtctcaccctaggcgggctgggcggggcaggcctcctttgttctccacaatctactgtctccgagtgtacacgttgcgctgtttgtgtttgatccccctgacttgtagccagcttgtgtaagatcccttgcagaacgagaaagttaaaaacaagcccacccagtactcacaccatcaagtctgttatagagtgtacgactgtattaacacggaggcctgcctggctacttttttaacatattgttaagtaatattaaaatcatgtctttctttttgaaagatggaatacattagta

SEQ ID NO: 3528 - DNA, 4710 bp, Homo sapiens
cacaatgacatgcagacctgcatattggagctggacggagaaactgggctaatgtgacagacagcaacaagagtaaggcagttgcttcgctattgagagaaagaaccatatgaagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggaaaatgaacacttgaaaaagttccaagtgacgtgggaactgcataataaacacctgtttgaaaatctggtcttttcggagccacttcttcagagcaacttgcccgcactggtgtcacagatcaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcagatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcgggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattgatgatgtctttctacctaaagatattgacctagacagtgtggatatggatgagacagagagggaagtggaatatttcaaaaggttctgcttggattctgctagacagacccgacaaagactgtctatcaactggtccaattttagcttgaaaaaagccacctttgctgcccactgaatgaggactccctggagagggacacgcgagaggcaggccaggctgcaccaccccaagagccacgcccctcgctggcgccccagagccgtggtgcttgccaagggctgtgcggagctggtgctgcctgaaaccccagaccgagaagttgatgctcggcccacgccgttagctcgtgtgcgtgtagtctgtgcgtgagactccttcgattgtagctctgtgctgtcggattggaacagtagttcccgccaagtcctcccaccaccgcggcctcggaggcctgggccgtggccagataggagtttgcatcatccacgtggctccgttgcctctgcattgcgccctgtcctgtcatgtgtcctcaccggggtatcggccgtcactcagctctcctgtgcccctgcgtctcaccctaggcgggctgggcggggcaggcctcctttgttctccacaatctactgtctccgagtgtacacgttgcgctgtttgtgtttgatccccctgacttgtagccagcttgtgtaagatcccttgcagaacgagaaagttaaaaacaagcccacccagtactcacaccatcaagtctgttatagagtgtacgactgtattaacacggaggcctgcctggctacttttttaacatattgttaagtaatattaaaatcatgtctttctttttgaaagatg

SEQ ID NO: 3529 - DNA, 503 bp, Homo sapiens
gagccaagattttcttcttcactcctcgcttggtggctcccagccagaggccggcagtggtgggaggctcgctctgggtgcacagacgctgccttcagacaccgcatgctcgtgcgaggcctgcagtgagcgcagagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccagg

SEQ ID NO: 3530 - DNA, 3727 bp, Homo sapiens
ggtttcaccgtgttgcccaggctggaagtttgaaatcaattatttttatgtttgctgtctgaaattcattctttctctgttgtttgacacatacataagcctgcaggtacccaaatttgttccaaaaaaaaaaaaatttccctgaggctgtgaggagagagtcaaggaagaggtttttattgatgttatttatcaaacaactcttacactgtacactaagattttataataactgcagacatatacaatgaaaagggagaattggcaccaatattgaatcttcccatccaagaatatggtatgtcactcttttttaaggtttttaaaaatatattgtattatggttttatagtttgtaaatcttgacccattttgtgcctccatagtctgtagtttgaggggctgctatgaccggcatcttgagtggggaatgtgtgtttaaagcattcatgctggaaactgggaaaatggagatgccctgtgaccagtcatctcgccagatgccggcattaactcttgtagtttttgagttgagtcttgaatctgggagtctaggaaatcacggtatcttctacaaataatgataggtttatctcatcttttccagcatttgtcccctttttttggcttccactaggaccttcagaccagtgtgaataagagcattgatactggcacccttgtccagtcctggcttcgaggggctgctatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcgggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaag

SEQ ID NO: 3531 - DNA, 3987 bp, Homo sapiens
cacaatgacatgcagacctgcatattggagctggacggagaaactgggctaatgtgacagacagcaacaagagtaaggcagttgcttcgctattgagagaaagaaccatatgaagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggaaaatgaacacttgaaaaagttccaagtgacgtgggaactgcataataaacacctgtttgaaaatctggtcttttcggagccacttcttcagagcaacttgcccgcactggtgtcacagatcaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcagatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcgggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattgatgatgtctttctacctaaagatattgacctagacagtgtggatatggatgagacagagagggaagtggaatatttcaaaagagacggggtttcgccacattgcccaggctggtctcgaactcctggcctcaagtga

SEQ ID NO: 3532 - DNA, 4570 bp, Homo sapiens
gcggcggcggcggcggcgtgtggagcgagggagcggcgcgagcggcggcatgacgcggaggcggagcaggccgagcggcggtgcgggcaggcgcgagcgggctcgggccgcggggccgcagaagccccaggcgcccgagcccccgccgccgccaagcctggaggcgggagcgggtgcaggccctccggaggcgccggcggagcccgaccacgacggccccagggaggatgacgaacccaacctggtgcccggcccgcaggtaggagcgagcggggagacttcggcggctcgggcgctttcaccttccccgagcgggagcgggagtggggcggggttggggatgggccatcctgccgcggctggggtagcagccttcccccgggtccggcgccgaagctttctcccccggggcgggaatggaggctggacccctctccccaaagccgaggctcggtccgcgctcctgcgactaggctgaagctgctcccctctccccgccgcctccgggcgttccggccgtacacccacactgggactgggactgggactgggctgtgatcccgaggccgcagctccgctctcggcccgccacctcccccgggcccacctgctccctcagccacaggccatctcggggctctgggactggacgactgcagcctcttccctctgcccccgggaacggctccactccgtcccctgcagcgcctgcagccgcggccccctcagcagctgtgtctcctggcgcctcctcgccatacccagcagagcagttggagcagacagccaggctgcccggaggagtttttggtggggtttctgcactgaggtggaaacccagcagaacctgcccttcttccctcccctgctccgcaaggcagcccaccccgaccttgagatcccaggtttggagaatcctgctgagagcgaacagtaggaggattccccaaagcttccagcttgccacctggaagaaggtcactttcttttgagcaaaggagataacgggaggtaccctgccaaagttcactgagaggcgggggtgacatgggccacggttgctctgggagggttgtggcactcggggctgggtggctctccctaagcttgctctgacaaaagagttttgagttggtcttttggctgagcctgcccaggaaggcaggctcctgcaggagtcttggagggtcggatgcggcgccggatgaggatgaggcgtggcggaagatgcgtttggctctgcagacactgcatcgggcagcaggggactctgggaggctggtgcagccagaaggcatggctcttgacagccttctagtagaatctctggaattgtgcatatgaagaaacagaaactcagagcaactaaacatttgcccaaatgactccaactgtaggtgtcagacaaaagaaaagaaaaggacttttaggtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatctccttgtcacacacatcctgcaaatcacagtcttgtggagatgactctcattcgtcctcgtcttcctcctcatcatcctcatcctcgtcctcctcttcctgccctgggaactcgggagactgggatcctagctcgttcctgtcggcacataagctctcgggcctctggaattccccacattccagtggggccatgccaggcagctctcttgggagtcctcctaccatccccggtgaggctttccccgtctcggagcaccaccagcactcagacctcactgctccccctaacagccccaccggccaccacccgcagccagcatctctaatcccgtctcaccccagctcctttggctccccaccccacccacacctgctgcccaccaccccggcagcacctttccctgcccaggcttcagagtgccctgttgctgctgccactgccccccacactccagggccatgtcagagctcccatctaccctccaccagcatgccgctcctgaagatgcccccaccattctcggggtgcagccacccctgcagcgggcactgtggtgggcactgcagtgggcctctcctcccacccccgagctctcagccactccctagcactcacagggatcccgggtgcaaggggcacaagtttgcacacagtggcctggcttgccagctgccccagccctgcgaggcagatgaggggctgggtgaggaagaggatagcagctctgagcgaagctcctgcacctcatcctccacccaccagagagatgggaagttctgtgactgctgctactgtgagttcttcggccacaatgcggcaaaaggaaaggaaatggcagagagaaagctatgattctgatgagtatgtatacgtgtgtaatcccagagaagtgaacgcttgggagtgatgaaggcagagtggaagcaaaaaggctctcagtcccccaagtgtgacagccagccgagggacaggccgtgagcacagacggcgccaggaaggaggctcagatcagagggcatgctggctctggccagggggaggaagcagtgcagaagtctcataagccacccgctgccccgacgagtcggaactataccgagatccgggagaagctccgctcgaggctgaccaggcggaaagaggagctgcccatgaaggggggcaccctgggcgggatccctggggagcccgccgtggaccaccgagatgtggatgagctgctggaattcatcaacagcacggagcccaaagtccccaacagcgccagggccgccaagcgggcccggcacaagctgaaaaagaaggaaaaggagaaggcccagttggcagcagaagctctaaagcaggcaaatcgtgtttctggaagccgggagccaaggcctgccagggagaggctcttggagtggcccgaccgggaactggatcgggtcaacagcttcctgagcagccgtctgcaggagatcaaaaacactgtcaaagactccatccgtgccagcttcagtgtgtgtgagctcagcatggacagcaatggcttctctaaggagggggctgctgagcctgagcctcagagtctacccccctcaaacctcagtggctcctcagagcagcagcctgacatcaaccttgacctgtcccctttgactttgggctcccctcagaaccacacgttacaagctccaggcgagccagccccaccatgggcagaaatgagaggcccccacccaccatggacagaggtgagggggccccctcccggtatcgtccccgagaacgggctcgtgaggagactcaacaccgtgcccaacctatcccgggtgatctgggtcaagacacccaagccgggctaccccagctccgaggagccaagctcaaaggaagttcccagttgcaagcaggagctgcctgagcctgtgtcctcaggtgggaagccacagaagggcaagaggcagggcagtcaggccaagaagagcgaggcaagcccagccccccggcccccagccagcctagaggttcccagtgccaagggccaggtcgctggccccaagcagccaggcagggtcctagagcttcccaaagtaggcagctgtgctgaggctggagaggggagccgggggagccggccaggaccaggttgggctggcagtcccaaaactgagaaggagaagggcagctcctggcgaaactggccaggcgaggccaaggcacggcctcaggagcaggagtctgtgcagccctcaggcccagcaaggccacagagcttgccccagggcaagggccgcagccgccggagccgcaacaagcaggagaagccagcctcctccttggacgatgtgttcctgcccaaggacatggacggggtggagatggatgagactgaccgagaggtggagtactttaagaggttctgtttggattctgcaaagcagactcgtcagaaagttgctgtgaactggaccaacttcagcctcaagaaaaccactcctagcacagctcagtgaggccctgcccaggctgagctgcttcagggcgtcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattttgtttttttccaattctttacttttgatactgtgaagatctttcgtgccgaaagataaagcaacatttggacacag

SEQ ID NO: 3533 - DNA, 4322 bp, Homo sapiens
gcggcggcggcggcggcgtgtggagcgagggagcggcgcgagcggcggcatgacgcggaggcggagcaggccgagcggcggtgcgggcaggcgcgagcgggctcgggccgcggggccgcagaagccccaggcgcccgagcccccgccgccgccaagcctggaggcgggagcgggtgcaggccctccggaggcgccggcggagcccgaccacgacggccccagggaggatgacgaacccaacctggtgcccggcccgcaggtaggagcgagcggggagacttcggcggctcgggcgctttcaccttccccgagcgggagcgggagtggggcggggttggggatgggccatcctgccgcggctggggtagcagccttcccccgggtccggcgccgaagctttctcccccggggcgggaatggaggctggacccctctccccaaagccgaggctcggtccgcgctcctgcgactaggctgaagctgctcccctctccccgccgcctccgggcgttccggccgtacacccacactgggactgggactgggactgggctgtgatcccgaggccgcagctccgctctcggcccgccacctcccccgggcccacctgctccctcagccacaggccatctcggggctctgggactggacgactgcagcctcttccctctgcccccgggaacggctccactccgtcccctgcagcgcctgcagccgcggccccctcagcagctgtgtctcctggcgcctcctcgccatacccagcagagcagttggagcagacagccaggctgcccggaggagtttttggtggggtttctgcactgaggtggaaacccagcagaacctgcccttcttccctcccctgctccgcaaggcagcccaccccgaccttgagatcccaggtttggagaatcctgctgagagcgaacagtaggaggattccccaaagcttccagcttgccacctggaagaaggtcactttcttttgagcaaaggagataacgggaggtaccctgccaaagttcactgagaggcgggggtgacatgggccacggttgctctgggagggttgtggcactcggggctgggtggctctccctaagcttgctctgacaaaagagttttgagttggtcttttggctgagcctgcccaggaaggcaggctcctgcaggagtcttggagggtcggatgcggcgccggatgaggatgaggcgtggcggaagatgcgtttggctctgcagacactgcatcgggcagcaggggactctgggaggctggtgcagccagaaggcatggctcttgacagccttctagtagaatctctggaattgtgcatatgaagaaacagaaactcagagcaactaaacatttgcccaaatgactccaactgtaggtgtcagacaaaagaaaagaaaaggacttttaggtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcgatctccttgtcacacacatcctgcaaatcacagtcttgtggagatgactctcattcgtcctcgtcttcctcctcatcatcctcatcctcgtcctcctcttcctgccctgggaactcgggagactgggatcctagctcgttcctgtcggcacataagctctcgggcctctggaattccccacattccagtggggccatgccaggcagctctcttgggagtcctcctaccatccccggtgaggctttccccgtctcggagcaccaccagcactcagacctcactgctccccctaacagccccaccggccaccacccgcagccagcatctctaatcccgtctcaccccagctcctttggctccccaccccacccacacctgctgcccaccaccccggcagcacctttccctgcccaggcttcagagtgccctgttgctgctgccactgccccccacactccagggccatgtcagagctcccatctaccctccaccagcatgccgctcctgaagatgcccccaccattctcggggtgcagccacccctgcagcgggcactgtggtgggcactgcagtgggcctctcctcccacccccgagctctcagccactccctagcactcacagggatcccgggtgcaaggggcacaagtttgcacacagtggcctggcttgccagctgccccagccctgcgaggcagatgaggggctgggtgaggaagaggatagcagctctgagcgaagctcctgcacctcatcctccacccaccagagagatgggaagttctgtgactgctgctactgtgagttcttcggccacaatgcgccacccgctgccccgacgagtcggaactataccgagatccgggagaagctccgctcgaggctgaccaggcggaaagaggagctgcccatgaaggggggcaccctgggcgggatccctggggagcccgccgtggaccaccgagatgtggatgagctgctggaattcatcaacagcacggagcccaaagtccccaacagcgccagggccgccaagcgggcccggcacaagctgaaaaagaaggaaaaggagaaggcccagttggcagcagaagctctaaagcaggcaaatcgtgtttctggaagccgggagccaaggcctgccagggagaggctcttggagtggcccgaccgggaactggatcgggtcaacagcttcctgagcagccgtctgcaggagatcaaaaacactgtcaaagactccatccgtgccagcttcagtgtgtgtgagctcagcatggacagcaatggcttctctaaggagggggctgctgagcctgagcctcagagtctacccccctcaaacctcagtggctcctcagagcagcagcctgacatcaaccttgacctgtcccctttgactttgggctcccctcagaaccacacgttacaagctccaggcgagccagccccaccatgggcagaaatgagaggcccccacccaccatggacagaggtgagggggccccctcccggtatcgtccccgagaacgggctcgtgaggagactcaacaccgtgcccaacctatcccgggtgatctgggtcaagacacccaagccgggctaccccagctccgaggagccaagctcaaaggaagttcccagttgcaagcaggagctgcctgagcctgtgtcctcaggtgggaagccacagaagggcaagaggcagggcagtcaggccaagaagagcgaggcaagcccagccccccggcccccagccagcctagaggttcccagtgccaagggccaggtcgctggccccaagcagccaggcagggtcctagagcttcccaaagtaggcagctgtgctgaggctggagaggggagccgggggagccggccaggaccaggttgggctggcagtcccaaaactgagaaggagaagggcagctcctggcgaaactggccaggcgaggccaaggcacggcctcaggagcaggagtctgtgcagccctcaggcccagcaaggccacagagcttgccccagggcaagggccgcagccgccggagccgcaacaagcaggagaagccagcctcctccttggacgatgtgttcctgcccaaggacatggacggggtggagatggatgagactgaccgagaggtggagtactttaagaggttctgtttggattctgcaaagcagactcgtcagaaagttgctgtgaactggaccaacttcagcctcaagaaaaccactcctagcacagctcagtgaggccctgcccaggctgagctgcttcagggcgtcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattttgtttttttccaattctttacttttgatactgtgaagatctttcgtgccgaaagataaagcaacatttggacacag

SEQ ID NO: 3534 - DNA, 2052 bp, Homo sapiens
gccgaccggggccgcggccaaagagctggctgtaatcccgcctcccgccagccatggcccacttgcgctcgcctagcggcttcggagacccggggaagaaggaccagaaggagtcagaggaggagttagaggaggaggaggaggaggaagaggtggaggaggaggaggaagaggtggaggaggaggaggaagaggtggaggaggaggaggaggaggtggtggaggaggagttggtgggggaagagcaggagttggaggcccctgagacgttcagcgaagagtacctctggaaggtcacggacatcggtgactacgacgacgacttcccagacgtgcgcccccgcttagccagcatcgtcagccctagcctgacctctacgttcgtgcccagccagagcgcgaccagcactgaaacgccgagcgcaagcccaccctccagcacctcctcgcataaaagtttccctaaaatatttcagacatttaggaaagacatgtctgaaatgagtatagatagaaatattcatcgcaatttgtctccaggaattccagtatcagtacaaacagaagaaagttggctccaagatttgtctgataaagtgcaatcgaggaagaaagcctctaaagagaaagctgaacctgaatgtctggcatctaagttaagagaaaaatgggtaattaatccagaagagtcgaaactaaatattttatatgagctggagtttaaggaagacttcataacactgttcgagccttctctaagaacgttacccagcatcggaccaccatccattctggcatacaaagaagagagctccaatttaggcattaacttcaaggatgaagaggaggagacatcacccaaatgtgaattttgtggcagcgatctaagagcatttttttctaatgtggatgtttcctctgaaccaaaagggcatgcctcctgttgtattgctttccaaaatctgattgactatatctatgaggagcaaataaaaaccaaaccccctaaagctgaattaattgctattgaccctcatgcagcccatggtagtgaggtcgacagactcaaggcaaaagaaaaagccctgcaaaggaaacaggagcaacgaatggccagacattttgcaataatatcaagggaacagactcatttctctgaagatgattcaaagcgcttaaaaacaatttcttatcaactttctgtggatattccagaaaaacagataattgatgacattgtatttgattttcaactaagaaacagtaacatgtctatcatttgttgtgattctcggatagcatgtggaaaggttgtcaggaatgagctcttagagaagcactacaaacatgggagcaagtttctgacttcatttccagatgggacaacacaaatattctatccatctggaaacctagccatcattcgagtgcccaacaaggtaaatggttttacttgtatagtccaagaagatatgcccactaaccctgctatcctagcagtgctggattcctctggcagaagttcctgctatcatcccaatggaaatgtctgggtatacatcaatatcttgggaggtcaatattcagatcaagccggcaacagaataagggcttggaattggtcaaattccatcacttcctcaccctttgtttcatttaaacctgtctttctggctttgaaccgttatattggagtccgcatcttagaacaagacaagatttctataacttttctagcaatgggccaacaggcaagaatcagtgttggaaccaaagtgaagctaccaaaccctgaggagattccaatcctccgatacgtaagtggagatgaccttcttctgctggccagtttaataaagatccgtcgcctgtttcataaacttgaaggatgtgtgaattttccctcaagccaggtttgggaaaaattaaagcaaccttcctacctttcttcactttctctaaaactaattgccctttgtcacagttctggtataaagcaagatataatgaagacaataagaaatataataaatgaagaaatttaactaagaa

SEQ ID NO: 3535 - DNA, 1868 bp, Homo sapiens
atggcccacttgcgctcgcctagcggcttcggagacccggggaagaaggaccagaaggagtcagagcaggagttggaggcccctgagacgttcagcgaagagtacctctggaaggtcacggacatcggtgactacgacgacgacttcccagacgtgcgcccccgcttagccagcatcgtcagccctagcctgacctctacgttcgtgcccagccagagcgcgaccagcactgaaacgccgagcgcaagcccaccctccagcacctcctcgcataaaagtttccctaaaatatttcagacatttaggaaagacatgtctgaaatgagtatagatagaaatattcatcgcaatttgtctccaggaattccagtatcagtacaaacagaagaaagttggctccaagatttgtctgataaagtgcaatcgaggaagaaagcctctaaagagaaagctgaacctgaatgtctggcatctaagttaagagaaaaatgggtaattaatccagaagagtcgaaactaaatattttatatgagctggagtttaaggaagacttcataacactgttcgagccttctctaagaacgttacccagcatcggaccaccatccattctggcatacaaagaagagagctccaatttaggcattaacttcaaggatgaagaggaggagacatcacccaaatgtgaattttgtggcagcgatctaagagcatttttttctaatgtggatgtttcctctgaaccaaaagggcatgcctcctgttgtattgctttccaaaatctgattgactatatctatgaggagcaaataaaaaccaaaccccctaaagctgaattaattgctattgaccctcatgcagcccatggtagtgaggtcgacagactcaaggcaaaagaaaaagccctgcaaaggaaacaggagcaacgaatggccagacattttgcaataatatcaagggaacagactcatttctctgaagatgattcaaagcgcttaaaaacaatttcttatcaactttctgtggatattccagaaaaacagataattgatgacattgtatttgattttcaactaagaaacagtaacatgtctatcatttgttgtgattctcggatagcatgtggaaaggttgtcaggaatgagctcttagagaagcactacaaacatgggagcaagtttctgacttcatttccagatgggacaacacaaatattctatccatctggaaacctagccatcattcgagtgcccaacaaggtaaatggttttacttgtatagtccaagaagatatgcccactaaccctgctatcctagcagtgctggattcctctggcagaagttcctgctatcatcccaatggaaatgtctgggtatacatcaatatcttgggaggtcaatattcagatcaagccggcaacagaataagggcttggaattggtcaaattccatcacttcctcaccctttgtttcatttaaacctgtctttctggctttgaaccgttatattggagtccgcatcttagaacaagacaagatttctataacttttctagcaatgggccaacaggcaagaatcagtgttggaaccaaagtgaagctaccaaaccctgaggagattccaatcctccgatacgtaagtggagatgaccttcttctgctggccagtttaataaagatccgtcgcctgtttcataaacttgaaggatgtgtgaattttccctcaagccaggtttgggaaaaattaaagcaaccttcctacctttcttcactttctctaaaactaattgccctttgtcacagttctggtataaagcaagatataatgaagacaataagaaatataataaatgaagaaatttaact

SEQ ID NO: 3536 - DNA, 2421 bp, Homo sapiens
cacaaacgccggggcctgagatcgcggtggatgcacgcgcgggagcctggcttggctgttattgttgaaaactctcttggcttggactcagtttaccccctgacattgataataaagtgacgttggctgctgcagaaggagttcaccacctacgacttccccagcatgtctgctgaaaataatcagttatcaggagcatcacctcctcaccctcccacaactccccaatattccacacagaacttgccttcagagaaagaggatactgaagtagaactagatgaggaaagtctacaggatgaatctccattttctccagagggagagtctctggaggacaaagagtatctggaggaggaagaggatctggaagaggaagagtatctggggaaagaagaatacttgaaggaggaagagtatctggggaaggaagagcatctggaggaggaagagtatctggagaaggcagggtatctggaggaggaagagtatattgaagaggaagagtatctggggaaggaagggtatctggaggaggaagagtacctggggaaggaagagcatctggaggaggaagagtatctggggaaggaagggtatctggagaaggaagattatattgaggaggtagattatctggggaagaaagcgtatctggaggaggaggagtatctggggaagaaatcatatctagaagaggaaaaggctctggagaaggaagagaatctggaggaggaagaagctctggagaaggaagagaatctggatggaaaagaaaatctgtataaaaagtatctgaaagaacccaaggcaagttattcatcacaaaccatgcttcttcgtgatgcaaggagtccagacgctggcccctctcaggtgaccaccttcttgactgtcccgttgactttcgctaccccttctcctgtctctgaatctgccacagagtcttctgagttgcttctgacattgtacaggaggagccaggccagtcagacagactggtgctacgacagaactgccgtaaaatctttaaaatcgaaatcagaaacagagcaagaaaccaccacgaagctggctccggaagagcatgttaacactaaagtacagcaaaaaaaggaagaaaatgtcctggagtttgcttctaaagagaacttttgggatggtataacagatgagtccattgacaagctggaagtggaagatttagatgaaaactttttgaacagctcctatcagacagtatttaaaacaataatcaaagaaatggctgctcacaatgaactggaagaggattttgacattcccctaactaagctactggaaagtgaaaacagatggaaactggtaattatgctgaagaaaaattatgaaaagttcaaggaaacaatcttacggattaagaggagacgtgaagctcaaaagttaacagagatgaccagtttcacatttcatttaatgagcaaaccaacacctgagaagcctgagacagaagaaatccaaaagcctcaacgtgttgttcatcataggaagaaattagaacgagataaggaatggatacagaagaagacagtggtgcatcaaggtgatggaaaattaattctctaccccaacaagaatgtctatcaaattctctttcctgatgggacaggccagatacattatccatcaggaaacctggctatgctcatcttatatgcgaaaatgaaaaagttcacatacatcattctggaagacagtctagaagggaggatccgggcccttatcaacaactcaggcaatgctaccttctatgatgaaaatagtgatatctggttgaacctgagctccaacctgggctactacttccccaaagacaaacgccagaaggcctggaactggtggaatctgaacatccatgtccacgcaccccctgtccagcccatctccttgaaaatcaatgagtacatccaggtacaaataaggagccaggataagatcatcttctgcttcacctatgaacagaagcagatttgtttaaacctgggcaccaggtacaagtttgtgatcccagaggtgctgagcgaaatgaagaagaaaaccatcctggaggcagaacccggcccaacagcccagaagatccgggtccttctggggaaaatgaataggctcctgaattacgcgaccacccctgatctggaaaacttcatagaggccgtcagtatatcactgatggacaacaagtacctgaagaagatgctctctaaactctggttttaaggcggggcttatctggcatccaccaaatgccttaggaagttggagaccttgggagctccagggaaaaaaaacccaaagacctgttgaccttttatgagagttggtttgtaatttgggacctgtcgtggctccttgatttgaagtaaacatttttggcagaagggc

SEQ ID NO: 3537 - DNA, 946 bp, Homo sapiens
gcaagcgccgcctccgccgcgtgtccggggtcagcccgagcccgtgcgggccctttaagggccgggggcgtgtagcgggcccgccccctccccgcggcgcccgcagtccgttaagtgcgagccccggcgcaggggccggatctggccgggggccggcggcggtgtgggagcggcgcgtcatgtacaccatcaccaaggggcccagcaagctggtcgcgcagcgccgcacaggtcccacgcagcagcaggtggagggccggctcggcgagctcctgaaatgccggcagcccgcgccgccgacctcgcagcccccgcgggcgcagccctttgcgcagccgccgggaccctggcccctgtcgagtccagggccaaggcttgtgttcaatcgtgtgaatggccggcgggccccctccacgtccccatccttcgaggggacccaggagacctacacagtggcccacgaggagaatgtccgctttgtgtccgaagcctggcagcaggtgcaacagcagctggatggtggcccagccggtgagggcgggccaaggcctgtgcagtacgtggagaggacccccaatccccggctgcagaactttgtgcccattgacctagacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtc

SEQ ID NO: 3538 - DNA, 807 bp, Homo sapiens
ggatctggccgggggccggcggcggtgtgggagcggcgcgtcatgtacaccatcaccaaggggcccagcaagctggtcgcgcagcgccgcacaggtcccacgcagcagcaggtggagggccggctcggcgagctcctgaaatgccggcagcccgcgccgccgacctcgcagcccccgcgggcgcagccctttgcgcagccgccgggaccctggcccctgtcgagtccagggccaaggcttgtgttcaatcgtgtgaatggccggcgggccccctccacgtccccatccttcgaggggacccaggagacctacacagtggcccacgaggagaatgtccgctttgtgtccgaagcctggcagcaggtgcaacagcagctggatggtggcccagccggtgagggcgggccaaggcctgtgcagtacgtggagaggacccccaatccccggctgcagaactttgtgcccattgacctagacgagtggtgggcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtc

SEQ ID NO: 3539 - DNA, 1226 bp, Homo sapiens
acttccggcggggcctcccagctggaagaggcggtggcggcgggtcggggcgagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggtgcgaggtgtcggttccctcctgtcctgtggtcctgcccctgggatgggggtgccttgctccagcgggctgcagatcccagcactggcgtgactgacggctgaggcctgcctctccttcccaagcccccttccttcatccttgggggtctcaggctgcccccatcatgggggtctgggccctgcccaccctcctgccctcccccagccacctggctgcatttttgaagctgcctggcccccaggggccctgacctgacctctctcctctcccctcaccctcctgcccctggccactgcaggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactggg

SEQ ID NO: 3540 - DNA, 925 bp, Homo sapiens
acttccggcggggcctcccagctggaagaggcggtggcggcgggtcggggcgagaggctgaggggatctggcggtggagcgctaggatcagacgcccccgcgatgaccagctcccccgtctccagagtcgtgtacaacggcaagaggaccagcagcccccgctccccacccagcagcagcgagatcttcaccccagcccacgaggagaacgtccgcttcatttacgaagcctggcagggtgtggagcgagacctgcgaggccaggtgccgggtggcgagcggggcctggtggaggagtatgtggagaaggtccctaaccccagcctgaagaccttcaagcccatcgacctgagtgacctgaagcgccggagcacgcaggatgccaagaagtcctagagcgcccggtgcccctccccggcctccggaagatcagggatcaggaggggagaagaaggagcctctgctgcctcccaggctgctgggactgggctggttttgtccttgaagtggtcaggatacaggacaagggcagccccaccccatccagcctgggctccccgcagacccttgctgctcccgtggcctggacacgctggggagcttctcacacctacccctaccgtccagcctggcctcttccctgaatcagcttcaagatggcaccagctctttgggcctaggatactgccgggccccccaagggggtccccagcaaccaggcctggcctcctggtgtctgcggtcacagtggcccctgggcaggggcacccaggctgaccctgaggtgctgctgctgggtctgtcttggctctggggtgtgctgggagggtcaccaggtcccttttccttcctgtgccctctgaaagctaagtgtctgtgtggctgtggagctcgagggtctgtgaataaaggcggcggcactggg

SEQ ID NO: 3541 - DNA, 4403 bp, Homo sapiens
aagtccccggagccgaggcttcctccgcgtgagcgcggcgagtctggccgcggatgccctgtccggagtgctccgtgccgccccaggcttgccagggtccgcagcgagacatgcccgagccaggcgctgcatcgacctcgacttatctgtaagcagcggaagatcctgaaggcactaactaaggtatctccaggcaaccaaggatcttacctctcacattgagaaaaaccataacttcagagacatttcctggctccaaattcaagtcctttcagagacccctctactaattattttccagtaccactctccatggaataaaaggagttgcaaacatggcctttgtagatgcagggaaacccacgttccttttagagctgatgttaacccatgagaagcgaccacccctcgacgacttctccttcacggttcccacccaggagcacggccaactctcccccggaatccataacggctcacgcaaatagatttctttccgttcctcctcggagggctctccacatttatctgctcgagacgtggcagctccagaaccatggtcagtaaggacaccggcaaatgcatactcacaacgtcggagagtgaagtggaacccgccgcctgcctggccctggagatgaaatacgccctggaccccaaccggcagattaaaaaacggaacaaagccctgcaggtgcggtttaaggatatctgcgaggcacagaatgagcagagggacacacagctgtcctcgggccagctgggggagaagcgggaggccaagcccgtgtcctgcagagcagcctaccgcaaatacatgacagtgcccgcacgcaggtccatccccaacgtcaccaagagcacaggcgtgcagacctcgcccgaccttaagaagtgttaccagacgttccctctggaccgcaaaaaggggaacctcaaaagcctcccagctgcagatccctttaaaagccaaaacaatgggtttctaacagatgcgaaagagaagaacgaggctggacccatggaggaggcccggccatgtggcgcggggcgggtgcacaagaccacagccttggttttccattccaaccaacacatgaacacagtggaccagcctttgggggtcaactgcacagagccctgtaaaagcccggagccgctcagctatggagaagctgcgctccaaaactccactcggcctccatccgaagagcccgattaccagctgctcgggagggccaagcaggaccgggggaggccaaactccgaggagcccgctccacctgccctcaggagggtgtttaaaacggaggttgccaccgtttacgcacctgccctcagtgccagggcccccgagcctggtttgtcagactctgcagccgccagccagtggtcactctgcccggcagatgacgagcggaggagagccacacatctcaacgggctccaggcgccctcggaaactgccctggcctgctcacccccgatgcagtgcctgtcccccgaatgtagtgagcagccgtcgcagactcacaccccgccggggctggggaaccagcctagtcccacagcggttgctgcaggtgaagaatgccaacgaatcgtgcctcatacggaagtggtcgacctcaaagcacaacttcagatgatggagaacttgatcagttcaagccaagaaaccatcaaagtgctcttgggggtcattcaggagttggaaaaaggagaggcccatcgggaagggctttcatatcggacggggcaagacacagctaattgtgacacatgcaggaacagtgcatgtattatctatagtgtggagctggattttaagcagcaagaagacaaactccagccggttctaagaaaactccaccctattgaggaaactcaggtcataccttcgccttactctcaggagacttactcctcaactcccaagcaaaaatccaaaactgaatctaaaaagcacggaagatggaaactctggttcctttaacactcacggtgtctggagtctcgaggccgtctttagaacccactggagtttaagtcaatacttttccaaaatgaataggatcgagggaactgtggtgcccattcaggcacctcccacttctcgccctgcgtaccaaaaaggcctttgtaccaatagataattaacagaagcaaggtattctgtgtcactccttgccagctgttctttgcagttcactgatgtgggatgtaaaatctgaaatgaaacttacgtagtcaaagatgataagtaaaaattttcccccacccccgatctgcaagtaatacattatcaacctgcgagatggcaggctgtcaccctgtacacagctataactcataattattttcaagccttgattttttttttaaataatgagaagaaaaagcaagccttatgtttgcgaaggacttcatttttatgtttcattttgcaaataagcagggggcgagtgcaattttcagcacatcaaattccggagaaagcacaattttttcaagtggtcggagaccatgaataatctctaaaatgtgactatatgtatatttgccttcatgtgctatagcgctaagccaagtgaccacatctcagtgtcacaacgacacctcaaatttagcatcctcttcatctccagacttacgacatgtttactgctcattttccaaatggccagcagccaggagtcccccaaagtcaggatatgcctttaatcactgcaagtagacagggtcagagctattggacactaagttttcttagatctcatttttaatcttttggtacccaaaggccaaataatacattctggcaagaatctgagaacatacatagagatacacgatggataatccacccaccaataaatcacaggcattctgtgccatggcagacagtgtttttgtggatcgatcctccgagacactgttagccatggtaagtgcagccagacgttatgtacaattcgttatgctttgtattaatggtggaagccctgaccatctcaaagagaaacagtgcgtttagtttagctgctaccaagggacaatgtcgcctacatttaacctattagtaagttgtactaaacaacatacttaggggaaagctgtgaatcaaatgtttttaggtattttttaaatcaacagtaacacttagagttctctcttgattacacattgcaatgtaaatcttagttcctttattttttcactcatttctttgcacctttgcaagtatctttttatagaaatcaaatcccctagtctattaatgactttgtctatcaattttttgattttcacaataggaagtagggatcttactttgcctttttttttttttttgtacaacttaaattttgaatagtttgtgagcatacaggaaaacctagtcttgaagtttctgtccagcagtttcacatctagtggagtgctgacatgcacacctcattgactagatgccaaacacacagtggctaaccttggtaaaaggatctcacctgcttttgtcagattggagctgcttcttgccatgtattttcctcctgactcaacagcaaatctgttttagttctaagtgttttgattctacaaggacctagtgatcagtaaccagatcgggccttgaaaaaaaaatgaagagtatgtcgtgtaaacattcttcgggggccaaacaacactgcagttgtatgctttaatttaaaacacacatgtgcacacacacatcctctgcggaaacactatatgaagttcgaatccctgaatatcaataaaaggaactgagaaatattttggtgcaagaacaatgaggaagttgatcctgtaacatgaaggaagtgtaactgtttcacgtagactaaatatttaaaaatgggtttcatgttttttatactgtttttaactaaagttataaaaatgtttccaacaagttctctctccttatgttttaagaatcccaactatctcagtaaattgaaataagggtattagcagttttctaattagtaacacaaatctgtctaaacaagaggacatcctagtacacaaaataatgtcactgtttcacaccagtctagaccaaaaaaaaataaaattaaaatgttcagagtcaaaaaggaacttctgaagataaattaattcatccctaaaaattaaagtgtgttcaaaatagaaaaactattgtcaaaatcatttcatagtttaattgcaacacgtcactaacagatggtgattcttctcttggaaagattcaagtaaaaacgctgatacaaaagcaaggtaaaacgcacagggttcccttatgtagatgtacacatggcattgcatatagagattaaattattatacttgtcgttaagttctttattaatttttaaataaaaaaatcaaagatg

SEQ ID NO: 3542 - DNA, 2999 bp, Homo sapiens
gctaatttaaccagctcccacttaaatcaagaaataaccattattctcgtttctacctccagccaggccaaatgcaagaaaggagaaaccttagcatttgtggggtgtaggagtgtgtgtatatgcatgtgtgtgtgcctgcatatgtgtgtgtgtgtgtgtctatacacacacaggagcgtgtgtttcctctgctccatctctcctctcccttccttaaagaattcagcctgtggccactagaggtcttttcttttcacatggtagctgccgagcagtttgttcggctttttatttattcctacgtgagcagacccactacacttcttgcatataaacagtgaaaattacaatatgaaggacttattattccttcttttggagtaattttgctgctggtcaaagcctggctcattgtgcaaggaagggggaccatcctctgcaggtaattccactgcttcaaggtgctcctcgcctgcttgcagatatcagaccccagctcatctcagacctcagcccctgaggccaagcaaacatacatcatcatggaggctgcagacgtagctcaccgtgcccacatgtgaacttcggccaacacaccacaacagggactctgcccactgaatcccctgtgattcctcaatcctgtcctggtcataccccactgggttttgtgaggctatttaggaagataagtttccctcactgaagaaaagagagacagcatgaaagaaaacaatggccccaaaggaggaatttgtgattgacataaatgggaatgttcccttgggagcatcatgtatcatcaaacaagcaaacctccaggtcatttatttctccacctgtttacctgctatggaaagaagatgcatttaagtttcctgcagtttcaccctggaaattaatgctctgggaaacaaaaagctgtatgttctagacgtagcaggtttcttttggaattcactcattgggagtctggcactaccccctaaatggtacttttgttgtctttttgttcaagacagccagcttcttccaagatcagaaccgcgtgccagcctcccttgataaaccgcctaccagctctcttggtagatcagatgtttaatagttagcctaactcatttgtttttccaaggagcaattatgactacaatgaattaatattttaactgcagggaaagcattacagatagttcctacgtagactctagaggctgggaatggccaacaggatttcccatactaagaggagaggaccactccatcctggccagcagttctctatgattgaaatactatcattagatactgctccaaagacctaaggggagatgtgcctaggagaagtgtatggtcctgatccttcccactgaggctcaatggcccagcaaaatatgaaagtgagacctgtgcttctaaagcgtaacagtctagaatcagtggagtttgtgaaacaacctcaccaccgcaggagcaaatcccagcaggtgagattcaaggaagatgggaccactaagaatccaactggcctagctgaggttgacgtccaaactccagaagacccggctgtgatggggaagactcaagcaaccaggcaccatcttccccccacctactcgctctccttccccaggtcccagaaggcagggggctttcgcaacattgcaatccaaacttcccccagtctcaggaagcatttcccagttttcaaaaggaagagactcacagccagtaagtccctggtggaaatgccaacagcctcccaaagtgccatccaggtcaacggtaacctctctgaacaggacattgtgtcttctgaccttgcctacttaaggttggctcagcatcttgaggatgggcctcgaagggtcaaggtgtcccatgcattcctcccaagggtccccaaggtgcaaagcaatggtcctgttagcatatgcttggaagcaggaacttggaggtccttagagaaagccacagctgccattcaggttccagatgatatttatcacagtccttcctgggaagctagagagtctgctctcagcccagacaggtcagctgaagtaagtaactccatacaccctttggatgacacacgtccaggtgatgggagaagggtgactccactagattcagaaaaatccacctcctgcttaaatgccaccagcgttgccagccacacaccaggcacagaggaacttaaacctgaattgcttttgcccaaagacaactcagatgacaaagaccttggctcactgtcatctcagtcaaaggaaacgtgtgttccttcatctccacggactcacagttccccctcacaaggctcccacagccagccagcccacccaggaagagcctcagactgtccttcatcaagtaacaatcaccagaatctggtgtcactcaaaactaacagtgcatcgaaatctgcccctgggtgtcaggagcagacggcaaacaaccccaccgagtcagacacactggagtttccaaattgtccaggaagtaatcatctcccatcctctctttcaaggagtgagaccaaacttcagagcaacagggagattagtgacattaatcaaattcacctggcacggggtgaactctgcgacctccaaggccgactgcaatctgtggaggaatctctgcactcgaaccaagagaaaattaaagtccttttgaatgtaattcaagacttggagaaagctcgagctctcactgaagggcgcaacttttatcgaactggccaagatctcaacaattgcagtacctgccagaacacggcgtgcatcatatacagtgtagagtatgattttcggcagcaggaaggcaggttccatgaagttttgcagagtctggaggaagcagagccagttgaggaggcatcgcccccaccaaagtccccagcagaacccccagccccggaaaagcaggacttaaggcggaaaaccaagaaggtgaaaaagaaatgcttctggtggatctgagctggttgg

SEQ ID NO: 3543 - DNA, 7457 bp, Homo sapiens
cgcaccccggcaagcagcagcgggccgcgacgcccagcctgccagtgagctgcgacgggcacaccccggagcgtcggcgactgcggacaggttagagtgggggcaggggcgggcgcgggagcagcccagggccagagagggagcccgagccaggccatctccaaccatgtccgacgaggcctcggccatcacttcctacgagaagtttctaacccccgaggagcccttcccactcctgggacctcctcgcggggtgggcacctgcccgagcgaggagccgggctgcctggacatcagcgacttcggctgccagctgtcctcctgccatcgcaccgacccgctccaccgcttccacaccaacaggtggaacctaacttcttgtggaacaagtgttgccagctcagaaggcagtgaggagctgttttcatctgtgtctgttggagatcaagatgattgctattccctgttagatgatcaggacttcacttcttttgatttatttcctgaggggagtgtctgcagtgatgtctcttcttctattagcacttactgggattggtcagatagcgagtttgaatggcagttaccaggcagtgacattgccagtgggagtgatgtactttctgatgtcatacccagtattccaagttcaccttgcctgcttcctaaaaagaaaaacaagcaccggaatttagatgaactcccttggagtgcaatgacaaatgatgagcaggtggaatatattgagtatctgagtcggaaagtgagtactgagatgggtcttcgggagcaacttgatattattaagatcattgatccttctgctcaaatctcccctacagacagtgagtttattattgaacttaactgtctcacagatgaaaaactgaagcaggtcagaaactatatcaaggaacatagccctcgccaacggcctgcaagagaggcctggaagagaagcaactttagttgtgcaagcaccagtggagtgagcggtgccagtgccagcgccagcagcagcagtgccagcatggtcagttctgcaagcagcagtgggtccagtgttggaaactctgcttcaaactccagtgccaacatgagtcgagcacacagtgacagcaacctgtctgcaagtgcagcagagcggattcgggattcaaaaaagcgatccaagcagcggaagttacagcagaaggccttccgcaagaggcagctgaaggagcagaggcaggcccggaaggagaggctcagtgggctcttccttaacgaagaggtgctgtccttgaaagtgactgaggaagaccatgaagcagatgttgatgttttgatgtaataagggtgaatttatcaacgttctttgtgagcattaaaatactccatccttatgggtttacatgcatcttgaccaaaattttggttagggctgtgctgatgtaccattaataatttaagccagtggttcttggcaggtgatcccaagacctgcagcttcagcatcacttgagaagttgttaggaatgcatactagtgggccccgcccccagacatagtgaatcagaaaccaacagggaggcgcctagcattgtttttttaacaagtgctgggttattctgatgcacagtctagtttaagaaccactactttgggtaaacgttttgactgtttaaagtttatggcggtgaagtgggcgtcttcaaagactagtacttacacagtttagaagatttcaaggtactgctgacagtagtttattatgtcagtatacatacatgtgtagagatcataatttagttcccttcttaatgttacaatttcttagtttacttttcctaaagggccatagcataattcttgattcctggtggaaatcttttctgaggtgtgggggtgggcaaggtgtggattgctgtttacgatagtgccttcattagttttagttctgtctgttttcattcattattgactcaaaggtattagaacaggcccttatctttttcctattagatttatttttgttttttactttatgtaagttcagaatccttttttaagtgatgactactgatgaaataatgttactagtagctgaattttagacttgatgctatgttgattaatatttaaatggtgaaagtaattaggcaaaataagcaattctgcttttctgttgctttcagaatttttaggctgtaaaattgtctcaggcaggaagtcagtctatatctctctcaagttcttattgtaggtcatttttttttcagcacagctctaatttttaaatatttggtataacagcttctggcatgtgacctagttaatgttgaaaattaactgatgaaaacccttgtagatctgctaaacttctctataaattgctagaaatatacagagcaatgagatatagaaaacaccttagcttgttggttattaatagagctctaattttaactgtgaaatcatggagtttctttaaatgttttcctagagtgtttgttatcatgaacattagaaatagcattattccttttcttctaccacatgtcttgaacattcacatgggttaaagaagatggaaactgatactactgacaatcaagctgctttctgactttcataattttctttatattgtggatagcattttgaaggtgaccgtgattctgtaggaagagctgtaatcaatatttttcaaactctaagagtacagaggttagtaagatttcttttttttttactttttgttacgtcaagtagcttattaagaaaaagattcatgacttaaattcttaattctcagttgatacaaaggcttataatcatgtgttttaaaattttgatttcattttcgttccttgaaggttaaagaatggaaactggggataaaaattaatacactgcagctttgccaaggtctgtgatatggttgtaaccttttaaagactactaaagtcataatttgaaatttttactaaaataaaacatatgtgtctatggttttcaattggagtagtctttcttactttcccccttcccctctttggttctcctaaccagcttagaggacccaaagagagcttagggatagacaccagaatactctgtggaggtggaacaacttaacctcactgttttcccttccaagtataggaagagcaaatagagcatagtaactgtatctaaattctctacctgctcttagcaaaagcaaaatcccacagaatgattgcctgctgtctttacctattcttcaaggaaaacaggccacttttggagaccatagagcaccatttatctgtcaaatacttggaaactatttacttaacggtcatcagtaaaaaaccctaaacaaggtcatgatataatttaagaccaattcccctactctcccaataatcacatagtcttattactttcaatttaacttgagtcactattaagcaagtttaccaaagtgccacaaagttgatttttaacgtttgtaaaggtttgaatgtttatagaagtgcatcatgaaattttgtgtaaatccagatgaactgtcattatagtactataaattagagatagtccataaagttgggttgaaggagattgaaaatatttcctttgattaaaagaaaataattaactaacttgggcttgcttgtgattgaagagggagattagatagtcctctgtccccccaaaaaagaaactagcagagaaagacataaaaagctctttggtgtctgttcatgtgctgtacattttttccgttttaatgtcttgtgtagataattcaaagtttgaactatttctttcttggaataagtaataatttattcaatatggtgtatctctgagttcaatttaaaacaatccaactcagtaatatttatttttaaatacaaatcctaactaaccaattaattaataaaaaggcaagacttacttgctgtagtattggttctcatctgtagagaactgacattggagcaaattttaagtctcccctttgaaaataagccttgttaactgagggcgtaatacatttcccacagatttatccagaaacattttattagagatcttatagtagtatctcagttcctactacagctttctaaaggatgagacttgcatttaacaaaatgacatatataatatttttctatagttttgcaactgaattaaaggaaggtgatgtattataatgtgtagtgaggtataaagggctagttcattctctcccaacaagaacttagaataaaataacacttttttttcatgagacttacctcatttttgttaggctatggcagttttgtccagttcctctgtcccttgagtgaattagatattggtgaattaatctcagaaactgacctataaaataatgactcattatagattgggtgaacttctcattttatttagcttttaaaagtgctaaatcctctcataaaggaaaaattataggaaactatagcggtatccagattctgatgagctttaaaaattataaaatatagcaaatgtcttcatattttagccagaaatattagtacacaaccaatatagaagtcttgtttgtttctgggttctccagcagagactttttgtttgtggcttactctgtatagcctcatgtgccttaaaggtggtgaactctagtttttgtcaatatcaggcttttcaaaactcaaaaacaatccaaatgttgtaatttgttttgcataatgcccatggaattggatatcagtaagcaaagccattaaatcgaaccaatcaatgctaatagagtataaaaacaaaaaccttcaaattttaagtttcatttgtgtaactttattttcggcctagctagatcattgaagagccttgaaagttatctaaagtatggcttaatgtatttttttccctctgaaaaagatcatatgccaggatacttcttcaaaccagatcacttttaatatctagaaagataattttcaaggtataggcaaaagcacttcaaggacagagattatgtagcaagttgattctctaggaattctttgaactcatttgtgtaatagctggaacacactcctcttctttcctttaacaaatgaacttttagcacttctgtcttcaaggaaaaacatttgtttggaattgaagggtactcgcagtccgtttatagtttgggacaattaataggaaaatccccagttgcattcaaataatagtgttgatgttgagggcactgactcattcagcatgtctgaactagaagtaaatttaattctgaaaggactgttagttaggaaataagtatttgtatacatatgtactgtggtaactttggattcattttaagtctgataaagtaagataaactttgtcttaaaaataaaattatgctaagtgaataaaaactgagatattttaagctaggcatctttgttagcatagtatccggaacataactacttataatgcttaggtcttatttctttggaaaataagttacttattccagaagccttagaaggaattctgaaaattcttctaactggccattaagagtaaggaagttgaatggtactgctgaagatctgagttgactcactgaaattttattttcttatttttttaacattaaaattatttctttttggctctccctctagttattttttaaattaaggtaattactgttttaacctagagcatataatggcaaattaaattttaatttgacactcataccgaactcagaaaagcttgtttgatcttctctaaattctgtatgtagtactttttttaattgtcacatttctttgttacatctttgtgtccaacaaaacctgtggaaatctgtgttcatttttgtggtgagggatgggggtgaaaaaggggagacttgctctaattatgcatatacatttgactatgtaaaggtagttgtagactatatgtataaataacaagttaacacttaatattctaaattgttctaaggaacagtggcctgaagccatgactagttttgtggagctgctggctcttttaacagtagctgacctattggatttaaactgagactgaaattgacatttgtggttaggttatctagctgaggcttttaacaatggagcagataatgtctgttcctgtagtggatccatttaatttcctatttgagtactctcacttaacaagtattatctattctgaacctttgtgttgggaatttaaggactattgtcaaaggctattaatggtaaacaagtatatgcaaaacaattcacatatgggtaaaaatttcaaattgtgggtttttgtttttgctttttagtttcaaagattagttatgtagcagcaatatcataaccaaagcaagtaggaagttgactggtttggagaatcttcaagtagttttaaatactgtaatgtatcagattgttaaccaggatttttttttcctgtattactgctaaatatattactatattaatgcacttttgtatatataactgtcttctgtacattctgtacttactacagtgtatataaagcctgttttccctgaagctgtgagggaataacaatagttgtatcataagtcgtttctattttgagttccttcttgtacttgaaagtagttcagtagtgaaatctaaatgagtgtgtatggttgtaattaaaactggcaatgtggcagagctgtcttttgaaactgaataccagaatgaaaagtgttgttttggttaagaactcttataatatattatttcttttgatgtaccctgagttgttacacagcccactcactgctgcttactactttatacttctgagtcagctcctttcatgctctatcccagaatatttaccaacagaggagaactgctcccttttctgtttctcacagtttggttatggctttataaacttttatttggtgaaagccccagatacccaaatgtcattggcaaaacttatttttttttctggacagatcagatttctagagagagcagatttctagagagattagcattcatagtaagtgaaaattgtctaatttttttaatccatgctattactgggcagtaggtctaattttttttgacaaaaaatagatctattttccttatatattgatttagaatcttaagttagaattttatagaagaaatgtctgagcagttctatgtatggaggagcaattcagcttttcagcagcaactttatcttttgccactagagggagatctgtggttgctttctcctttggagaatagctgctttgcttttatttttaatttctaaggttggaatagaacttattctcaaaattcctttagtgttattaaatattttcatttattagtcaaaggtaagttaattaagcttgtttaatgatgccaatcttatgcttttctgtaatcttcaatttttaataaatgtgagttagatactaagtgaaa

SEQ ID NO: 3544 - DNA, 2962 bp, Homo sapiens
ggagggaagtgtggggagagcagaggcgcagctctgctggagagacctgaggcttgcagcgctgggcccggccgggtcgctgcggctgggctggaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaaggtaccaacacagcaaaggcacaaaatgtctctatatcagtatttttcatggtatatgtgagacccattagtgaggcatgaaatcaattctgtgagtcacaatgaacatttgtctaaaaaacaaaataaaatgtaaaataccaaagtgttttgcatgaatcctttgcctgaattgtgcacattgcaaggaatgctgaggtcaatttcaatatgcgagaggggtatttgatggaggagatatgatgaatagaatgtatattggctaagaaatggttttcagtcattgattcctgggtgtcttgcttgattttcataatagcacggttaatgttctatagtcaagttttatattacaattacttgcaactagttgtgaagtctgaaatattcgattcaattgcaaactttgagtgtagtttttgaaaagatgttatttagactgtatatttttttcttcttttttgagttagtgccaattataacattttaatcaaactggaacaaattgctattaaaatggatcatttctttattaaaagaaagaggaatagtgaagtgaaatatacagaagcatgttcaagttcatctgttgaatctggaattgtgaatagtgacaatattgagaaaaatactgactccaatctgcaaacttcaacttcatttgagccacatttcaaaaagaaaaaagtaagtgcaagacgttataatgaagattacttaaaatatggctttatcaaatgtgaaaaaccctttgaaaatgacagacctcagtgtgttatttgtaataatattcttgcgaatgaaagcttaaaaccttcgaaattaaaaaggcacttagaaactcagcatgctgaacttattgataagcctcttgaatattttcaaagaaagaaaaaagacataaagttatcaacacaatttcttagttgttctactgctgttagtgagaaagccttattatcatcatatttagttgcatatcgtgtggcaaaagagaaaatagctaacacagctgctgaaaaaattattcttccagcatgtttggatatggtgcgtacaatatttgatgataaatcagctgataaattaaaaactatacctaatgataacacagtatctcttcgaatttgtactattgcagaacatttagaaacaatgcttattactcgtttacagtctggtatagattttgcaatccagcttgatgaaagcactgatattggaagctgcacaacacttttagtttatgtcagatatgcgtggcaagatgattttttggaggattttttgtgttttttaaatttaacctcacacctaagtggattagatatttttacagaattagaaaggcgcatagttggccaatataaattaaactggaaaaactgtaaaggaattacaagtgatggcacagcaaccatgactggaaaacatagcagagtaattaaaaaattactagaagttactaataatggtgctgtgtggaatcattgttttatacatcgtgaaggtttagcatccagagaaattccacagaatctcatggaggtattgaaaaatgcagtgaaagttgttaattttattaaaggaagctcattgaatagccggcttcttgaaacattttgttcagagattggaactaatcatacccacttactatatcataccaaaattcgttggttgtctcaagggaaaatactaagcagggtttatgagctcaggaatgagattcacttttttctcattgaaaaaaaatctcatttggcaagtatttttgaagatgatacttgggtaacaaaattggcatatttaactgatatttttagcattcttaatgaactgagtttaaaactacaggggaaaaacagtgatgtattccaacatgttgaacgtatccagggatttcgaaagacattattgttatggcaagtaagacttaaaagtaatcgtcctagctattacatgtttccaagatttttgcagcatattgaagagaatattattaatgaaaacattttgaaagaaataaaattagagatattgttgcatctcacttctctgtctcaaacttttaaccatttctttccagaagaaaaatttgaaacattaagggaaaacagttgggtaaaagatccatttgcttttcgacaccctgaatcaataattgagctaaacttggtgcctgaagaagagaatgaattattgcagcttagttcttcatatacattgaagaatgattatgaaaccttaagtttatcagcattttggatgaaggtaaaggaagactttccattgttaagtagaaagagtgtcctgctattgctaccattcacaacaactagtttgtgtgaactagggttttccatcttaacgcagttaaaaacaaaggaaagaaatgggctgaattgtgcagcagttatgcgggtagcattatcttcctgtgttccagactggaatgaacttatgaacaggcaagcacacccatcatagtaaataaaaatcttacctagcttttgtctttgtatttcttattttgtagtatttttctatgttatatttaaatggtactataatactgtgatacttttgttatgttttaatttttgttatatttaataaaattattttatgttcattgaa

SEQ ID NO: 3545 - DNA, 3437 bp, Homo sapiens
gagtgcacctggcctgagagcccgccaggccctgcccctgctcggctcctcgtctgctgaagctcgggacctctagccagtggccctctgcagccacggggaatggggctgagagccggttcccgctgcagggcagaccacctagctcagccgcagccacagggacatctggccccggttctgagatgtggggagtgctggcgggctcgggggttgcctggaggctgctgcctgcacacagaaggcggatgcagcttgggtgcccaggcgggctggaggacagcgggctgggaagccaggggccgccgggacctggggctggaaaccacatctgcccacagccgcagcctcctgcacctgtcatcctggcggcgccctgacgtcggagaagcagcaggcgcggagctcctgcagcgggcaccgctgcagcaacccgacccggcgcaggcggcagtggaaggcggcctgctagcacggctcccgcggccccaggaccaggggtgcggccagcaccgccctcactccccgcgtctcgtggatattgccctccctggaggcggctggacctaagcgaggctcgcagcgatcggccccgcgaagactcgcatgcagggctcaggatcccgcattctggcgccgcggcaccgcacctttcagcagccctgctcctcttcttgttggtaaacttttgtcactctgccatgaaaagcatccaggcgtccttgatttcgacattgcgtgcacgctcagccgagctcatcagacgggcggttgtccccagagcccgcgggtagcttgttcccgggcggcggctcctgctggatgcagctccttgtgggcctaccaggcttggtggagccacagcagacctgtggagaggaagagtaaggcgggctctgcagggcagtgggccgggaccatgagagaggcgggtcagtctgggctccaagctcagcctctcggattccccgggacccacggcttataatgcgcttaaatcccacgcctcgcccgagagacagcacgtcaccgtcaccgtcaccgcctagcgcccctgacccgctcccactccgctgcagcggagggtgtgtgagggagagggacgcagggagggaaaagcgttgggagggcaaacatcttttcataagcttttccccttctatatgccatctctgatgggagcctctttagatctttcgtccatttactaattgggttgttcgatttcttattgttgagttgtaagtggtttttaatggtctggatgccagacaggtgttttgcaaatattttctccgtctgtggcttgtttctccattctcttatttcctttcccagagcaaaagtttttaattgtaacgacttcataccaatatcttctttcatggtagaaatttgtcttttatgtactttactgttgtatctacaaagtaattgccaaacccaaagttacctaaatatcccttttgttattttacagaagttttacagcttttggatttaaatttaggtctaaaaattgaattcataaaagtagagagtataatgatgcttaccagaggctgtgttgctggggagaaaaatgggaagttgttcacagatgcaaagattcagttaaaccggagaaatgcgttttgaaatctattgcacagcaggatgactatagtcaataataatgtactgtatatttaaataacaaaaagtaaatttcaaatatctaaccacaaaaaataaaattgaggtgatgggtattttttattttatttatttatttgtttatttatttatttttttgagacagagtctcgctctttcgcccaggccggactgcagtggcagggtctcggctcactgcaagctccgcctcctgggttcacgccatgaggtgatggatattttatcctcgatgtagtcattcctcattttatacacatatccaagcatcacattgtaccccataaatgtatgcaattgtggtttgacaatttaaaatattattaacttaaaaatgtgtcgttcgagttaatttttgaggagcaaggtctgtgtctcaattctttttttttttgcatatatgtatatatacatacacgcaatgtattcatcactgtttttgaaaaagctaccctttctcccttgaattgcctttacctttttgtaaaagatcaattgactgtgtttgtgcactcttatttctgagttctctattctgttccgttgatcactttgcaagtccttgaactttgttcctcccccacaatattgttggctattcttgttagtttgtctttctatataaactttagaattagtttgtcaatttccacacaataatttattcatgttttcacgagagttgtaatgaatttgtaaatcacactgaagagaactgacatcttaacaacactgggtcttattttgtgaatacagatgtcccttcatttatttagatctttaatccctttcaacagattttatagtttttctcacatagaccctgcccatattttgctagattgtgtctatttcattttcttgatgctaatgaaaatggtattgggcttttaatttcaaattctcgttgttcattgctggatgtaggacagcaattgattttgtatattaaccttataccgtgcaaccttgctataatccagaagggtttttggctgatgctttgagattctctacatagaaaatcaagttatcagcaagcaaagggcattttaatgctccctttccaatctgtataccttttattttattttcttgtcttattgcattagctaggattttagtatgatgttgaataggagcagtgagaggggataacatttccttgcttcttttgtgtaaaacatcccatttttcacattatgtatgatattgtctgtaggatgttcttttggtatatgttctttatcagttgaggaatttcccttctatttctaatttgctgagagttttaaccatgaatgggctttggattccgtaaaatgctttcttgatctattaatataatcaaataacttttcttctttagctagttatctgagggattgccttaactattttgtgttaagccaggcttgcatacctggaataaatctcacttggtcttggtgtgtaattcaacaatgtattgctagattcagcatgctaatattttgttgagaatttttgatgagagacatttgtctgaacatttttctttaaatgtctttttctgcttttggtattagaacttcataaaatgagttgggatatgttccttttgcttctgttttctggtagcaattgtaaataattggtatcttttcctccttaaatgtttcatacaattcgctagtgaaacaatctaggcctgttgctttctttcttggaaggttgttaattattcatatatttctatactagataaagagttatttgaatta

SEQ ID NO: 3546 - DNA, 2531 bp, Homo sapiens
gggccacacagcggacccctaagcggaccgctggcaccggtcgggtggcagcagagtgtcgctcgacatgggggaggccggggctggcgctggcgcctcgggagggccggaggcaagcccggaggcagaggtggtgaagctgctgcccttcctggcgccgggcgcgcgggcggacctgcaggcggcggcggtgcggcacgtgctggcgctgactggctgcggacccggccgcgcgctgttggcggggcaggcggcgctgctgcaggcgctgatggagctggcgccggcctctgccccggcccgggacgccgcccgcgcgctcgtgaacttggccgccgaccccggcctgcacgagacattgctggcggccgaccccgggctgccagcgcgcctgatgggccgcgcgttggacccgcagtggccctgggccgaggaggcggccgccgcgctagccaacctcagtcgcgagccggcgccgtgtgcagcgctcatggcggcgctggcggccgcggagccggcagactcgggcctggagcggctggtgcgcgcgctgtgcacgcccggctacaacgcccgcgcgcccctgcactacctagcgccgctgctctccaacctcagccaacgccctgcggcgcgggccttcctactggaccccgacaggtgcgtggtccagcggctgctgccccttacccagtaccccgactcctctgtacgcaggggcggggtggtggggacgctgcggaattgctgcttcgagcaccgacatcacgagtggttgcttggacctgaggtggacattctcccctttttgctcctgcccttggctgggcctgaggatttctccgaggaagagatggaacggctgcctgtcgacttgcagtacctgccaccagacaagcagcgagaacctgatgcagacatccgcaagatgcttgttgaagccatcatgctgctgacagccacagcaccaggtcggcagcaggtgcgggaccagggagcctacctgatccttcgagagctgcacagctgggagccggagcccgacgtgcggacggcttgtgagaagctcatccaggtgcttattggggacgagcctgaacgtggcatggaaaacctgctggaggtgcaggtgcctgaggatgtggagcagcagctgcagcagctggattgcagggagcaggagcagttggagcgggagctggccccagagccatgggtggagagggccacacccacctgaggcccctgcagccggacaccagctccagggtcccctttgccaggctttctcagaccaggccttcctgcagctgtctgcaggccccctgggtccccttgttcagagactgtgctcttctgagaagcagagctacgcttaggctccagtaaggattggaggcactttccagccctgtgcagtgttgctaccagcaagaatgaaggttgtgcagagcagtactgtgaggtaggcaccgtgactcggctgcctgtgcagaaggtggaggtggcaggcggatggccagggagccatgagaagactcttcctgggcacggcgtggggactggacagaaaaccactgcaagccccaaggagccagctgaagcctcccaatccccagggcactgcagagtctgggcagaggtgggcgcataggtacaagtgctgctttgtcagcctcactccctgcagctctcagctccctgttccctgagacctggcctcaaagggctgacccagccatacgtagatcctggggtctttctaggactgtgcctccctgcttgacctatgctccaggaccctgccctcaacccttgtcagctccctaagtcttcctgtttcccagtctcagattgagtgggtgctctcattggcctctctagctaggccgtctccctggtcagcttccttgagcctgggccactcctccctggccttcttacctctgccaagagcctccagatgtgcctgcagcctagtccctgcccaagcttctcccccagccaccctctgcccctgtggtagagcccactataggcccaggcgccttacgtgcttctcccctggacctatgtgcatccctcacctgccagttatgtggctgccaagccccacaggctgtcatggtggctcttgccacacttcccttcctgagctgacctgacctcactgccacctcttgcattgggatcctgagggctggcccctgctcactgatgggccctcccaggcccgtcaagccctggtgaaggagcttagcttgtcttcttggcaattcacaatgcctcactccacaccctaaaactggagcgtcccctatggtctcctgctgtggcttgggtgccgggcgtctcccgcctccaggatctcctctcacctgcccccattaaagctctgccactcatgcaggcatgtgtggaccatgttttcccctggccagagcccccacctgccactggaggccagttgccctcttagcactcagacatcagcactgtcttcacagaataaatgctttatctggccttgc

SEQ ID NO: 3547 - DNA, 2405 bp, Homo sapiens
gggccacacagcggacccctaagcggaccgctggcaccggtcgggtggcagcagagtgtcgctcgacatgggggaggccggggctggcgctggcgcctcgggagggccggaggcaagcccggaggcagaggtggtgaagctgctgcccttcctggcgccgggcgcgcgggcggacctgcaggcggcggcggtgcggcacgtgctggcgctgactggctgcggacccggccgcgcgctgttggcggggcaggcggcgctgctgcaggcgctgatggagctggcgccggcctctgccccggcccgggacgccgcccgcgcgctcgtgaacttggccgccgaccccggcctgcacgagacattgctggcggccgaccccgggctgccagcgcgcctgatgggccgcgcgttggacccgcagtggccctgggccgaggaggcggccgccgcgctagccaacctcagtcgcgagccggcgccgtgtgcagcgctcatggcggcgctggcggccgcggagccggcagactcgggcctggagcggctggtgcgcgcgctgtgcacgcccggctacaacgcccgcgcgcccctgcactacctagcgccgctgctctccaacctcagccaacgccctgcggcgcgggccttcctactggaccccgacaggtgcgtggtccagcggctgctgccccttacccagtaccccgactcctctgtacgcaggggcggggtggtggggacgctgcggaattgctgcttcgagcaccgacatcacgagtggttgcttggacctgaggtggacattctcccctttttgctcctgcccttggctgggcctgaggatttctccgaggaagagatgcaacggctgcctgtcgacttgcagtacctgccaccagacaagcagcgagaacctgatgcagacatccgcaagatgcttgttgaagccatcatgctgctgacagccacagcaccaggtcggcagcaggtgcgggaccagggagcctacctgatccttcgagagctgcacagctgggagccggagcccgacgtgcggacggcttgtgagaagctcatccaggtgcttattggggacgagcctgaacgtggcatggaaaacctgctggaggtgcaggtgcctgaggatgtggagcagcagctgcagcagctggattgcagggagcaggagcagttggagcgggagctggccccagagccatgggtggagagggccacacccacctgaggcccctgcagccggacaccagctccagggtcccctttgccaggctttctcagaccaggccttcctgcagctgtctgcaggccccctgggtccccttgttcagagactgtgctcttctgagaagcagagctacgcttaggctccagtaaggattggaggcactttccagccctgtgcagtgttgctaccagcaagaatgaaggttgtgcagagcagtactgtgaggtaggcaccgtgactcggctgcctgtgcagaaggtggaggtggcaggcggatggccagggagccatgagaagactcttcctgggcacggcgtggggactggacagaaaaccactgcaagccccaaggagccagctgaagcctcccaatccccagggcactgcagagtctgggcagaggtgggcgcataggtacaagtgctgctttgtcagcctcactccctgcagctctcagctccctgttccctgagacctggcctcaaagggctgacccagccatacgtagatcctggggtctttctaggactgtgcctccctgcttgacctatgctccaggaccctgccctcaacccttgtcagctccctaagtcttcctgtttcccagtctcagattgagtgggtgctctcattggcctctctagctaggccgtctccctggtcagcttccttgagcctgggccactcctccctggccttcttacctctgccaagagcctccagatgtgcctgcagcctagtccctgcccaagcttctcccccagccaccctctgcccctgtggtagagcccactataggcccaggcgccttacgtgcttctcccctggacctatgtgcatccctcacctgccagttatgtggctgccaagccccacaggctgtcatggtggctcttgccacacttcccttcctgagctgacctgacctcactgccacctcttgcattgggatcctgagggctggcccctgctcactgatgggccctcccaggcccgtcaagccctggtgaaggagcttagcttgtcttcttggcaattcacaatgcctcactccacaccctaaaactggagcgtcccctatggtctcctgctgtggcttgggtgccgggcgtctcccgcctccaggatctcctctcacctgcccccattaaagctctgccactca

SEQ ID NO: 3548 - DNA, 975 bp, Homo sapiens
ccgccggttcgggctccggcatgatgagtctgggagggcctcttgtgggcagccgagggaggcggcatgggcggcctcatagctcctcggccgagcctcccggagcaggctagaaaagcccccggcccggggccgcggaagcgacggcggggccgccctcagccttcctcgaaaggggcgtcgcagcggcctccccagcctgttatgtggagggggttctccgtcccacccaggtcaaagtgagaggggattgaggaggctgtcgatagggaaaacaggctcacgtttacagttgctgtattccggaaaacagctccagttaatgggactgccagcaggctagacatccttcgccggaatgtgcagcgcttagttctgtgcccgggaggggcttctctctcttttgggattggagtgtggcattgccgccagaaagcctgcagaattccgggttgtgcagccaagcaggaacggtgtacctttctagacccatcctcttgcaatcttggaccctaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagataaattgaagaatgaaaaagaattacatagtgaaccgtcctcaaatgaaacccagtggaaagagcttactcagtattttggagtcaatgatagatttgacccgcctgttaaaaggaaaaaagttgagaag

SEQ ID NO: 3549 - DNA, 872 bp, Homo sapiens
gcgatgttgacggggtcctaagatggctgctgggcgaccacttcctgacagaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagataaattgaagaatgaaaaagaattacatagtgaaccgtcctcaaatgaaacccagtggaaagagcttactcagtattttggagtcaatgatagatttgacccgcctgttaaaaggaaaaaagttgagaagtcaggccttgaaaagaggatagaccaggctgtggaggagtggaatattgagaaggctgaggaactcagcaaccagctagctactcgagagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataag

SEQ ID NO: 3550 - DNA, 5930 bp, Homo sapiens
gcgatgttgacggggtcctaagatggctgctgggcgaccacttcctgacagctccagttaatgggactgccagcaggctagacatccttcgccggaatgtgcagcgcttagttctgtgcccgggaggggcttctctctcttttgggattggagtgtggcattgccgccagaaagcctgcagaattccgggttgtgcagccaagcaggaacggtgtacctttctagacccatcctcttgcaatcttggaccctaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagataaattgaagaatgaaaaagaattacatagtgaaccgtcctcaaatgaaacccagtggaaagagcttactcagtattttggagtcaatgatagatttgacccgcctgttaaaaggaaaaaagttgagaagtcaggccttgaaaagaggatagaccaggctgtggaggagtggaatattgagaaggctgaggaactcagcaaccagctagctactcgagagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatcagctcttttcagtctttctttaaggactttgtcctattgaagtgaataaaatgaagcattctgttatttgtataagaaatgtaagaaaaaaaatatagaaagaagaggataggattttgtttatttgtatggatggacccttggtataaaatcacttttggcgctttccattcatttggtttagcacagccagtgagcttctcgtactttctttctttttttttttttttttgagacagagcctcgcttgctctgtcacccaggctagagtgcagtagcacgatcttggctcactgcaaccactgcttcctgggttcaagtgattctcatgcctcagcctcctgagtagctgggattatggacaaatgccaccacacccggctaattttttttttttttttgtatttttagtagagacagagttttgctgtgttggtcaggctggtcttgaactcctggcctcatatgattcacctgcctctgcctcccaaagttctgggagtacagacatgagctaccatgctgcccttgtattttcttatctgtacccagtgtaactacacgtttactggaactgtgtttttaagactgacagttgtttataatggattagtcgtaagtaccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgtagtatttggaagatgatttaaattcagcaacgcctaaaaatgtcttcctaagtatttttctcagccatgtcattctttaaattatgagatggttcttagaagagaaaatggtgtaattgtattaaacagacaattataactcaagataatataactttgaaccttctaagaactgatttgtttggttttcctcccattccccattcctccttaaaagattgaatgaattaatgagcagaaagagaggattggtaacatgggaaatcgttttcattagatgtacatttcctggttctgacaggaaaggggctccagaaaatcataaaacaagcaggtgaacaagaccaggtgtgtcggcacctccctgctcagtgcccagcggaggtaaagaaccactcagcatggtttttgtcagttcacctcttctgtcgttgtcagaggtttcctacctgtctgatataaactttctctgggttgataatataaattcagaaacatgtaaaatgaatcatgattatattactgttatttttagacttaaaatagtaacaaaattttatttatggtggcacatttaatggctttttttttctgtgttctggaataagagaatacctagctactatttaagcatccaaaaatcatatcttgctttcatttagttgagaaaagccagcatagagaaagcaaagttttagaatattatgtgtcatactaattcagtatccagaccaaatgttggaaagtcttattttatgatttaatatcccttgttccattttacagatatgatcatgtaaaacttacctacaatattcatttcaaactgctaaattaggtaaatacagacttttagtatagaaacctttcctctaaaaatccattatgggggaaatattcactatacaatccagtggttttgtctgaaatcctaaaaatgttatttttgagcaggcgagtggtatagatattctcacacttggggccccgatatgggcatttccctttgacttcagtctcatttttttttttttttctgtttctactccttagagcatttagtgacccctgcaggcatgttgcacttcccatactgaagccttgccagagtggcctcctgtagggtctgacttgggatcctgtccagccaaggaagcccttcttcagcctgctccagtgcccgcagttgccccctcagcatcccctcggggttctcatgtagatgggaacattttaactacgcggaaggcaggcatttcagcagaattaagtatagcgggggctcatctaataaaggaagccacttctcccaagtcgtcactcctttctgggcatgggttgtggaaagctctaaaacgttatgtgtagcagaagaaggggttggagggaagatttgtggggacaggttgtcttggattggccctgctgacatgtcatttgagagcagttttattttatcctttctaataggaattaggtattttactcctagaaacattattccttgagtacgcatgctgctcaaaggatgtagtcatttgtccactccattctagtcacagcaaaataaggattctttttggatcagtaataactttggttcctaaaacttcaatatgtgcatttactaccaccagaatgcctgagttagatcagtaatgtaaacgtcagttattgttaactgagattaatatgtttcaggccgttggtatggcattaatgtaactatgatttactatttaagtactttaggctaaaacatcttactaaagaacagtaattttgagctttacagcactggttctgagaaagggaagttggcagtgcattcttgtttgggagccctcaggatgtttctgattttcagcagaacattctatgtctttcaccgaaaggagagattgaatatataatcttaggtttgctataattagttctgatgacagagttaaatacctcagccaagactgtaaatcagtacgtaaacaggtttctgcaactgatcataaatctcaaactgcatattttaaacacttatttttttaggatgacagataagggagcagcaggctaaggataggaataaaatgttatctgaacttttaagtcacaacttagaactcacattaaaatcttctgattttctttataccttttgtctaaaatattatcttttagcttattaataactttaataagacaagtttgaatttaattcacaaaaaatgaagatataatttataaaatgtccaaatttttgttaagacattactttttaagaaatgtgtgtcttgctaaatataaaacatattgtatgaggttgttgtttaaacaaaatgagagttgtacattattttttaagagatgataaagtttgaggaggcaagccgatgttatgtcagatctcattttgaagttagtgaaacctagtctaatccagaaccaactgaatccaagttttccattttggcagaagttgcttttatttttagtatctggcagagcaacaaatgctttgcatgtcagttcaatattttttcctgccaactgtttattcattggcttaaaatttacactctactaaagtcttagctctgactttcatgaaacaaatagtaatatttggacaaaatatgtacatgaaaatctttttccagaaccaaatgtagactggtatttgtgacatcagtgccttctagcatggtgacgggtcgaaaaatactttgaaaagttgaaggctgtgtaaacccacggcagtgcatctcaagtgatttttattatgaggtaatcagagtatctaggttttcaaatttaaattagtgggtgactttatgctagaaagtagaatatgtgttagaataaatttatcaatatatattcttggcctttgtaggatactgagacaataaggtccatttttcatttttgaggttggggagctctgtagattttgataaaatgtgcagaactgcattctttaatctttattatttcatcctccctccacactgcttgctttaaaagaaaaaaatacctacacacattttctagtgttaactgctgtaatcagcatagacttcctgggaagggattcttgccttcagtaaaggacatgacagcatgtggccaatggagattgccacgaggaaacctggaaaggcattgaaccattttgtgctactgttaaaatgaggtgtgttgtctctttattatctcctactcaatagtgagtattctggaggtgtctgttccctttccggaatttcttcaaatacagagatgcttcagagtagcttcctgccacattggctttcatgatcttaatccctggaacacagctataggcttctgggagatagtttattaaatgccatgcagaatgctatgtttttagatgtgcatgtaaatcaagaattagctgaggaatatctttttattagtagtagtagtaactcatttttagattcaagtaaagtttgttttccaggtgagatgacatttttaagaaattgaatttaagtatgtgcttttatatccggaccaggtttctcaaggaagcagaatacaagggaatgaaaggggaagggagggtagtgcccaagagaaacctcggctcctaagtgctcccctgccaggtttcccccgtgcctgcccactggcaccatcctggcagctccagcccacaccccctcctggaccctgggctgcctctcgctgaatagctgcagggggcctgctatgtgacaggtatggaatgaggtaatccttttccacctctaatttctgaagggtgtgtctgtccagtttttacttgttcattgaatttaaagccttaggaaccaacagctacagtgcaagctgtaattattgatgtctgtttcatattcatctgtaagttctggcatttgatcaagaagtcaatatatcacttcatcttcaggctgaatgtgtctcagctataaaggttttattgtttgatggatagcatacaattatgactgcccacaataaaaagtgttttcatttgtaa

SEQ ID NO: 3551 - DNA, 5400 bp, Homo sapiens
gaccatgttgagccctacttttgttctgtgggatgttggatatcccttatacacctatggctccatcttcatcgttattgtaattatctggcaagtgaaaaggagccaccatgaattgaacttggaagttgaaaggagctgctgctggcgtcaccaaaaagtcaggcaaagagctagagatgcagcatcaacagctaggagactttctcaggaagaagatcagaagccacaagagctgttctctgtcatgaaaagggctggcttcccccagagggaagtgtgcggcgaatcctatgtacagatccctgttgccaaatttgcaatgctatggctctggagattcagcagttgctggcggatgagaatgactagatctccccaactttgtcgaggagtccatcacaggtctcctcttgcctagagatcttgtctctgtctagtgtatcctttgagcagagtatagagctccattccagaaatatcagagagctttcactggcatctataaacccaacactgtcacaattaacagatcagaaatctttaacccagtcagctgcccagtcaacgtatgcagatggcatacaagattactgggctgatcacctccagctagggccggaatttcaagtgccagctgtgctccggggcccaaacaccatagcttcttcaaggcttgacaagccaagggctccactgaaccaggaggagatgagcagagcaaccccagccttgtccagggaaaccaaggccagcatcacttgaatttccaggtctccttgctgtccctgaacccagaaaccctgaaccggatgcatccgatggccttgcatatggtcctccctgcccacctgccatttctcagtcctgaagtgctgaggcttcttgaggtacatgttaaaaaatggatgcatttccagaggtgggggctcccaagacgtgtggaggagtccctgaggcagcttatgccaaacccaccattgtattaccaacctggaaatgaccagccagtttctttcaacctgaataatacttctcaggtctctcttcacagatctgagaccatttccctccagacctggtgttcatgtgtggctggccagcccatccagaccttctgggtttctgaatggtccacaatgaacccagaacaaagacaccactgtcagcaaactccaaaccctatggctctagccttgccctctccagcccttaaagccctaagtggcccccatccacagtctgggggacaagataatgactcagggagtgatctccagcagaaatacagccagctattctgtgggctcccttctctgcacagtgagtccctggttgccactttcatgggatctcaaggccttcccaagattgaaaatgtgcccaagccccccttgaaggatccttttctcttcaatgatctctccttcccccaactgctccctaaaacttcaccccagtcagccccaccctcttccccactttcgccaaattgggtgtctccatctgaccatcaacgagctcagatcaatgtcccatttctgactctggctgagtatgaagccttggagtggcacctgctacagaggcaactccagcttcagtggggctggccagctgccctccagaggtctcagcacacccagtgcctcatgcagcatgagccctgtggcaaagctcagtctcctgagaccacgacagcttcccagacagggaagtccatctcagtgctcaccagggaactactcttcttcccggagcatgcccggaagctgctggaattccacatccagaaacagtcgattcgccatcgctggggcctgcctcagaagatccagcagtccatccagttgctccttacctccactgaccagcagactgtgtccagcagcagcacagccctagccaacgtgagcatcccccagcctgtagccctagaggccaacggggcttgcgatgtgctgtcacccattgcggccccagtgtccatccccaggccacacttgttaactcaggtcaaggcaatactgcagagccacatcgactccaaatgtggacaaatccaccagggcaagatccccgcctgtgtacacaggtcctgggactgcagaatttctggggtcctggcagtggctccttttccctgcattccagaaagccagttcctggtactgcagacagcaagtgacccagacctacatcacaaagttatgccctggatgccaacggcccttgatcagcagcaacaggccttaccaggtactgtcactgaacaccctaagctgctccgagtcttgtctgtggaagccattgagaaactggagacaactttacggcacaagcatctggccttcctgtcggggctgcctgctctgtattatgtggcgctccccagggccctggccccggcagtcactagccaatctgtcatcacagagatggagcctagtcccgtggaaatcccagcagagcctctgatttagatggtttcatttgaagaacagtgtataagtcttgggccatgccctcaaggcaacaatgagagttgtacagacgttgcaaaagagttccagcctgcagtgccagtaaaaggaacaatggagacgctgcctctagaaagccagacgcatcctactagcccccactcactccagacacatatcttgaccaaactaaacttccacctgagaaaaaaggtcctagagatacaatggggaattcccattagggcaaggaagtccagggaacaaactgctgcagcaccagagaacatatccacacagaagtctcttgaaagtctaaaccaccaaggggagacattgctccaggaactgcccatcccaccagacactcttcctgcccctaatccagaaggggttcaccttaaagaacagctggccaatgacttgaaggcagtgcagcagaaccaaaagcaatccaattccaaagcagtaccccagggttctgcccactcggtctccaagatctcacaacccagtggggacatgacagaggcccacatgccttgtgttcaggtagaggccagtgtgaacaaccccagcctggaggaaccctgtggccctgagcctcaaagccctagcaagagcaaggacccagcccatgtccccatgctagcaggaaacagagaggacccagaggaaaccaaagcagccagggactacagagaaggggatgcggggtttgggcgctcctcaaccagagaagagagacgccctgctgaagaccagaggccagcagggatgcttccaaacaagacaccccgagggtcctggcgatggagccgtagctttcatcttgctgatccctgtcaacacagcccccagcatcaccctcagtttaagctcccacagctacctccacgagtccctggggagaaagagtctgagaaggacctgcaagacagtcaaaccaagctaactgtcatccttgaaccagcaacaattcctgagaatacccagactgtggtgccccagcttcacagggtcagcctttcctgagccaaccaactcaggctaagcctttgcagggccaaactttgcaatgccaagttttacatgggctggtgatgccagcccatactcaaaagaagcccagccttacagagtctagcttcagaaataaaattaaatgttttctggagtgtattaaccccaagacaaaaggcaaagggcacaaggattccatgttctctgccactgtgaaggtggccaaaaccagaaaagaaaatgttgcaaagagcctggctccagccaagagccctgtggggagaagtaagacagagaagccgacagggtgctccaaggcccaatctcatcgtgctcagaagctgatgggcccagctttcttggatggtccccagtccctagacaataagcttcggttacactccagacaacctggctctgcctcaaccccaggccacccccaccactgtcctcgtcactgtccttgagtggcttgtgccccccaaccagggcacccaccctagctcctaaccctcagttcagatagaaacattggtctgctcaaggagaacacacagagccatgaaaaagagtttataggctccccaactgctgcagccctccagaggaccagtattttcatttccataaatatgctggtggggcagggtgccactagaaatgcactctatatgtttcagcaatacgttgcccatctgctccttatctccactgtattgtgttaagggaaggtgtgagggaggctaaaaagaccttcctgtctagggaaggagctttaacccacaattcagatggttcattttagaggagtgccacagtattccctccttgaggaggtgcttttgtgtttatcaaaacacaatatctaataagacagatgtcagatccagatgatagactctcctctgacttctccctgtttatactgggaagatctttctagaaaatccatcttggagcctgctgtaatcctgctgcctgtttactgcctccactgcctctcagttgcatgaaatgaaagcctcctggaatgagatgacagtagaaaatggagaagggcctgtcccacaggcccagggattggtagggagcagggtcacgtagttggaggtcagagtacctgtgacaaaagttgattctcatgcctgaccaggacatgagaatagagaaaagacagtttgcttggtgctaaaatgagcctagagccaggaggcaaacccaaggcccaagtgctttgggagggatcactgagcttagttctgcttgcccttagtgtgatgaagggcagggtgttgagcactgaagtttctgggaaagaaccacaaatataagaggttttctaaacatatgtgagcctgtcaagttactgccagcagcttgtacccaggcctactgtttctataccacctgtgcctggagcccttctccaccactctccttgccatgatccttactccttaaatttatcttcacagtaactaatggtgggcacccagtcagctgaatcccctcccaggatctacctggtgccttttcctcaggggatgactcctacactttttcctgccaaggacggcaccacagaagcctggcagctccagcccttggttcctgtcacccttctacatctcttcattgtgtcccactgcatttctgaaaacactgaagccaatcaccttggctgtcaaaagaagacaaggcttttggaaagtgtcctattaacacagaaagtgaccacaaatctacaatttaatgccacacatgagtctaacaatgagatcagctgctcataactgaggtggtgggactctggcccttttgcctctctctgggaatgtccaatattttgctattcagggaaatacatagttattattaattgaaatactatgtg

SEQ ID NO: 3552 - DNA, 927 bp, Homo sapiens
ccagcttccgggaggcgctccgcacgtttgccgtgctccgccgggaagatggggaaagtgagggggttgcgcgcccgagtgcaccaggctgccgtgaggccgaaaggggaggccgcccccggccccgcgccccctgccccggaggcgacccctccgccggcctcggccgcggggaaggactgggcgttcatcaacaccaacatctttgccaggaccaagatagaccccagcgccttggtgcagaagctggagctggacgtgaggagtgtcacttccgtcaggagaggtgaggcaggctcgagtgcacggagcgtcccttccatcaggagaggtgcagaggccaagaccgttttgcccaagaaggagaaaatgaagctgaggcgtgagcaatggttgcagaaaatcgaagccataaaactggctgagcagaagcacagggaggagcggaggcggagggccacggtggtggtgggggacctgcaccctctcagggatgccctgcccgagctgctggggctcgaggctggcagccggcgccaagcccgcagcagggagagcaacaagccccggccctcagagctcagccggatgagcgcagcccagagacagcagcttctcgaggaagaaaggacccggtttcaggagctgctggccagtccggcctacagagccagccccctggtggccatcgggcagacgctggcccggcagatgcagctggaagatggcggccagctctgaccagggcagcgggcatgccacaactcctcaggacacatgtgggccaagtagagagcgccggcccctcaaggaccatggcctgagcctggtggacgcccttccctctggtcggttgtggggctcaataaatggctctgtgaacttcccctgcactgccagggccgttcccatgagctgcttccctga

SEQ ID NO: 3553 - DNA, 880 bp, Homo sapiens
agcttccgggaggcgctccgcacgtttgccgtgctccgccgggaagatggggaaagtgagggggttgcgcgcccgagtgcaccaggctgccgtgaggccgaaaggggaggccgcccccggccccgcgccccctgccccggaggcgacccctccgccggcctcggccgcggggaaggactgggcgttcatcaacaccaacatctttgccaggaccaagatagaccccagcgccttggtgcagaagctggagctggacgtgaggagtgtcacttccgtcaggagaggtgcagaggccaagaccgttttgcccaagaaggagaaaatgaagctgaggcgtgagcaatggttgcagaaaatcgaagccataaaactggctgagcagaagcacagggaggagcggaggcggagggccacggtggtggtgggggacctgcaccctctcagggatgccctgcccgagctgctggggctcgaggctggcagccggcgccaagcccgcagcagggagagcaacaagccccggccctcagagctcagccggatgagcgcagcccagagacagcagcttctcgaggaagaaaggacccggtttcaggagctgctggccagtccggcctacagagccagccccctggtggccatcgggcagacgctggcccggcagatgcagctggaagatggcggccagctctgaccagggcagcgggcatgccacaactcctcaggacacatgtgggccaagtagagagcgccggcccctcaaggaccatggcctgagcctggtggacgcccttccctctggtcggttgtggggctcaataaatggctctgtgaacttcccctgcactgccagggccgttcccatgagctgcttccctga

SEQ ID NO: 3554 - DNA, 5600 bp, Homo sapiens
aggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccaggtatgaaatcaccagaagaacaactggtgtgtgtgccaccacaggaggcctttcctaacgacccccgggtaataaatagacagagaagttctgattaccagtttccatcctctccatttacagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtacagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagatgctgttttgacattaacccctttggagctgggagttgggatttcccaacattaaacgtgaacacatttcgcagaagcttttagcatcggattatctggacattcacatctagtgtgagtgttgtgactaagtgaacttgtggcagaagaccaagctttaagggattgtggacttgcagaccctgacgcgttatattgtgtgagtagtgtataattttaaaacttaaacaaactgtgtatttcaatagaggaggactttttgttttttaaatgtagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacgg

SEQ ID NO: 3555 - DNA, 5239 bp, Homo sapiens
agaagaactgcccgagggaggagcggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtacagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacata

SEQ ID NO: 3556 - DNA, 7119 bp, Homo sapiens
aatgactgttaatttctttgcctcctctttgattccatctcttgacctctatatcatttcaaaggagcattgagtgaacatccatccttgtaccttgaatattccatgaatgctcctgcttcagggcctctgcatttgctgttctctcactttccccagtaagctgcataattcattctacatttcttcacgtatttccttatgattgaggtttctctgttttttttttttacctctatactcttatgtctctttttatagcactgaaaaccatcatgatctgttatatatcattgttttctgtcttcctcattagatttatgtaggttggaactttgttctgtttatctctataatcctattacctagaactgtgcctggtaaataagagcttagtatgtatttactgaatgatgaattaatatatttatatattgaggctgtgtcttctaatgtcagcaaaataattgacaagagactttggtggacactgttctctcttggttaatatttttggaaaaaacaactcccttaaatttgggtaaatgtggtaatttgagcgaagtaagtacttctgttttctctaagtagacttggatttactagactttgtaatgagtaatttctttgttcttcctacctggaggaaggacttaactgtagtatgccattaaaaattgcacttatatcatcttacatgttaatttttatgattatactaatgagtaatgtttttcttttcttttaaaaaatttgtagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtacagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgaaatcacattgatatatgtttgttagtaaaatgtgcacacctgacttgcaatgttgtgttaaactagaattatattcacttggaaaacatatcgcttaggataaaattttgtcattcaaaaattttttcagaaatgcttgtactagaccacctcatttggatatatagctatcacatttgtaagattctgtttttagcataaaaatcaatagggatgaaaattttcttagaactcaagactccataactatgggggtaaatgaagtcatcccttctcccccagtccacccccaagtgctcttagatactgaaggagtctcccttaacatacagtgttttttttttgttgttgttgttttgtttttttttggagatggagtctcgctctgtcgcccaagctggagtacagtggtgcaatctcactgcaagctctgcctcccaggttcacaccattctcctgcctcaacctcccgaatggctgggactacaggcacccaccaccacgcctggctaactaactaactaactttttgtatttttagtagagacagggtttcactgtgttagccaggatggtcttgatctcctgacctcatgatctgcctgcctcagcctcccaaagtgctgggattacaggcttgagccactgctcctggccaacatccagtattttatcttgactgtcctaaccttaccttagatgctaacagaagggtcctgctgaaataacactgggtgctatattgatgggtaaatgtgtacatcctattccttcctctttatctcacaatttttgtctccactaagcaagaagtaaactaacacttcgtcactctaaagaaataacttatgtaaaactcttagtaaccctgtttgtcttcaaatgagtaaatagaccaaagtggggggacaattttctagttctgtagagggaaaaacatctgagtcaacattttgaaatgcagagggtattggtacatgacg

SEQ ID NO: 3557 - DNA, 8626 bp, Homo sapiens
gcttccggttgctagcgccggtcagagagaaagtcggcatgttctcgcaggctgccgggcgtcccggggttgcctcttgcccgtgaccctgacgggagacagagcgcgggcggccgcggcgtccctgtcagcgcccgcggcgaggaccccggggctggggcggacggcgtgcccctgaggggggtccccgcgggagcgcggagccggcgactggtgcttcccacgtgcgccggtgtcgcgagggcccgggaggacgcagagcacggccgggagaagcatgggaaggaggccgagccgggatctcaggtcctcgggggcggcggccacgccaaggacggtacaaaactttttaccaacaaaaaaaagcaagtagttatactcaggaagaacttcaagacacttacgggtttcttctgtttgatactgaaaagcaggtgtatacatttccaaatactccgactgtcttcattcaagaccatggtatcatgggaaatctggttatgttgtaatttttaatataattaagtattacttttacgaactttcaggcaacaccgttattgaacgacccagacagatctgtccttatgtaattgtagcttttcgatacagggaatctaaaactatggcaccaccagctcataaaagcatacttgaacgcagtgaaaatgttctcatgtctccatggaaagggaaattaattgttcaagaccgtatgctatgtgatatagctctttggtccacttacggtgcaatgattccaacacagctaccgcaggaactagattttaaatatgtaatgaaagtgtcttccttgaaaaaaagactaccagaggctgccttcagaaaacagaattacttggaggagaaagtctgttttcaagatttgtgcttcaatttgtatgaggtagaactgtcaaacagacaaggggaaaatatagataaattaacagaatgtattaaaaacaagcaattggcaatcatcaaatgcttagaagatcgagggtttttcattttacttacatcatcagccttactatcagaaccagattttggaggcaagcagatgggtctgcatgggttacatttatttcgttcacccctgtcaacaggggtgaaagatttgaaagttgaagatgacatctcaatgaaggtgatacctattttatctacccttaattgtgccctgctagaaacaaagaaatcacttcctgaagaaagaatccatccaaacacattagtaaagcgtcatttccaagaattgtacaaggcggacagaagcccttcattgagtgttgctcctcaggatagaatgaaagaccctacattcttggggaaactgcccagtggttttgacttgattcctccagctgaaaagtgcccttcagagtctttaactcagttgaactcttatttttcagaccctagtgcttacattttggaagtgtctactgctttggacttgctagcagagcatcctcagtctccttgtgtttcagacggaatttgtgatgctggattttccttagttatgactccagatcctgaatttcttgtctcagaggcagaagtgagaaaagaaactgaaacaaaaaaggattctgaagaaatgttgaaagcaaagaagagagtttttccattgagtccagcgtcaaatctgagagtgcagcctaagaggaaggccagcatgccccacatggtgcagagtaaaaaggtgaacttgtgccgcccctttcccaaaagaactgcttccagagcagacaacagctcggactctccaacaactcttaagttagttaaaggacagtttcctcagaaaagaaaaagaggtgcggaagtgctgactgcacagtttgtacagaaaaccaaattggataggaaaaaccaagaagctcctatttctaaagatgttccagtgccaacaaatgctaaaagggcaaggaaacaagagaaatctccagtcaaaactgttccaagggctaagccacctgtgaagaaatctccacaaaaacagagagtaaatatagtaaaaggcaatgagaaccccagaaacagaaagcagctacaacctgtcaaaggagaaactgcttcaaagcttcaatcagaaatttcaagaggttgtcaagaagatgggattagcataaatagtgttcaaccagaaaataccacagcggctcacaatgatcttcctgaaaactccatcgtcaactatgactcccaggccctaaatatgttagccgatctagcattaagctctgctacttcttccacaccagtatctgaggctagaaatcttcactgttcctctgaattgccacaaaatgatgttttgctctctaaagaaaattctttgcgaggtacatctgaccatgaatatcatagaggagttaaaactcaaaaaggtgaattactacctaacccatcttctgataggaagagtaattctggatcagacttaacagttagccaagatgaagaaagcttggttccttgtagtcaggcccctgctaaagcccagtcagcacttactgaggaaatgctagaatcttcagatgcaagccaaagctcttctgtttctgtggaacattcatatgccctgctccttacagaacattcaaagaaacatctacaggagagagagatactaagccctctgtttcccaggaatgggacaaaaagccctgaagcagcaaccccagtggggaaagtcatgccatttcggcatcagcccggccttttgcttcagcaaaagcctcctgacgaccccgtggtgaagcccaaggatcgaccaccgtctgcccgtgtgaaaaaatcttcttgctctcgtatagtgcttagctgtgatgactccgttaagatcactttcaaatgtgaaacagaatatgcattcagtttagacagcaaatataccaacaacccactggagaaaactgtagtaagagcattacatgggccctggaatactgatttgcctgataatgtggaagaagtgaagcttttacttcatatgtgggtagctctgttttacagcaatcagaacaaaatcatacgatcttcccgaaaggttgtagaacacagcaacccagcaaaatatgtgtctataaatagcacgttagaatcttgtgagctccgtgaaattgaggagtcccttggtttggaaaaatgttctgcagactctctgttggagactaacgaaatttccagggctcatgctgctgaagtatccttccgtgatcctaactgcttgcttcctttcattaaaacaccacttacccaaggcttggaactctgtgtacaaaatgaacagaaaaaaacttttgcaagagagtgtgatccagacacccaagaagaccagaatttcatctgttcttacaataatgaggtaactggggaagaagctaaacaagaatcattggagacttctaatcttgtgctttcgggtattggaagtacacaaactaatggaccttctgttcctagtgaagaagaaattgttcagccactggatagcacaagagtggcttcttacagtggcactgttactcaagccacattcaccaggacttacgatgggcctggcagtcagccagtgatatgtcagagctctgtgtacggcacccttgaaaacaaagtggatattcttgatgcagcagtgcaaacaaaaacaggtactttacaggaccttatccaacatggcagccccataaacaatgaatgtcacccttccttggaaagaaaggatgataatatggggtgtgcagtgattaacccggaaccaattactctcacctttgaaaaaaatgcacatgtaccaatacagacagaaggtgtaaatactgctgatgaacgtacaacctttaagaaggagttgattaagcaagtatcacctgctgcaagccttagacatcctgtatccacctcggaaaatgcacgaacacaaggcctgagggacattccctctctagtagttgcaggacagaagggcactaagtacctttgtgcctcgtcagtaggtggagagacacttgataaagcagtgtgttcattacagaaggagacgccccttccagtctctctaccatctgataaaacaatggtcatggaggcactatcattagctaaaagttctagtcatctatcacccagtgaagaagtgagatgcactcaggatttcctttcacagactcagagtctcctcggcctatcttcagaagggcttctagaactgacacaggttgaagtggactcatcatcagcctctaccaccttgggaaggcagtgttcacttaactgcatttcgtcaggatgccacacatcaggtgactctttagaactaaggaagaatcacaagaatggtccaaacactgaaaatatgaatttggaagcgtttgattcagtatttatcaaacaaacaagcctgtctgtgagtagagaggtcagcctagagttatcagaggaagattctgacattgacttagctctaacaatatcaccacctacaagtcccagagaagaaatgccagctggtgaaatagagcaatttgaggaggccccattctcaaatttagaacttcaggatgtagctgaggaaataggtgaaccggaagaggtggctctcacagaaagcagagaagtgagttctgctgacaatgtgtcagtatatccctcagtgtcagaagaaccagtagaaaataaggagagaaagggggataatttacaaccagttactttaatactttctaaagaaaattgcacccttgagattgcagaggaaattaatgtgacctctgattttccctttgattctgtaattgaagaagtatcaccagcgtctagtcctgaacctccagtaccagttaaagagacacgaccatatcaggctgtgactccatgcattttaaaacttcatggtacacagtgtgagaagagcaaccaaatctcccaatgtgagtcagaagacttaggcataacagaaaaagaaaatgtttttgttggtcctacccatccagtggggcaagataactttacccaggtacaacaaatgcaggtctctgccgaaatgcctctaatattaactgatcatccaggaagaacaggtagaccaacccttcctggtaaagtaactgaggaaattgtctcaagtgagcatgatgagggtttatctttctcaggaaaggtgcagtgctatggtagggagttaaaccagcctgcctcagctgccaaatgcacaggtgacttcagtccttctcctgaaaaactggtaaaatcaggaaatccattgcagccagttagtatagagaatagaaatttggacttaaaacatcttgtcttggagtccagtgaacctccatttggtcctagaaatgttattgaaaataagtctttgtctgacacattggtttccacaactgcaccaagtggtatagtgaatgtgtcagtaaaacagcagactagccctaaaagcagtcagaaccatctctttcccggtgatttgaaaacagatgaaggcatttatctgcaggtgaagtccttgacagctgcctcggttgatggagcttattctacacagggatgcatgtgctcagtggtccccacgctttgttcttcctcagacaatgctacattaacccattatgtaagaccaataaatgcagagccagtgtttcaagcacaggaaataccagcaggcagaatggccagtttgcttaagaatggtgagcctgaagctgagttacataaagaaaccacaggtccaggcactgctggccctcagtccaacaccacatcttctctaaaaggtgaacgcaaagccatccacacgctgcaagatgtgtcaacatgtgaaacaaaggagctattgaatgtcggggtttcctccctttgtgctggtccctaccaaaatacagcagacaccaaggaaaacctcagtaaagagcctttggcctcctttgtttcagaatcctttgatacttctgtttgtggaatagccacagagcacgtagaaattgagaacagtggggaggggctcagggctgaggctggttctgaaaccctaggcagagatggagaggtcggtgtgaattccgacatgcactatgaactctctggagattctgatctagacctgcttggtgattgtagaaatcccagactggatttggaggattcttatactttaagaggtagttacaccaggaaaaaagatgttcccacagatggctatgagtcgtcgttgaacttccacaacaacaaccaagaggactggggctgctctagctgggttccaggcatggagacgagcctccctcccgggcactggactgctgcggtaaagaaagaagagaagtgtgtgccgccttacgtccaaatccgagatctccacgggatcctcaggacttacgccaacttctctataacaaaagaactcaaagataccatgagaacttcacacggcctgaggaggcacccgagtttcagtgcaaactgtggcctgcccagctcctggacaagcacttggcaggtggcagacgacctcacccagaacactttagacctggagtatctgcgttttgcacataaactaaaacagaccataaagaatggggattctcagcattctgcctcctctgccaatgtctttccaaaggagtcaccaacccagatctccattggtgctttcccttcgacaaaaatctctgaggccccatttctgcatcctgcacctaggagcagaagcccccttctggtaacagttgtggagtcagatcccagaccacaggggcagcccaggagaggctacacagccagcagtctggacagctcttcctcttggagagagagatgtagtcataatagagatcttagaaattctcaaagaaatcacactgtttcattccacctcaacaaactgaaatacaacagtactgtgaaggaatctcggaatgatatttcacttattctcaatgagtatgctgaattcaacaaggtgatgaagaatagcaaccaattcattttccaagacaaagagctaaatgatgtttctggagaagccactgctcaagagatgtatctgcctttcccaggacggtcagcctcctatgaagacataatcatagacgtgtgcaccaatttgcacgtcaaactaagaagtgttgtgaaagaggcttgtaaaagtaccttcctgttctaccttgtcgaaacagaagacaaatcattctttgtaagaacaaagaaccttctgaggaaaggaggccatacagaaattgaacctcagcacttctgtcaagctttccacagagagaatgatacactaatcatcatcatcagaaatgaagatatatcatcacatttgcatcagattccttctttgctgaagctgaagcatttccccagtgtcatctttgctggagtagacagccctggagatgttcttgatcacacctaccaagaactgtttcgtgcaggaggctttgtgatatcagatgacaagatactagaagctgtaacattagttcaactgaaggaaattatcaaaatcctggaaaaactaaatggaaatggaagatggaagtggttgcttcactacagggaaaataaaaagctaaaagaagatgaaagagtggattcaactgcacataagaagaacataatgttgaagtcatttcagagtgcaaatatcattgaattgcttcattatcaccagtgtgactctcgatcatcaacaaaagcagaaattctgaaatgtttgctaaacctgcaaattcagcatattgatgccaggtttgctgtcctcctaacagacaagcctactatccccagagaagtctttgaaaatagtggaatccttgttacagatgtaaataactttatagaaaacatagaaaaaatagcagctccatttaggagtagctattggtgactcaactacagcctgcctggatatggatgatgccaataaaaaattagtattttccctttggaaaacttgtgaacatgtgaatacacatgtgaacagtcttacatttgaaaaaccaatgttctacaacttggaaagttttcattttttatattttgctgaaatatgtcacagtggcattgcagttgtctgttagctttgggttgcagtgctagatattgttttaaattattttcattttaaacaagatgccttctaagctattgagcttattaaaaataattttacatgtttacttagttggagcaaaaataagtctattttaacaaatagctttgtttttgcatgctaatgtcagaaaggcatacgatgcacattatgctctgttttaaaggttttaccacccttgtaaaaactataatcttaaatggttttatttgctgttacacaaacaacactacataaaacattttttcctaaatggtacaaatttataaactatcatttttcacttacggtatttgtaaatactacactacaaaaatcagctttctgagaaagaaataatcatttatttatgatattgaaaatttctacagtaaacactcaaaaccaagcaaaaaacatttgtaagatacacggtatctatttggagcaacggtttttgtaactaatgtgtttcattttttaaataaagacaactaaaaataa

SEQ ID NO: 3558 - DNA, 6203 bp, Homo sapiens
gcttccggttgctagcgccggtcagagagaaagtcggcatgttctcgcaggctgccgggcgtcccggggttgcctcttgcccgtgaccctgacgggagacagagcgcgggcggccgcggcgtccctgtcagcgcccgcggcgaggaccccggggctggggcggacggcgtgcccctgaggggggtccccgcgggagcgcggagccggcgactggtgcttcccacgtgcgccggtgtcgcgagggcccgggaggacgcagagcacggccgggagaagcatgggaaggaggccgagccgggatctcaggtcctcgggggcggcggccacgccaaggacggtacaaaactttttaccaacaaaaaaaagcaagtagttatactcaggaagaacttcaagacacttacgggtttcttctgtttgatactgaaaagcaggtgtatacatttccaaatactccgactgtcttcattcaagaccatggtatcatgggaaatctggttatgttgtaatttttaatataattaagtattacttttacgaactttcaggcaacaccgttattgaacgacccagacagatctgtccttatgtaattgtagcttttcgatacagggaatctaaaactatggcaccaccagctcataaaagcatacttgaacgcagtgaaaatgttctcatgtctccatggaaagggaaattaattgttcaagaccgtatgctatgtgatatagctctttggtccacttacggtgcaatgattccaacacagctaccgcaggaactagattttaaatatgtaatgaaagtgtcttccttgaaaaaaagactaccagaggctgccttcagaaaacagaattacttggaggagaaagtctgttttcaagatttgtgcttcaatttgtatgaggtagaactgtcaaacagacaaggggaaaatatagataaattaacagaatgtattaaaaacaagcaattggcaatcatcaaatgcttagaagatcgagggtttttcattttacttacatcatcagccttactatcagaaccagattttggaggcaagcagatgggtctgcatgggttacatttatttcgttcacccctgtcaacaggggtgaaagatttgaaagttgaagatgacatctcaatgaaggtgatacctattttatctacccttaattgtgccctgctagaaacaaagaaatcacttcctgaagaaagaatccatccaaacacattagtaaagcgtcatttccaagaattgtacaaggcggacagaagcccttcattgagtgttgctcctcaggatagaatgaaagaccctacattcttggggaaactgcccagtggttttgacttgattcctccagctgaaaagtgcccttcagagtctttaactcagttgaactcttatttttcagaccctagtgcttacattttggaagtgtctactgctttggacttgctagcagagcatcctcagtctccttgtgtttcagacggaatttgtgatgctggattttccttagttatgactccagatcctgaatttcttgtctcagaggcagaagtgagaaaagaaactgaaacaaaaaaggattctgaagaaatgttgaaagcagtgtgttcattacagaaggagacgccccttccagtctctctaccatctgataaaacaatggtcatggaggcactatcattagctaaaagttctagtcatctatcacccagtgaagaagtgagatgcactcaggatttcctttcacagactcagagtctcctcggcctatcttcagaagggcttctagaactgacacaggttgaagtggactcatcatcagcctctaccaccttgggaaggcagtgttcacttaactgcatttcgtcaggatgccacacatcaggtgactctttagaactaaggaagaatcacaagaatggtccaaacactgaaaatatgaatttggaagcgtttgattcagtatttatcaaacaaacaagcctgtctgtgagtagagaggtcagcctagagttatcagaggaagattctgacattgacttagctctaacaatatcaccacctacaagtcccagagaagaaatgccagctggtgaaatagagcaatttgaggaggccccattctcaaatttagaacttcaggatgtagctgaggaaataggtgaaccggaagaggtggctctcacagaaagcagagaagtgagttctgctgacaatgtgtcagtatatccctcagtgtcagaagaaccagtagaaaataaggagagaaagggggataatttacaaccagttactttaatactttctaaagaaaattgcacccttgagattgcagaggaaattaatgtgacctctgattttccctttgattctgtaattgaagaagtatcaccagcgtctagtcctgaacctccagtaccagttaaagagacacgaccatatcaggctgtgactccatgcattttaaaacttcatggtacacagtgtgagaagagcaaccaaatctcccaatgtgagtcagaagacttaggcataacagaaaaagaaaatgtttttgttggtcctacccatccagtggggcaagataactttacccaggtacaacaaatgcaggtctctgccgaaatgcctctaatattaactgatcatccaggaagaacaggtagaccaacccttcctggtaaagtaactgaggaaattgtctcaagtgagcatgatgagggtttatctttctcaggaaaggtgcagtgctatggtagggagttaaaccagcctgcctcagctgccaaatgcacaggtgacttcagtccttctcctgaaaaactggtaaaatcaggaaatccattgcagccagttagtatagagaatagaaatttggacttaaaacatcttgtcttggagtccagtgaacctccatttggtcctagaaatgttattgaaaataagtctttgtctgacacattggtttccacaactgcaccaagtggtatagtgaatgtgtcagtaaaacagcagactagccctaaaagcagtcagaaccatctctttcccggtgatttgaaaacagatgaaggcatttatctgcaggtgaagtccttgacagctgcctcggttgatggagcttattctacacagggatgcatgtgctcagtggtccccacgctttgttcttcctcagacaatgctacattaacccattatgtaagaccaataaatgcagagccagtgtttcaagcacaggaaataccagcaggcagaatggccagtttgcttaagaatggtgagcctgaagctgagttacataaagaaaccacaggtccaggcactgctggccctcagtccaacaccacatcttctctaaaaggtgaacgcaaagccatccacacgctgcaagatgtgtcaacatgtgaaacaaaggagctattgaatgtcggggtttcctccctttgtgctggtccctaccaaaatacagcagacaccaaggaaaacctcagtaaagagcctttggcctcctttgtttcagaatcctttgatacttctgtttgtggaatagccacagagcacgtagaaattgagaacagtggggaggggctcagggctgaggctggttctgaaaccctaggcagagatggagaggtcggtgtgaattccgacatgcactatgaactctctggagattctgatctagacctgcttggtgattgtagaaatcccagactggatttggaggattcttatactttaagaggtagttacaccaggaaaaaagatgttcccacagatggctatgagtcgtcgttgaacttccacaacaacaaccaagaggactggggctgctctagctgggttccaggcatggagacgagcctccctcccgggcactggactgctgcggtaaagaaagaagagaagtgtgtgccgccttacgtccaaatccgagatctccacgggatcctcaggacttacgccaacttctctataacaaaagaactcaaagataccatgagaacttcacacggcctgaggaggcacccgagtttcagtgcaaactgtggcctgcccagctcctggacaagcacttggcaggtggcagacgacctcacccagaacactttagacctggagtatctgcgttttgcacataaactaaaacagaccataaagaatggggattctcagcattctgcctcctctgccaatgtctttccaaaggagtcaccaacccagatctccattggtgctttcccttcgacaaaaatctctgaggccccatttctgcatcctgcacctaggagcagaagcccccttctggtaacagttgtggagtcagatcccagaccacaggggcagcccaggagaggctacacagccagcagtctggacagctcttcctcttggagagagagatgtagtcataatagagatcttagaaattctcaaagaaatcacactgtttcattccacctcaacaaactgaaatacaacagtactgtgaaggaatctcggaatgatatttcacttattctcaatgagtatgctgaattcaacaaggtgatgaagaatagcaaccaattcattttccaagacaaagagctaaatgatgtttctggagaagccactgctcaagagatgtatctgcctttcccaggacggtcagcctcctatgaagacataatcatagacgtgtgcaccaatttgcacgtcaaactaagaagtgttgtgaaagaggcttgtaaaagtaccttcctgttctaccttgtcgaaacagaagacaaatcattctttgtaagaacaaagaaccttctgaggaaaggaggccatacagaaattgaacctcagcacttctgtcaagctttccacagagagaatgatacactaatcatcatcatcagaaatgaagatatatcatcacatttgcatcagattccttctttgctgaagctgaagcatttccccagtgtcatctttgctggagtagacagccctggagatgttcttgatcacacctaccaagaactgtttcgtgcaggaggctttgtgatatcagatgacaagatactagaagctgtaacattagttcaactgaaggaaattatcaaaatcctggaaaaactaaatggaaatggaagatggaagtggttgcttcactacagggaaaataaaaagctaaaagaagatgaaagagtggattcaactgcacataagaagaacataatgttgaagtcatttcagagtgcaaatatcattgaattgcttcattatcaccagtgtgactctcgatcatcaacaaaagcagaaattctgaaatgtttgctaaacctgcaaattcagcatattgatgccaggtttgctgtcctcctaacagacaagcctactatccccagagaagtctttgaaaatagtggaatccttgttacagatgtaaataactttatagaaaacatagaaaaaatagcagctccatttaggagtagctattggtgactcaactacagcctgcctggatatggatgatgccaataaaaaattagtattttccctttggaaaacttgtgaacatgtgaatacacatgtgaacagtcttacatttgaaaaaccaatgttctacaacttggaaagttttcattttttatattttgctgaaatatgtcacagtggcattgcagttgtctgttagctttgggttgcagtgctagatattgttttaaattattttcattttaaacaagatgccttctaagctattgagcttattaaaaataattttacatgtttacttagttggagcaaaaataagtctattttaacaaatagctttgtttttgcatgctaatgtcagaaaggcatacgatgcacattatgctctgttttaaaggttttaccacccttgtaaaaactataatcttaaatggttttatttgctgttacacaaacaacactacataaaacattttttcctaaatggtacaaatttataaactatcatttttcacttacggtatttgtaaatactacactacaaaaatcagctttctgagaaagaaataatcatttatttatgatattgaaaatttctacagtaaacactcaaaaccaagcaaaaaacatttgtaagatacacggtatctatttggagcaacggtttttgtaactaatgtgtttcattttttaaataaagacaact

SEQ ID NO: 3559 - DNA, 522 bp, Homo sapiens
cggccgcggcgtccctgtcagcgcccgcggcgaggaccccggggctggggcggacggcgtgcccctgaggggggtccccgcgggagcgcggagccggcgactggtgcttcccacgtgcgccggtgtcgcgagggcccgggaggacgcagagcacggccgggagaagcatgggaaggaggccgagccgggatctcaggtcctcgggggcggcggccacgccaaggacggtacaaaactttttaccaacaaaaaaaagcaagtagttatactcaggaagaacttcaagacacttacgggtttcttctgtttgatactgaaaagcaggcaaaattggtatgtcagtgtggactccgtgttggcagcagtgctgttaccactctgggtgatccagccaaagtattacttttacgaactttcaggcaacaccgttattgaacgacccagacagatctgtccttatgtaattgtagcttttcgatacagggaatctaaaactatggcaccaccagctcataaaagcat

SEQ ID NO: 3560 - DNA, 2656 bp, Homo sapiens
gccgacagccgcccgcccgcccgcccccgcgacgcccgcgcgcaacagttcccccaaagttgcagcccgggaggcgagcgcgcacgggcggccgaggggcgggcggttggcggggacgcggcctcgcggcccagagcggagagtcccggcgggcggcggcggcatgggcacccggcagaccaagggcagcctggcggagagagccagccccggcgccgcgccgggcccccgacgcgaacggccggacttctgggcgtcgctgctgctgcgcgccggggacaaggcggggcgcgcgggcgcggggatgcccccctaccaccggcgagtcggcatggtccaggagctgctgcggatggtgcgccagggccggcgggaggaggcggggacgctgctgcagcacctgcgccaggacctgggcatggagtcgacctcgctagacgacgttctgtatcgctacgccagcttccggaacctggtggaccccatcacacacgacctcatcatcagcctggcacgctacatccactgtcccaagccgcctcaaggctgtcctggccggaagccccccagacaacacagtggacctgtcgggaatcccactgacctcccgagacctggagcgggtgaccagctacctacagcgctgtggggagcaggtagacagcgtggagctgggcttcacaggcctcacggacgacatggtcctgcagctgctgccagcactcagcaccctgccccgcctcaccacactggcactcaatggcaaccggttgacccgggccgtgctgcgcgacctcactgacatccttaaggatcccagcaagttccccaatgtcacgtggattgacctgggcaacaacgtggacatcttctccttgccccagcccttcctgctcagcctgcgcaagcgctccccaaagcagggccacctacccaccatcctggagctgggtgagggcccaggcagtggggaggaggtccgggaagggacagtaggccaggaggaccctggagggggccctgtggcacctgccgaagaccaccatgagggcaaggagactgtagctgcagctcagacgtgacatggaagtgaagggcctcaccagggagtccttgttgggtagaatgggcaaggcaggcaggggagggcgcttctcctatcaggtgggttaaggatattgccaaaaattggcctgggccacccacctacagaaaggcaaaccatatcatctggggaaggggatttgtgttaaaacttcccgttggtcctctgcatctgccccctatcccattatctgccatttggttcttaagtcatcccaggccccagagaaccctctcagctcagctcatggccttccccaaagacttgtggaaatgggcacatggctggaggtactgtaagcctgagccattgtgaacaccaagagctttcccccagaaaaagaatacagtagggcccctacatgtactgcattacatttttcatttaggggaacaagctccaaccagaggaatgtgtccccactcaaggaaggtgggaatctttagcaaaattcctgtaactcctggttgcccgagaccccagttccatctatgctaggggtggactgaacgtggcctacctccttatggagacccagccctatttctgaggcccaccttgattctaggcatctgcccataggaccagctatcgctatatcctttgacagagcagcctacgatgccatgtggtagtgctcaggacagacatggtgcccatgcatacaggcataaagtcctgttcagaaatcccctatccaccttccctacccactgctggctgaaaaactaccagacttctatgtgggctctgatgtccttagcatgcagggtaagtgacaaacctggcttccttcttgtcacttgccagtatgacttcactgacctagacaggccgtaagaactctttccccataactcttaagtaatccaccaacacattccagaaaaccgactgcagaaggtgggctttaaaaccttaaaaacctaggacaatgaaggagtccaatcccttggcagatccaacaagatggctggggagagggagaaacaaactggaggctcccaaaggaacctaacttagcaaaggttctcatcttataccctccccttacccaaatactgtcctactgaaagggccctaccagttaagggatctcttctaaataacaggcaacccctagatccaagtagttcagtccaggaagactgggagccaatcactcttgaaccttgtgggcaaacagtatgggggaggaccctcttgacaggccttggtaggcaagattccaacacaggaagacagcaagatggggcctagagtatggggccctacatgctgttaaggttgtggttaggaatggtgcaatgctgcaggagctggaacaaagctacaccaaggaacagagcacagagcagcaggggccgaaattgaggaggccttaaatgctttgagcttttgccttcagtctaaagctgtagaatagggggttaagagcttaggctgaccacagggaagtttacaagctagagcgaatatctggactgctaatatctgacaacagtaggcgaaatttactttttcttcaaatacacattttcaagaattgac

SEQ ID NO: 3561 - DNA, 1390 bp, Homo sapiens
gcggagagtcccggcgggcggcggcggcatgggcacccggcagaccaagggcagcctggcggagagagccagccccggcgccgcgccgggcccccgacgcgaacggccggacttctgggcgtcgctgctgctgcgcgccggggacaaggcggggcgcgcgggcgcggggatgcccccctaccaccggcgagtcggcatggtccaggagctgctgcggatggtgcgccagggccggcgggaggaggcggggacgctgctgcagcacctgcgccaggacctgggcatggagtcgacctcgctagacgacgttctgtatcgctacgccagcttccggaacctggtggaccccatcacacacgacctcatcatcagcctggcacgctacatccactgtcccaagccggaaggcgatgcactgggcgccatggagaagctgtgccggcagctgacataccacctcagcccccactcccagtggaggcggcaccgggggctggtgaaaaggaagccacaggcctgcctcaaggctgtcctggccggaagccccccagacaacacagtggacctgtcgggaatcccactgacctcccgagacctggagcgggtgaccagctacctacagcgctgtggggagcaggtagacagcgtggagctgggcttcacaggcctcacggacgacatggtcctgcagctgctgccagcactcagcaccctgccccgcctcaccacactggcactcaatggcaaccggttgacccgggccgtgctgcgcgacctcactgacatccttaaggatcccagcaagttccccaatgtcacgtggattgacctgggcaacaacgtggacatcttctccttgccccagcccttcctgctcagcctgcgcaagcgctccccaaagcagggccacctacccaccatcctggagctgggtgagggcccaggcagtggggaggaggtccgggaagggacagtaggccaggaggaccctggagggggccctgtggcacctgccgaagaccaccatgagggcaaggagactgtagctgcagctcagacgtgacatggaagtgaagggcctcaccagggagtccttgttgggtagaatgggcaaggcaggcaggggagggcgcttctcctatcaggtgggttaaggatattgccaaaaattggcctgggccacccacctacagaaaggcaaaccatatcatctggggaaggggatttgtgttaaaacttcccgttggtcctctgcatctgccccctatcccattatctgccatttggttcttaagtcatcccaggccccagagaaccctctcagctcagctcatggccttccccaaagacttgtggaaatgggcacatggctggaggtactgtaagcctg

SEQ ID NO: 3562 - DNA, 1238 bp, Homo sapiens
ttcggcgaccatcgcgcggcggccatgggggcgcggctgggccggcgggccgggcccgaggctggctctgaggccggggcggcggccggctgcgggcccgcgccctacgagcgccgggtgcggtggctccgcgagatccagtccacgctccgcgagcggcggccggagcgcgcccggcagctgctgcgcctcctgcgccaggacctgggccttgagaggaccctccttcctgatatcctctacagagatgtggccttcctcaacccggtcgaccccatctcccatgacctgcttgtgaacctggcccgggacctgcagtgccccaagaaggactatgagctctggaagtcctcggacaagatctgccgacagctcatctaccacctcacccctcactcgaagcagcagcaagggtccagcctgcgccagaggaagacccagagctgcctcaagagcagcctccagaagactctgctggcaggggagactgtggacctctcaggcatcccgctgtcgacacaggacgtgcaacacatcacacgctacctgagcagccatggtgctgtgctggcggtgctggacctgagcttcacggggctgagtgatgagctgctgcacctcctgctgcccagcctgtgggcgctgccccgcctcacccagctcctgctcaacggcaaccgactgacgcgggccactgcccgcaagctcactgatgccatcaaggacaccaccaagttccctgctttggcttgggtggacctgggcaacaacgtggatgtggcttccctgccccagcccctgctggtcggcctgcgccggcggctgagccagcgcacctcactccccaccatctacgagggcctggaccttgagcctgagggcagtgcggccggggccaccacccctgcctccacctgggactccacagctgctgggctgggacccgagccccaggcctgctgtgccaggtgacccaccacccacctggctcattgctactgacttgtgatgctctcaagcacatgatagtgggcgatgaaggtcaaggaggactcacaggcccccagaaatccagtgtaaatgctcagcctgagattaaggggacagaagaatggactcataggtggccaggtggccagccctggctagaggctcagccttccctcagtgggaggggccccagcacccacagtgtggaccccgcaataaagagtgacacccgcctctgcttttctgca

SEQ ID NO: 3563 - DNA, 1040 bp, Homo sapiens
gggagctacggagagcgaggagtcgcgcaggcaggcggaggctgagggcgccgctggccggccctcccagccctctccgcgcggctccgccggggttccaagaggagctagtaggttcggtgggggccctggcatggacatgcacagcgctcggcttgacagcttccttagccagctccgctgggaactgttgtgtggtcgggacacaggctcaccctcaatgcctggtcccctgcagccaacctcccaaactggcccagatgtgcagcccagccaccagcttagggcctcgggtgccttggaagaggactcagtctgctgtgtggaggaggaggaagaggaggaggaggaagcagtggtgacagaagacagggatgcagccttgggaggccccagggagcatgccctggactgggactctggcttctcggaggtgtcaggcagcacatggcgagaggaagaactgcctgtatcccagcgcccagcaccctcagcacagccccttcgtaggcagtgcctctcagtcagtggcctccccatgcccagcagggcccctgtagccagtgtaccacctgtccaccatccacggcccaagtccaccccagacgcctgcctggagcactggcagggactggaagcagaggactggacagcagccctactgaacaggggtcgcagtcgccagcccctggtactaggggacaattgctttgctgacttggtgcacaactggatggagctgcctgagacagggagtgaagggggtgacggaggtgggcaccgtgcccgtgctcggccccctcagttcctgcttggcctctctgagcagcttcggcgccggctggccagggctcggcggacagctatggcaggaaagcggctgtcatgcccacctcgcccagaacctgaactgcctgcggatgtctcacgctttgcagctctcatgagctgtcgtagccgccagcccatcatctgcaatgatgtcagctacctctgaccctgccctccagcctgggacaataaaagccttttttctagac

SEQ ID NO: 3564 - DNA, 5980 bp, Homo sapiens
gaccgcgcgcggctagccgctggggaagcgactctgagtcccgggctcggagcgcaggctcagctccgcgctgcgagcgctacgggcgcaggggcggggagccggcccggagcgcagtttccagtggggccggggtttcacccgggccctctctgtttgaaccgaacccgacaaatgggcgcatgacgatggagagcagggaaatggactgctatctccgtcgcctcaaacaggagctgatgtccatgaaggaggtgggtgatggcttacaggatcagatgaactgcatgatgggtgcactgcaagaactgaagctcctccaggtgcagacagcactggaacagctggagatctctggagggggtcctgtgccaggcagccctgaaggtcccaggacccagtgcgagcacccttgttgggagggtggcagaggtcctgccaggcccacagtctgttccccctccagtcaaccttctcttggcagcagcaccaagtttccatcccataggagtgtctgtggaagggatttagcccccttgcccaggacacagccacatcaaagctgtgctcagcaggggccagagcgagtggaaccggatgactggacctccacgttgatgtcccggggccggaatcgacagcctctggtgttaggggacaacgtttttgcagacctggtgggcaattggctagacttgccagaactggagaagggtggggagaagggtgagactgggggggcacgtgaacccaaaggagagaaaggccagccccaggagctgggccgcaggttcgccctgacagcaaacatctttaagaagttcttgcgtagtgtgcggcctgaccgtgaccggctgctgaaggagaagccaggctgggtgacacccatggtccctgagtcccgaaccggccgctcacagaaggtcaagaagcggagcctttccaagggctctggacatttccccttcccaggcaccggggagcacaggcgaggggagaatccccccacaagctgccccaaggccctggagcactcaccctcaggatttgatattaacacagctgtttgggtctgaatcctagagacagaaagttgactgagcctgaaagggccaggtcccagtgctgggcccctggggaggagggagggtgggcggtatggctctcgaaagcccaactccaagttcctttcccccagaaagcggggagaagccagagttcttggctcaggactgaagggaaggtggttgggagaggctgtcttgggggctagctggtggaggaggtaagagtagctggagagtgagctgtgcgtgtgtgtgtgtgtgtgtgcatgtgtgtgtctgtctggcatgcatgcactcactttggggctggaggtgacagtaggtgagggcagaggaggagatcagaaaatccctctgacatctccactgcccccaaagacctccgttgaacattctgtatggaaaagagccctggagcatcaggttccccagataggcccccaaataaagacctgtctatggctctcccaaccttctgtcagcttctttggcaagacattgctccaggcacagggactgaaccccaggcctcctgggactggagcagcagtgaggcaaaacccgacctgctagccctttctgccttggaggtttcagtccatacctggactctgagaaaatgagctgaataaggagtacagtgtgtaaggagcagccagggaagccctagacactccccgcgtctcccccatgcacaggggaaggatgttgacatagcactgggctgtttgaatgccttttcatctccatggtctcatttgaaagtgagcgaggcaggcaggcatgatcccattttccagataaggaaacaagcctagatatgctacatgtccaggaacaactgcagccaggaggcagaacagcctaggtctaactgcagagtagaagctggaccctggagttaccaacactcctccccaacagttcttagcaccccgcaggctgggcgctgtggctcacgcctgtaatcccagcactttgggagggcaaggcaggcggattacctggggtcaggagttcatgaccagcctggccaacatggtgaaaccccgtctctactaaaaaaatacgtaaaaattagccaggcgtggtggcacacgcctgtaaacccagctacttgggaggctgaggcaggagaattgcttgagcccgggagagggaggttgcagtgaggcgagatcatgccactgcactccagcctggctgacagagcaagactcccctgtctcaaaaaaaataaaaaaaaacagttcgtagggccccataccccacaacccctgtctcctgcacttaactcccacctgggtcagagaacagccaattcaccagtgaggtagaagtgaacccagaagaaatagccacttgattttaaaattcccagctccattccgtggccttctccccactagacacagcagtcccaggcctcctgttccctcctcacctagaggcagccgggacggagggggaagggccaggcagcagctcagctccggcttctctaaagccactctgggcacgtggcccaggagggccacctagtgatccaggcccccccccaggactgccctgggaagccactgtccctcccactccagtagggaacactcactggctgggaaaagacaatgtggatcttcttttgggctgaccaagccaggagggcacaccctcccactgcccctctctgcctcccactgattgtccctcagcctgatggggtgtgacagctgcaattagaggcaggattccttcccaccctcaaagcattaatagccagttggagaggcaaaatagtaagaaaaggctcttctgcttgcttcctggatccctggggagagtggagagaggggcagagctcaagatgggattatgggggcgcagccgcggtggttagggtcactctcaaatcctacccagtcaaatggtaagatgtttcatttttggtgggggagctgcaggagggaggaaggcgctcatgctttttgggttttgttgagcactcactgtctgtcaggtaatgtgcacatctctcaaacttagaaggaccctagaaggcattgttctccagacacatctatggaggttattagggggcgtgtaaactgccccgattaggctgctagcaaaggaaaggacagagatttgaacagagggttgggttatctggctccaaaacccctgtccttttcttgctatttctctacctggagtttgccaactgagcaagcccactctggtggagccagccactgcaaatcctttgtgtcttcccagagaataccaacatttcagttttgagtgagggaacgttggctctgactgcctttggaggtggagatggtggaggtggtggtggtggtggtggtagtggtggtgtgtgtgtgtgtgtgtgtgtgtgtgtgtgtgtgcctgcgcgtgctaagaaactgcatgttaagattccacctactgaatcatgagcggaggaagtcgtgggacactggctggtggagaagccatctagcatattattcaagatgacaccagctccaagtctggaatgagtctgtgggaaaccaaggtacttcttggacattcacctataactcacgtgtttcgtggactggtcacagtggttcggataaattgaacagaactttatgaacacctcccagcaccaggtgttgttatagaaactaagaacagagcaatgagaaggacccaactcctgctctcaaatggatgcagtggaaaataagcagactttgaaccattggttagtcagaagagacttgggagactgaaaacttgtttcaacttgggccagaacaaaaaattaggaagcaacacttgctgccaacatgatttacaagtgccagcaccttcacctctgttacttccttctcactacacactgaaagcagttgctcttgttttacatggacaggctcagagaagttaagcaacttgtccaaggtcacacagtagtggaattgagattgaatcagttccaactgacttgcaatcttgtgcttttcagacgatcccactaattgtccatatctgttccaaagccaaatcaagaggaacaagagcaaaatctgtcctctcatattattcatggtcctgcgtggatcataaatggcatgctgactgtctgatggagacttacttttcccttccccctggacacctgccatggcaatgacagaggctgtattttactgaagtggagggaagaggtgaatgcaaatgcctagggcctaagtatacaggaaggtgtagggagaggtaagcagtgtgtatgtggaggagatagcagacgtaagcagagagaaatcagagagcttagttcttcctctggggcgcactttgtggttaattaggacatgcaaatgagctagaagctcatttaatatcctccctgacatgtagccccaccccaccctgccccacttccctggcaggtacaagggccacctgattggcccaggtatctgtggaaggttccacctgcttctttgtggcccagggaacagaaaagagtccctgctgggcatgctagtggggccggcctggtctccctcctccctttctcttcccaacctttcagacttgggacctctcttttccctctccctcagacacttcccttgtgccccgcccctcagggtgatctctgaacccaaacttgccccaaagaaggttgctctgtcctctccacatccccatctcctccctagggccttgttggggagaggctcctccatctttcccaagtcacaccatcgtttcctacgtggtctggacaagagcaagagcacaccttgtccccaccttctccagagcagccagaacccacctcaggtgccttccccatccggtgcagttaaggcacttctgccagcaccatggtatgagcactagacttggagttaagatttgagagccccctctgtcactgtggaagcttgagcatgttgcttgatctctctgaaccttgtgtttctcatctgtgaaaggtgataatgtggggctgctgtgagatttaaaggacataatgcacctacggtccaagcactgcctggaatacagcagaagctcagcagatactggacaacccatccccttagtagaggcactaaccatgtgacccaaggcaaaagtgcttaagaaaaagtgctttctctgagcgttggtctcttcttctgtcgaaacatttatattgatttaatatctcacaggattgtagcaagggtcagagaagacaataggtgacatgtttttgtacactgtatactagccacccagatgggctgttatttgctaaatggcaaatttacactgttccccaaaggatgacatgcactggggaggcggggggtgtggaggtggagaaaggctgagcttggagaaaaggtgcttgaggaccccactgcctaaggacctgctctaggaaacattcccactccctacaccctagctgcccctcacagtcaacccttaaggacctcaaattcttggcaaggggtaaagagttgaaagtgccaagtcctagtggttttgagaagcctctggtctgctctttctgctctgtaaagtcttagttgccagagtcccctatagcccccacatcgctcccttcctcctgccctccggccaccctggaaactaatggcctaaaggtgctgtggctgtcctcctaaaatccattccctcctgatggggtggaggaatctgtgaagcccaccttcaggagaggtctcggggctcgggctggtgctgccagagaaagggtgactgaaccagaaaggcctaggggaaagcagctcaaactgcagccatccccttagtacgattactaggatgtcccttgccttccttttgcctcctccacccaacccctaaaataaacagtatgatgaaacctc

SEQ ID NO: 3565 - DNA, 1423 bp, Homo sapiens
aacacgcccggcctggaagtggaagaaagggacgggagtcggaggctgagagactgcccagacacacaaaaaatgtggcctgaggaaagccccaagagggaggagaggaaagatgaggcaactgatgtccatgaaggaggtgggtgatggcttacaggatcagatgaactgcatgatgggtgcactgcaagaactgaagctcctccaggtgcagacagcactggaacagctggagatctctggagggggtcctgtgccaggcagccctgaaggtcccaggacccagtgcgagcacccttgttgggagggtggcagaggtcctgccaggcccacagtctgttccccctccagtcaaccttctcttggcagcagcaccaagtttccatcccataggagtgtctgtggaagggatttagcccccttgcccaggacacagccacatcaaagctgtgctcagcaggggccagagcgagtggaaccggatgactggacctccacgttgatgtcccggggccggaatcgacagcctctggtgttaggggacaacgtttttgcagacctggtgggcaattggctagacttgccagaactggagaagggtggggagaagggtgagactgggggggcacgtgaacccaaaggagagaaaggccagccccaggagctgggccgcaggttcgccctgacagcaaacatctttaagaagttcttgcgtagtgtgcggcctgaccgtgaccggctgctgaaggagaagccaggctgggtgacacccatggtccctgagtcccgaaccggccgctcacagaaggtcaagaagcggagcctttccaagggctctggacatttccccttcccaggcaccggggagcacaggcgaggggagaatccccccacaagctgccccaaggccctggagcactcaccctcaggatttgatattaacacagctgtttgggtctgaatcctagagacagaaagttgactgagcctgaaagggccaggtcccagtgctgggcccctggggaggagggagggtgggcggtatggctctcgaaagcccaactccaagttcctttcccccagaaagcggggagaagccagagttcttggctcaggactgaagggaaggtggttgggagaggctgtcttgggggctagctggtggaggaggtaagagtagctggagagtgagctgtgcgtgtgtgtgtgtgtgtgtgcatgtgtgtgtctgtctggcatgcatgcactcactttggggctggaggtgacagtaggtgagggcagaggaggagatcagaaaatccctctgacatctccactgcccccaaagacctccgttgaacattctgtatggaaaagagccctggagcatcaggttccccagataggcccccaaataaagacctgtctatggctctcccaa

SEQ ID NO: 3566 - DNA, 4205 bp, Homo sapiens
taaacttggccgcggttgccgcaggaaggctagccagagggtaattacacagcattttgaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgcccaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcaacacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttagtacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattgaggactacactgaaacattcaaatgtgtggcgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatgggtgtgattactttagagtcccttggtaaaaggggttatcgagtacctccttcaggaacaatacaagtgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagtttgcaagtaaaaattagcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgttgaaaccacttcattggacatgttgcaatagcaaaacccccagttagattagtgtttacacattttctcagttatttaatatttaatgttttccttaatactcaagtgatgtttgtctctagtgttctaatgtagcacaaatcctatgtaaaatcatactatgtatttttgacattaatgttgaaatcaaatatatgcacaagtctttaattttgtgtaatgtgttaagtgctgttcatttaagttattgaaaatgagaataaaatgttgagcttctttaaaagtaacacactatgcaagcatgtgtactttttatatctctcatgtttagtttttataacaccatatccaggttgctatctcacatagtagtcctttaacatattgtattagcagtgcaatgtggactaagctgcttcactttccctttgcaagttcagatcatcatgcccattcatagccaggattccttatccccaaaacagttctatttttccttaatcactactatagagtctttacattaaattactgtcgtatgctagataattttctcaaattgttaaaagaatatgtactttggaaacaaattagtatttatattgtaaatatattc

SEQ ID NO: 3567 - DNA, 4052 bp, Homo sapiens
atcaggcccagatcagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgcccaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcaacacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttagtacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattgaggactacactgaaacattcaaatgtgtggcgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatgggtgtgattactttagagtcccttggtaaaaggggttatcgagtacctccttcaggaacaatacaagtgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagtttgcaagtaaaaattagcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgttgaaaccacttcattggacatgttgcaatagcaaaacccccagttagattagtgtttacacattttctcagttatttaatatttaatgttttccttaatactcaagtgatgtttgtctctagtgttctaatgtagcacaaatcctatgtaaaatcatactatgtatttttgacattaatgttgaaatcaaatatatgcacaagtctttaattttgtgtaatgtgttaagtgctgttcatttaagttattgaaaatgagaataaaatgttgagcttctttaaaagtaacacactatgcaagcatgtgtactttttatatctctcatgtttagtttttataacaccatatccaggttgctatctcacatagtagtcctttaacatattgtattagcagtgcaatgtggactaagctgcttcactttccctttgcaagttcagatcatcatgcccattcatagccaggattccttatccccaaaacagttctatttttccttaatcactactatagagtctttacattaaattactgtcgtatgctagataattttctcaaattgttaaaagaatatgtactttggaaacaaattagtatttatattgtaaatatattc

SEQ ID NO: 3568 - DNA, 4049 bp, Homo sapiens
agaccagatgcagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgcccaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcaacacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttagtacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattgaggactacactgaaacattcaaatgtgtggcgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatgggtgtgattactttagagtcccttggtaaaaggggttatcgagtacctccttcaggaacaatacaagtgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagtttgcaagtaaaaattagcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgttgaaaccacttcattggacatgttgcaatagcaaaacccccagttagattagtgtttacacattttctcagttatttaatatttaatgttttccttaatactcaagtgatgtttgtctctagtgttctaatgtagcacaaatcctatgtaaaatcatactatgtatttttgacattaatgttgaaatcaaatatatgcacaagtctttaattttgtgtaatgtgttaagtgctgttcatttaagttattgaaaatgagaataaaatgttgagcttctttaaaagtaacacactatgcaagcatgtgtactttttatatctctcatgtttagtttttataacaccatatccaggttgctatctcacatagtagtcctttaacatattgtattagcagtgcaatgtggactaagctgcttcactttccctttgcaagttcagatcatcatgcccattcatagccaggattccttatccccaaaacagttctatttttccttaatcactactatagagtctttacattaaattactgtcgtatgctagataattttctcaaattgttaaaagaatatgtactttggaaacaaattagtatttatattgtaaatatattc

SEQ ID NO: 3569 - DNA, 3687 bp, Homo sapiens
acacggagggaagcgggatcagcacccaacgctgaacatttgttttaaccgctgcagacatctggatccctcagttactgatagtatagctattgatagccagaaggcaacttcctttatacaaggattccagtatggttttcagtggaaacaaagggcttcacagagaagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgcccaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcaacacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttagtacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattgaggactacactgaaacattcaaatgtgtggcgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatgggtgtgattactttagagtcccttggtaaaaggggttatcgagtacctccttcaggaacaatacaagtgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagtttgcaagtaaaaattagcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgttgaaaccacttcattggacatgttgcaatagcaaaacccccagttagattagtgtttacacattttctcagttatttaatatttaatgttttcctt

SEQ ID NO: 3570 - DNA, 2273 bp, Homo sapiens
ggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccaaagcccttcacagaatgtcccccacccctaacagctgcccactgcccctccccctctgcagaatgtctggggtcctatgttccaggaacctgtttactttcaaattttccctgtttcagttggactcaggagcatctggtgagccaggtcactctctgggtcttacccttggcttttctcattgcggaaactgccagacagcggtggtcagtgcccagcctgaggggatggcttcaaatggagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaccctccccagcacacctctggtgacagaacaggatggctgcggcccgagtggggccggggcttccaacgtctttgtccagatgaggacagaggtggggcctgtgaaggccgctcaggcgcagaccttggtcctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatccctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtggaggccgtcattcatccccaattcctggaagaattgctttccccagatccacagatggatttcttggccctaagccaggagctggagcaggaggaaggactcacccttgcccagggagccccttcagatgctccagggactgacagatgctga

SEQ ID NO: 3571 - DNA, 3286 bp, Homo sapiens
ggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccaaagcccttcacagaatgtcccccacccctaacagctgcccactgcccctccccctctgcagaatgtctggggtcctatgttccaggaacctgtttactttcaaattttccctgtttcagttggactcaggagcatctggtgagccaggtcactctctgggtcttacccttggcttttctcattgcggaaactgccagacagcggtggtcagtgcccagcctgaggggatggcttcaaatggagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaccctccccagcacacctctggtgacagaacaggatggctgcggcccgagtggggccggggcttccaacgtctttgtccagatgaggacagaggtggggcctgtgaaggccgctcaggcgcagaccttggtcctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatccctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtggaggccgtcattcatccccaattcctggaagaattgctttccccagatccacagatggatttcttggccctaagccaggagctggagcaggaggaaggactcacccttgcccagctagtggagaagcgcctcctacccttgaaggagaaacagcatgcgagggcagcccctagtcgtggcacagcccggttggactcaagttcttctaagtttgcagctggccaaggagcagagagagacgtccctgtcccccaacaaggggttggcatggaaacctgcccaccccagacgactgcccgggactctcagggacgaggcagagcacacactggcatggccaggtccaaagactctgttgtgcttttgggatgtcaggattcccctgggctgagggctgcccggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagttcccatctgctgagagaagaggcctcaacctagcaccttctcctgccaacaaggccaagaagcgacctctctttggaagcctgtcccctgctgaaaagacaccccacccagggcctgggctcagggtctctggggagcaatccctgacttgggggctgggtggcccctcacagtctcaaaagagaaagggtgaccccttggtctccaggaaggagaagaagcagcgttgtagccagtaggggcttctgagcaggctctctggggccgatccccaaggatggggctctggcatccgatgccccaaagcggtcaaaagcttcttctcccccagtgctgatcttgctgggccttagctttggagggtaggggagggaggggagggagagggtggctgaatggggagggcaggaagggagggtctggggggaaggggctggggagtgggggtgggaagcagtgcgttgggggcctcgtgtgtaagtgtgaataaatgtagttgtcttgg

SEQ ID NO: 3572 - DNA, 3282 bp, Homo sapiens
ggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccaaagcccttcacagaatgtcccccacccctaacagctgcccactgcccctccccctctgcagaatgtctggggtcctatgttccaggaacctgtttactttcaaattttctttcagttggactcaggagcatctggtgagccaggtcactctctgggtcttacccttggcttttctcattgcggaaactgccagacagcggtggtcagtgcccagcctgaggggatggcttcaaatggagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaccctccccagcacacctctggtgacagaacaggatggctgcggcccgagtggggccggggcttccaacgtctttgtccagatgaggacagaggtggggcctgtgaaggccgctcaggcgcagaccttggtcctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatccctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtggaggccgtcattcatccccaattcctggaagaattgctttccccagatccacagatggatttcttggccctaagccaggagctggagcaggaggaaggactcacccttgcccagctagtggagaagcgcctcctacccttgaaggagaaacagcatgcgagggcagcccctagtcgtggcacagcccggttggactcaagttcttctaagtttgcagctggccaaggagcagagagagacgtccctgtcccccaacaaggggttggcatggaaacctgcccaccccagacgactgcccgggactctcagggacgaggcagagcacacactggcatggccaggtccaaagactctgttgtgcttttgggatgtcaggattcccctgggctgagggctgcccggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagttcccatctgctgagagaagaggcctcaacctagcaccttctcctgccaacaaggccaagaagcgacctctctttggaagcctgtcccctgctgaaaagacaccccacccagggcctgggctcagggtctctggggagcaatccctgacttgggggctgggtggcccctcacagtctcaaaagagaaagggtgaccccttggtctccaggaaggagaagaagcagcgttgtagccagtaggggcttctgagcaggctctctggggccgatccccaaggatggggctctggcatccgatgccccaaagcggtcaaaagcttcttctcccccagtgctgatcttgctgggccttagctttggagggtaggggagggaggggagggagagggtggctgaatggggagggcaggaagggagggtctggggggaaggggctggggagtgggggtgggaagcagtgcgttgggggcctcgtgtgtaagtgtgaataaatgtagttgtcttgg

SEQ ID NO: 3573 - DNA, 2741 bp, Homo sapiens
ggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccaaagcccttcacagaatgtcccccacccctaacagctgcccactgcccctccccctctgcagaatgtctggggtcctatgttccaggaacctgtttactttcaaattttccctgtttcagttggactcaggagcatctggtgagccaggtcactctctgggtcttacccttggcttttctcattgcggaaactgccagacagcggtggtcagtgcccagcctgaggggatggcttcaaatggagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaccctccccagcacacctctggtgacagaacaggatggctgcggcccgagtggggccggggcttccaacgtctttgtccagatgaggacagaggtggggcctgtgaaggccgctcaggcgcagaccttggtcctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatccctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtggaggccgtcattcatccccaattcctggaagaattgctttccccagatccacagatggatttcttggccctaagccaggagctggagcaggaggaaggactcacccttgcccagctagtggagaagcgcctcctacccttgaaggagaaacagcatgcgagggcagcccctagtcgtggcacagcccggttggactcaagttcttctaagtttgcagctggccaaggagcagagagagacgtccctgtcccccaacaaggggttggcatggaaacctgcccaccccagacgactgcccgggactctcagggacgaggcagagcacacactgcctcgggccttctcagcccagaaaagtggggaccccagggaactcatcagttcccatctgctgagagaagaggcctcaacctagcaccttctcctgccaacaaggccaagaagcgacctctctttggaagcctgtcccctgctgaaaagacaccccacccagggcctgggctcagggtctctggggagcaatccctgacttgggggctgggtggcccctcacagtctcaaaagagaaagggtgaccccttggtctccaggaaggagaagaagcagcgttgtagccagtag

SEQ ID NO: 3574 - DNA, 2239 bp, Homo sapiens
cctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatccctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtggaggccgtcattcatccccaattcctggaagaattgctttccccagatccacagatggatttcttggccctaagccaggagctggagcaggaggaaggactcacccttgcccagctagtggagaagcgcctcctacccttgaaggagaaacagcatgcgagggcagcccctagtcgtggcacagcccggttggactcaagttcttctaagtttgcagctggccaaggagcagagagagacgtccctgtcccccaacaaggggttggcatggaaacctgcccaccccagacgactgcccgggactctcagggacgaggcagagcacacactggcatggccaggtccaaagactctgttgtgcttttgggatgtcaggattcccctgggctgagggctgcccggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagttcccatctgctgagagaagaggcctcaacctagcaccttctcctgccaacaaggccaagaagcgacctctctttggaagcctgtcccctgctgaaaagacaccccacccagggcctgggctcagggtctctggggagcaatccctgacttgggggctgggtggcccctcacagtctcaaaagagaaagggtgaccccttggtctccaggaaggagaagaagcagcgttgtagccagtaggggcttctgagcaggctctctggggccgatccccaaggatggggctctggcatccgatgccccaaagcggtcaaaagcttcttctcccccagtgctgatcttgctgggccttagctttggagggtaggggagggaggggagggagagggtggctgaatggggagggcaggaagggagggtctggggggaaggggctggggagtgggggtgggaagcagtgcgttgggggcctcgtgtgtaagtgtgaataaatgtagttgtcttggaaaa

SEQ ID NO: 3575 - DNA, 2239 bp, Homo sapiens
cctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcatggagagagcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatcgctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcaaagtgaagcagccacaggaagaggactggacgcccccagacccgggcctcctgagctacattgacaagctgtgttcccagaaagacttcgtcaccaaggtggaggccgtcattcatccccaattcctggaagaattgctttccccagatccacagatggatttcttggccctaagccaggacctggagcaggaggaaggactcacccttgcccagctagtggagaagcgcctcccacccttgaaggagaaacagcatgcgagggcagcccctagtcgtggcacagcccggttggactcaagttcttctaagtttgcagctggccaaggagcagagagagacgtccctgacccccaacaaggggttggcatggaaacctgcccaccccagatgactgcccgggactctcagggacgaggcagagcacacactggcatggccaggtccgaagactctgttgtgcttttgggatgtcaggattcccctgggctgagggctgcctggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagtccccatctgctgagagaagaggcctcaacctagcaccttctcctgccaacaaggccaagaagcgacctctctttggaagcctgtcccctgctgaaaagacaccctacccagggcctgggctcagggtctctggggagcaatccctgacttgggggctgggtggcccctcacagtctcaaaagagaaagggtgaccccttggtctccaggaaggagaagaagcagcattgtagccagtaggggcttctgagcaggctctctggggccaatccccaaggatggggctctggcatccgatgccccaaagcggtcaaaagcttcttctcccccagtgctgatcttgctgggccttagctttggagggtaggggagggaggggagggagagggtggctgaatggggagggcaggaagggagggtctggggggaaggggctggggagtgggggtgggaagcagtgcgttgggggcctcgtgtgtaagtgtgaataaatgtagttgtcttggaaaa

SEQ ID NO: 3576 - DNA, 3970 bp, Homo sapiens
ggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccgaagcccttcacagaacgtcccccacccctaacagctgcccactgcccctccccctctgcagaatgtctggggtcctatgttccaggaacctgtttactttcaaattttccctgtttcagttggactcaggagcatctggtgagccaggtcactctctgggtcttacccttggcttttcttattgcggaaactgccagacggcggtggtcagtgcccagcctgaggggatggcttcgaatggagcatacccagtgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaccttccccagcacacctctggtgacagaacaggatggctgcggcccgagtggggccggggcttccaacgtctttgtccagatgaggacagaggtggggcctgtgaaggccgctcaggcgcagaccttggtcctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcatggagagagcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatcgctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcaaagtgaagcagccacaggaagaggactggacgcccccagacccgggcctcctgagctacattgacaagctgtgttcccagaaagacttcgtcaccaaggtggaggccgtcattcatccccaattcctggaagaattgctttccccagatccacagatggatttcttggccctaagccaggacctggagcaggaggaaggactcacccttgcccagggagccccttcagatgctccagggactgacagatgctgaggaagccctgatccctcccactaccgactcacaaggccctgcctgctttagggaggcttcttggggccccccatcgtcatcagcatccctggaaaatcctgggattggagagagctggctggctcttgttctgctcggtgggagctgaggagaaggcagccacctgcaacatggacatggggagaggaggctgctcctgcttaaccctcatcaggaagagcgcgggcactgggctgaggggagacgttgaggtgaccatccacacaggtgtgtttgggatacgatgatgggtggggagcaggggaagtccttctgcctgtttctgggcaggagagagtcttgtccaactagctaaagcagatgctccttgctgtggccacagggactggcctcggggccctcaaggtcctgcatggagccccccacagctatgattcccttcccatatgatgactgaactcatgtggaattgatgtagacacagatttacattggtttctaaaacagttccctcccaacacaccatcaccaatgggaacaaacatgtccagtccatcaggcgcagggtgggtgtttctgctggttccagggcccggaggagctggggcccaggccaagaggggccgagggtcagccgcccttctgccaggcacagaccccaagggcagagcaggggctgcctgggatgtggcattggctgtctgggaagtgacctgggagttgggggctaggtgttcgccaaagggagacttccagagtctacgagtgagatgaggactgcatcaggagagggaccgaggctggggaggatgctctgctctttcccaggttgtcctgtcctcccaatctctgctgaactgccctcaccccatgggccaacttctgccccccttacccctaacccacctcttagaatctcagatcccagcatggacaggacccggcacccaccctggttccctcctggccaacaccttcttctccacggtctgagttctgattcctcccccagggcgcttattggctcaggacccctgtgactgccagggcactggtcccagcactgcctgcgtgcagagctgtggtcacggcgctgggggctggcccagcagcagaggctggtggggcaaagctgtctggtacacggtggcctggcccctcggccaagtgacaaagggagccatgtttgggtcctctctggccccatctgcccacagaacacagcagtcagcctgacagatgcccctctgccccgtcccttctgctcgatgtgggcagtgtcggaggcctgctgtcttctgtggcctttgggaaggagagtttatcttggcagggcttccccagctcagtgcacatcaggccctcggggaaaatgtggggagcgaagagtcactggtgggtgatgtgggcagctcccgtgactcctctacattcagggccatcctcaagagataaggtagcactgcccctttgcagggtttaggaatgttaagtgagccgtgtttgaagggaacatggtccatactctggcgtgtgtgggtgcccagccaacttcctcacctaagggtgaaagtgacaccttggggctcctgctggttaccccactggctgttgtctatcccactgtccctgtccttgtcttggctgagccattcctaggaagcagaacttgtgcttcctccacctctgtgtcccacctgagccctacaatctgcccctaaatgggcacagtggggctgactggggggc

SEQ ID NO: 3577 - DNA, 3286 bp, Homo sapiens
ggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccgaagcccttcacagaacgtcccccacccctaacagctgcccactgcccctccccctctgcagaatgtctggggtcctatgttccaggaacctgtttactttcaaattttccctgtttcagttggactcaggagcatctggtgagccaggtcactctctgggtcttacccttggcttttcttattgcggaaactgccagacggcggtggtcagtgcccagcctgaggggatggcttcgaatggagcatacccagtgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaccttccccagcacacctctggtgacagaacaggatggctgcggcccgagtggggccggggcttccaacgtctttgtccagatgaggacagaggtggggcctgtgaaggccgctcaggcgcagaccttggtcctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcatggagagagcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatcgctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcaaagtgaagcagccacaggaagaggactggacgcccccagacccgggcctcctgagctacattgacaagctgtgttcccagaaagacttcgtcaccaaggtggaggccgtcattcatccccaattcctggaagaattgctttccccagatccacagatggatttcttggccctaagccaggacctggagcaggaggaaggactcacccttgcccagctagtggagaagcgcctcccacccttgaaggagaaacagcatgcgagggcagcccctagtcgtggcacagcccggttggactcaagttcttctaagtttgcagctggccaaggagcagagagagacgtccctgacccccaacaaggggttggcatggaaacctgcccaccccagatgactgcccgggactctcagggacgaggcagagcacacactggcatggccaggtccgaagactctgttgtgcttttgggatgtcaggattcccctgggctgagggctgcctggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagtccccatctgctgagagaagaggcctcaacctagcaccttctcctgccaacaaggccaagaagcgacctctctttggaagcctgtcccctgctgaaaagacaccctacccagggcctgggctcagggtctctggggagcaatccctgacttgggggctgggtggcccctcacagtctcaaaagagaaagggtgaccccttggtctccaggaaggagaagaagcagcattgtagccagtaggggcttctgagcaggctctctggggccaatccccaaggatggggctctggcatccgatgccccaaagcggtcaaaagcttcttctcccccagtgctgatcttgctgggccttagctttggagggtaggggagggaggggagggagagggtggctgaatggggagggcaggaagggagggtctggggggaaggggctggggagtgggggtgggaagcagtgcgttgggggcctcgtgtgtaagtgtgaataaatgtagttgtcttgg

SEQ ID NO: 3578 - DNA, 2273 bp, Homo sapiens
ggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccgaagcccttcacagaacgtcccccacccctaacagctgcccactgcccctccccctctgcagaatgtctggggtcctatgttccaggaacctgtttactttcaaattttccctgtttcagttggactcaggagcatctggtgagccaggtcactctctgggtcttacccttggcttttcttattgcggaaactgccagacggcggtggtcagtgcccagcctgaggggatggcttcgaatggagcatacccagtgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaccttccccagcacacctctggtgacagaacaggatggctgcggcccgagtggggccggggcttccaacgtctttgtccagatgaggacagaggtggggcctgtgaaggccgctcaggcgcagaccttggtcctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcatggagagagcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatcgctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcaaagtgaagcagccacaggaagaggactggacgcccccagacccgggcctcctgagctacattgacaagctgtgttcccagaaagacttcgtcaccaaggtggaggccgtcattcatccccaattcctggaagaattgctttccccagatccacagatggatttcttggccctaagccaggacctggagcaggaggaaggactcacccttgcccagggagccccttcagatgctccagggactgacagatgctga

SEQ ID NO: 3579 - DNA, 3284 bp, Homo sapiens
ggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccgaagcccttcacagaatgtcccccacccctaacagctgcccactgcccctccccctctgcagaatgtctggggtcctatgttccaggaacctgtttactttcaaattttcctttcagttggactcaggagcatctggtgagccaggtcactctctgggtcttacccttggcttttctcattgtggaaactgccagacagcggtagtcagtgcccagcctgaggggatggcttcaaatggagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaacttccccagcacacctctggtgacagaacaggatggctgcggcccgagtggggccggggcttccaacgtctttgtccagatgaggacagaggtggggcctgtgaaggccgctcaggcgcagaccttggtcttaactcagacccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatccctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttctctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtggaggccgtcattcatccccaattcctggaagaattgctttccccagatccacagatggatttcttggccctaagccaggagctggagcaggaggaaggactcacccttgcccagctagtggagaagcgcctcctacccttgaaggagaaacagcatgcgagggcagcccctagtcgtggcacagcccggttggactcaagttcttctaagtttgcagctggccaaggagcagagagagacgtccctgacccccaacaaggggttggcatggaaacctgcccaccccagacgactgcccgggactctcagggacgaggcagagcacacactggcatggccaggtccaaagactctgttgtgcttttgggatgtcaggattcccctgggctgagggctgcccggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagtccccatctgctgagagaagaggcctcaacctagcaccttctcctgccaacaaggccaagaagcgacctctctttggaagcctgtcccctgctgaaaagacaccccacccagggcctgggctcagggtctctggggagcaatccctgacttgggggctgggtggcccctcacagtctcaaaagagaaagggtgaccccttggtctccaggaaggagaagaagcagcgttgtagccagtaggggcttctgagcaggctctctggggccgatccccaaggatggggctctggcatccgatgccccaaagcggtcaaaagcttcttctcccccagtgctgatcttgctgggccttagctttggagggtaggggagggaggggagggagagggtggcctgaatggggagggcaggaagggagggtctggggggaaggggctggggagtgggggtgggaagcagtgtgttgggggcctcgtgtgtaagtgtgaataaatgtagttgtcttgg

SEQ ID NO: 3580 - DNA, 2740 bp, Homo sapiens
ggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccgaagcccttcacagaatgtcccccacccctaacagctgcccactgcccctccccctctgcagaatgtctggggtcctatgttccaggaacctgtttactttcaaattttcctgtttcagttggactcaggagcatctggtgagccaggtcactctctgggtcttacccttggcttttctcattgtggaaactgccagacagcggtagtcagtgcccagcctgaggggatggcttcaaatggagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaacttccccagcacacctctggtgacagaacaggatggctgcggcccgagtggggccggggcttccaacgtctttgtccagatgaggacagaggtggggcctgtgaaggccgctcaggcgcagaccttggtcttaactcagacccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatccctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttctctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtggaggccgtcattcatccccaattcctggaagaattgctttccccagatccacagatggatttcttggccctaagccaggagctggagcaggaggaaggactcacccttgcccagctagtggagaagcgcctcctacccttgaaggagaaacagcatgcgagggcagcccctagtcgtggcacagcccggttggactcaagttcttctaagtttgcagctggccaaggagcagagagagacgtccctgacccccaacaaggggttggcatggaaacctgcccaccccagacgactgcccgggactctcagggacgaggcagagcacacactgcctcgggccttctcagcccagaaaagtggggaccccagggaactcatcagtccccatctgctgagagaagaggcctcaacctagcaccttctcctgccaacaaggccaagaagcgacctctctttggaagcctgtcccctgctgaaaagacaccccacccagggcctgggctcagggtctctggggagcaatccctgacttgggggctgggtggcccctcacagtctcaaaagagaaagggtgaccccttggtctccaggaaggagaagaagcagcgttgtagccagtag

SEQ ID NO: 3581 - DNA, 3286 bp, Homo sapiens
ggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccgaagcccttcacagaatgtcccccacccctaacagctgcccactgcccctccccctctgcagaatgtctggggtcctatgttccaggaacctgtttactttcaaattttcctgtttcagttggactcaggagcatctggtgagccaggtcactctctgggtcttacccttggcttttctcattgtggaaactgccagacagcggtagtcagtgcccagcctgaggggatggcttcaaatggagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaacttccccagcacacctctggtgacagaacaggatggctgcggcccgagtggggccggggcttccaacgtctttgtccagatgaggacagaggtggggcctgtgaaggccgctcaggcgcagaccttggtcttaactcagacccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatccctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttctctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtggaggccgtcattcatccccaattcctggaagaattgctttccccagatccacagatggatttcttggccctaagccaggagctggagcaggaggaaggactcacccttgcccagctagtggagaagcgcctcctacccttgaaggagaaacagcatgcgagggcagcccctagtcgtggcacagcccggttggactcaagttcttctaagtttgcagctggccaaggagcagagagagacgtccctgacccccaacaaggggttggcatggaaacctgcccaccccagacgactgcccgggactctcagggacgaggcagagcacacactggcatggccaggtccaaagactctgttgtgcttttgggatgtcaggattcccctgggctgagggctgcccggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagtccccatctgctgagagaagaggcctcaacctagcaccttctcctgccaacaaggccaagaagcgacctctctttggaagcctgtcccctgctgaaaagacaccccacccagggcctgggctcagggtctctggggagcaatccctgacttgggggctgggtggcccctcacagtctcaaaagagaaagggtgaccccttggtctccaggaaggagaagaagcagcgttgtagccagtaggggcttctgagcaggctctctggggccgatccccaaggatggggctctggcatccgatgccccaaagcggtcaaaagcttcttctcccccagtgctgatcttgctgggccttagctttggagggtaggggagggaggggagggagagggtggcctgaatggggagggcaggaagggagggtctggggggaaggggctggggagtgggggtgggaagcagtgtgttgggggcctcgtgtgtaagtgtgaataaatgtagttgtcttgg

SEQ ID NO: 3582 - DNA, 5543 bp, Homo sapiens
ggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccgaagcccttcacagaatgtcccccacccctaacagctgcccactgcccctccccctctgcagaatgtctggggtcctatgttccaggaacctgtttactttcaaattttcctgtttcagttggactcaggagcatctggtgagccaggtcactctctgggtcttacccttggcttttctcattgtggaaactgccagacagcggtagtcagtgcccagcctgaggggatggcttcaaatggagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaacttccccagcacacctctggtgacagaacaggatggctgcggcccgagtggggccggggcttccaacgtctttgtccagatgaggacagaggtggggcctgtgaaggccgctcaggcgcagaccttggtcttaactcagacccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatccctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttctctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtggaggccgtcattcatccccaattcctggaagaattgctttccccagatccacagatggatttcttggccctaagccaggagctggagcaggaggaaggactcacccttgcccagggagccccttcagatgctccagggactgacagatgctgaggaagccctgatccctcccaccacccactcacaaggccctgcctgctttagggaggcttcttggggccccctcatcgttatcagcatccctggaaaatcctgggattggagagagctggctggctcttgttctgctcggtgggagctgaggagaaggcagccgcctgcaacatggacatggggagaggaggctgctcctgcttaaccctcatcaggaagagcgcgggcactgggctgaggggagacgttgaggtgaccatccacacaggtgtgtttgggatacgatgatgggtggggagcaggggaagtccttctgcctgtttctgggcaggagagagtcttgtccaactagctaaagcagatgctccttgctgtggccacagggactggcctcggggccctcaaggtcctgcatggagccccccacagctatgattcccttcccatatgatgactgaactcatgtggaattgatgtagacacagatttacattggtttctaaaacagttccctcccaacacaccatcaccaatgggaacaagcatgtccagtccatcaggcgcagggtgggggtttctgctggttccagggcccggaggagctggggcccaggccaagaggggccgagggtcagccgcccttctgccaggcacagaccccaagggcagagcaggggctgcctgggatgtggcattggctgtctgggaagtgccctgggagttgggggctaggtgttcgccaaagggagacttccagagtctatgagtgagatgaggactgcatcaggagagggaccgaggctggggaggatgctctgctctttcccaggttgtcctgtcttcccaatctctgctgaactgccctcaccccatgggccaactctgccccccttacccctaacccacctcttagaatctcagatcccagcgtggacaggacccggcacccaccctggttccctcctggccaacaccttcttctccacggtctgagttctgattcctcccccagggcgcttattggctcaggacccctgtgactgccagggcactggtcccagcactgcctgcgtgcagagctgtggtcacggccctgggggctggcccagcagcagaggctggtggggcaaagctgtctggtacacggtggcctggcccctcggccaagtgacaaagggagccatgtttgggtcctctctggccccatctgcccacagaacacagcagtcagcctgacagatgcccctctgccccgtcccttctgctcgatgtgggcagtgtcggaggcctgctgtcttctgtggcctttgggaaggagagtttatcttggcagggcttccccagctcagtgcacgtcaggccctcggggaaaatgtggggagcgaagagtcactggtgggtgatgtgggcagctcccgtgactcctctacattcacggccatcctcaggagataaggtagcactgcccctttgcagggtttaggaatgttaagtgagccgtgtttgaagggaacatggtccatactctggcgtgtgtgggtgcccagccaacttcctcacctaagggtgaaagtgacaccttggggctcctgctggttaccccactggctgttgtctatcccactgtccctgtccttgtcttggctgagccattcctaggaagcagaacttgtgcttcctccacctctgtgtcccacctgagccctacaatctgcccctaaatgggcacagtggggctgactggggggctctggtagactgaacatacgtcccccgcccagttcctgtgctgaagccctaacccccaacgtgatggtatttggaaatggggcctttgggagttattcagggttagaagagaccatgagggtggggccctaatgatgggattagggccctggtaagaagcagagaccccagagctctctctctccctgacacgaggacacactgagaaggcggccatctgcaagccagagagagagccctcaccagaaccttgcccactgggatgctaacctcggacttccagcctccagactgtgacaaatacatttctttttttaatatgtgccaccacccccaagtctatggccctttgtccgagcagccctatgtgactaggacaaagtccataatctcaagaacttccttcatgactggtatctggaaaccgtgcatcagagccacgggaaagaaaggctcagccctttacaactgtcagcacacctccaccccaagtgcagtgtatcacacatgaaccaggagagcctgggacacagtgaaaaggaatctgtaaatacccatgatgtcatcgcatccacacttggggaagccatgcagcttgctcacagcaggtgctgggggtgtgctgaggctcttggtcggcttggcctccctgctcacacacccaggtcactctctgggaaccagtgcggctggggtggcccctggcaggtttgcctccagagacccctcccttcaccattggatgacagatccccgaagaagccatagcctcctgggaaactccatctgacaacgtgagcaaggcttgcccccgttagtgaacatgctgtgctttctgacagctatgaggatggacttgatccaggtggctgcccttttgtagctcactttgattctaacttcagcgttgcatgatgccctatgaatggaatatacaatgtgtgtctttcacatctgtcttctttcacttagaataatatttccaatggcatctacatttttagtatgtatcattacatcaaacctttttgttgctgaataatattccattaatggatatactaaaatttatccatttatcagttaagaacgtttgggtttttttcactttttggctattgtgaataacacttctaagaacatttgtgtacaaggtttcctggggatgtatgtttccatttctcatggctacatacctaagagtgaaattggtggaccatatggaaactctgtgtttaaccatttcagaaggtgccagactgttcccagtgtacatgaaccattttatatacccactagctgtgtgagggtcccagcgtctctccatattcgagccaacatttattatcaactctctttttgataaagtcatcctagtggttctgaagttgcatctcatcgtagtttgcatttgtgtttctctgatgttgaacctctttcacgtacctattcgccacttgtatatcttctttggagcaatgtgtactcaacatttagtaatttttaactggtttgtgttttgtcattgagttataagaattctttatatattccagataaaaatgctttacaag

SEQ ID NO: 3583 - DNA, 866 bp, Homo sapiens
cacgggggagcccgagaaacaacgggaagagggcgaagtgaagcagccacaggaagaggactggacgcccccagacccgggcctcctgagctacactgacaagctgtgttcccagaaagacttcgtcaccaaggtggaggccgtcattcatccccaattcctggaagaattgctttccccagatccacagatggatttcttggccctaagccaggagctggagcaggaggaaggactcacccttgcccagctagtggagaagcgcctcctacccttgaaggagaaacagcatgcgagggcagcccctagtcgtggcacagcccggttggactcaagttcttctaagtttgcagctggccaaggagcagagagagacgtccctgacccccaacaaggggttggcatggaaacctgcccaccccagacgactgcccgggactctcagggacgaggcagagcacacactgcctcgggccttctcagcccagaaaagtggggaccccagggaactcatcagtccccatctgctgagagaagaggcctcaacctagcaccttctcctgccaacaaggccaagaagcgacctctctttggaagcctgtcccctgctgaaaagacaccccacccagggcctgggctcagggtctctggggagcaatccctgacttgggggctgggtggcccctcacagtctcaaaagagaaagggtgaccccttggtctccaggaaggagaagaagcagcgttgtagccagtaggggcttctgagcaggctctctggggccgatccccaaggatggggctctggcatccgatgccccaaagcggtcaaaagcttcttctcccccagtgctgatcttgctgggc

SEQ ID NO: 3584 - DNA, 3290 bp, Homo sapiens
ggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccgaagcccttcacagaacgtcccccacccctaacagctgcccactgcccctccccctctgcagaatgtctggggtcctatgttccaggaacctgtttactttcaaattttccctgtttcagttggactcaggagcatctggtgagccaggtcactctctgggtcttacccttggcttttcttattgcggaaactgccagacggcggtggtcagtgcccagcctgaggggatggcttcgaatggagcatacccagtgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaccttccccagcacacctctggtgacagaacaggatggctgcagcccgagtggggccggggcttccaacgtctttgtccagatgaggacagaggtggggcctgtgaaggccgctcaggcgcagaccttggtcctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcatggagagagcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatcccagttctccgatcgctggcccggcggaagcccaccatgaccctggaggagggactgtggcgggccatgcgggaatggcagcacacgagcaactttgaccggatgatcttctacgagatggcggaaaagttcctggagtttgaggctgaggaggagatgcagattcagaaatcgcaatggatgaaggggccccagtgcctgcctcctccagccacaccgaggcttgaacctcgaggacccccggcccctgaggtggtcaagcagccagtgtaccttcccagcaaggccggccccaaggcccagactgcctgcctgccaccacccagaccccagaggccagtgaccaaggcccgccggccaccaccccagccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcaaagtgaagcagccacaggaagaggactggacgcccccagacccgggcctcctgagctacattgacaagctgtgttcccagaaagacttcgtcaccaaggtggaggccgtcattcatccccaattcctggaagaattgctttccccagatccacagatggatttcttggccctaagccaggacctggagcaggaggaaggactcacccttgcccagctagtggagaagcgcctcccacccttgaaggagaaacagcattcgagggcagcccctagtcgtggcacagcccggttggactcaagttcttctaagtttgcagctggccaaggagcagagagagacgtccctgacccccaagaaggggttggcatggaaacctgcccaccccagacgactgcccgggactctcagggacgaggcagagcacacactggcatggccaggtccgaagactctgttgtgcttttgggatgtcaggattcccctgggctgagggctgcccggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagtccccatctgctgagagaagaggcctcaacctagcaccttctcctgccaacaaggccaagaagcaacctctctttggaagcctgtcccctgctgaaaagacaccccaccgagggcctgggctcagggtctctggggagcaatccctgacttgggggctgggtggcccctcacagtctcaaaagagaaagggtgaccccttggtctccaggaaggagaagaagcagcattgtagccagtaggggcttctgagcaggctctctggggccaatccccaaggatggggctctggcatccgatgccccaaagcggtcaaaagcttcttctcccccagtgctgatcttgctgggccttagctttggagggtaggggagggaggggagggagagggtggctgaatggggagggcaggaagggagggtctggggggaaggggctggggagtgggggtgggaagcagtgtgttgggggcctcgtgtgtaagtgtgaataaatgtagttgtcttggaaaa

SEQ ID NO: 3585 - DNA, 2561 bp, Homo sapiens
gtcagtgcccagcctgaggggatggcttcaaatggagcatacccagtgctgggacccggcgtgaccgtgaaccctggcacctccctgtctgtgttcacggctctgccctttgccacacccgctcccggcccagcacacaggccgcccctcgtgactgcagtggttcctccagccggccctctggtgctctctgccttccccagcacccctctagtggcaggacaggatggccgcggcccgagtggggccggggcttccaacgtctttgtccagatgaggacagaagtggggcctgtgaagccccctcaggcacagaccttgatcctaactcaggcccccctcgtctggcaggctccaggcaccctctgtggaggtgtcatgtgtccacctcccctactcctggcagctgctcctggggtgcccgttacctctgcccaggtggttgggggcacccaggcctgtgagggaggctggtcccatggccttcctcttccaccaccaccaccggctgcccaggtggcccccatcgtgtccccagggaacgctaggccatggccacaaggggctcatggagagggcagcctggctccctcccaggccaaggcccggccggacgactcctgtaaacccaagagtgtctatgagaacttccgactctggcagcactacaagcccctggcccggaggcaccttccccagagtcctgacactgaagcgctttcctgcttcctcatcccagttctccgatccctggcccggcggaagcccaccatgacgctggaggagggactgtggcaggccatgcgggaatggcagcacacgagcaactttgaccggatgatcttctacgagatggcggaaaagttcctggaatttgaggctgaggaggagatgcagattcagaaatcgcagtggatgaaggggccccagagcctgcctcctccagccccgccgaggcttgaacctcgaggaccccctgcccctgaggtggtcaagcagccagtgtaccttcccagcaaggatggccccaaggccccgactgcctgcctgccaccacccaggccccagaggccagcggagaccaaggcccacctgccaccacccaggccccagaggccagcggagaccaacgcccacctgccaccacccaggccccagaggccagcggagaccaaggtccctgaggagatcccccctgaagtggtgcaggagtatgtggacatcatggaggagctgctggggtctcaccctggggacacaggggagcctgagggacaacgggaaaagggcaaagtggagcagccgcaggaagaggacgggataacctcagacccgggcctcctgagctacattgacaagctgtgttcccaggaagactttgtcaccaaggtggaggccgtcattcacccccgattcctggaagaattgctttccccagatccacagatggatttcttggccctaagccaggagctggagcaggaggaaggactcacccttgcccagctagtggagaagcgcctcctgtccttgaaggagaaagggtgcgggagggcagcccctcgacatggcacggccaggttggactcaagtccttctgagtttgcagctggccaagaagcagcgagagaggtccctgacccccaacaaagggtcagcgtggaaacctccccaccccagacagctgcccaggaccctcagggacagggcagagtgcgcactggcatggccaggtccgaagaccctgctgtgcttttgggatgtcaggattcccccaggctgaaggctgtccggccaacctctcctccccaggaccacagacccacctgccccggcctggggaccaaggacgccttgggtctccctggagagtctcctgtcaaggagtcacatgggctggctaaggggtcaagtgaggagacggaactccctggcatggtctatgtcgtgggttcccaccacaggctgaggccctggaggctgtcccagagccctgtcccttcctcgggccttctcagcccaggagggagaggaccccagggagctcttcagtctccatctgctcagaaaagaggcctcagcccatcaccttctcctgccagcaagtccaagaagcgacctctctttggaagcccatcccctgctgaaaagacaccgcacccagggcctgggctcagggtctctggggagcaatccctggcttgggggctgggtggcccctcacagtctcaaaagagaaagggtgaccccttggcctccaggaggaagaagaagcggcattgtagccagtaggggccgccatggggcagactctctgatgccagtccccaaaagtggggctctgaagtctcggaccctcatggcacccggtgccccaaagcaaaggctgcttctcctccagtgctgatcttgctgggccttagctttggagggtaggggaaggaggggagggagaaggtggctgaacggggagggcaggaagggagggcctggggggtgggaagcagtgccttgggggccttgtgtgtaaatgtgaataaatgtagttgttttggaaaatg

SEQ ID NO: 3586 - DNA, 4195 bp, Homo sapiens
gtcagtgcccagcctgaggggatggcttcaaatggagcatacccagtgctgggacccggcgtgaccgtgaaccctggcacctccctgtctgtgttcacggctctgccctttgccacacccgctcccggcccagcacacaggccgcccctcgtgactgcagtggttcctccagccggccctctggtgctctctgccttccccagcacccctctagtggcaggacaggatggccgcggcccgagtggggccggggcttccaacgtctttgtccagatgaggacagaagtggggcctgtgaagccccctcaggcacagaccttgatcctaactcaggcccccctcgtctggcaggctccaggcaccctctgtggaggtgtcatgtgtccacctcccctactcctggcagctgctcctggggtgcccgttacctctgcccaggtggttgggggcacccaggcctgtgagggaggctggtcccatggccttcctcttccaccaccaccaccggctgcccaggtggcccccatcgtgtccccagggaacgctaggccatggccacaaggggctcatggagagggcagcctggctccctcccaggccaaggcccggccggacgactcctgtaaacccaagagtgtctatgagaacttccgactctggcagcactacaagcccctggcccggaggcaccttccccagagtcctgacactgaagcgctttcctgcttcctcatcccagttctccgatccctggcccggcggaagcccaccatgacgctggaggagggactgtggcaggccatgcgggaatggcagcacacgagcaactttgaccggatgatcttctacgagatggcggaaaagttcctggaatttgaggctgaggaggagatgcagattcagaaatcgcagtggatgaaggggccccagagcctgcctcctccagccccgccgaggcttgaacctcgaggaccccctgcccctgaggtggtcaagcagccagtgtaccttcccagcaaggatggccccaaggccccgactgcctgcctgccaccacccaggccccagaggccagcggagaccaaggcccacctgccaccacccaggccccagaggccagcggagaccaaggtccctgaggagatcccccctgaagtggtgcaggagtatgtggacatcatggaggagctgctggggtctcaccctggggacacaggggagcctgagggacaacgggaaaagggcaaagtggagcagccgcaggaagaggacgggataacctcagacccgggcctcctgagctacattgacaagctgtgttcccaggaagactttgtcaccaaggtggaggccgtcattcacccccgattcctggaagaattgctttccccagatccacagatggatttcttggccctaagccaggagctggagcaggaggaaggactcacccttgcccagggggccccttcagatgctctggggactgacagatgctgaggaagccctgatccctcccaccatccactcacaaggccccgcctgctttagggaggcttctcggggcctcccatcattatcagtatccctggaaaatcctgggatggagagagctggctggctttttttctgctcggtgggagctgaggagaaggcagctgcctgcaacatggacatggggagaggcggctgctcctgcttaaccctcatcaggaagagcacgggcactgggctgaggggagacgttgaggtgaccgtccacatgggtgtgtttgggatatgatgaggggcgcagagcaggggcctgtttctgggcaggagagagtcttgtccaactggctgaagcagatgctccttgctgtggccacatggaatggcctcaggggccctcagggtcttgcatggagctcccccaacagctatgattcccttcccatatgatgactgaactcgtgtggaattgatgtagacacagatttacattggcatctaaaacagttccctcccaacacaccatcaccaacgggaacaagcatgaccagcctgccaggcgcaaggtgggtgtgtctgctggtcccagggccaggagaagctggggcccaggccgagaggggccgagggtcagtcgcccttctgccaggcacagaccccaagggcagagcaggggctgcctgggatgtggcactggctgtctgggaagtgccctgagagtcgggggccaggtgttcactgaagggagacttctggagtctacgagtgagatgaggactgcatcaggagagggactgaggctggggaggatactctgctttttcccaggttgtcctgtcctccccatctctgctgaactcccctcaccccatgtggccgacctctgccccccttacccctaacccacctctcagaatctcagatcccagcatggacaggacccagcacctgccctggttccctcctggccaacaccttcttctccacagtctgagttctgattcctccccagggcccttgttggctcaggaccgctgtgactgccagagcactggtcccagcactgcccgcatgcagagctgtggtcatggtgctgggagttggcccagcagcagaagctgatggggcaaagctctctggtatatggcggcctggtccctctgccaagtgacaaagggagccatgtttgggttctctctggccccatctgcccacagaacacagcagtcagccagacagatgcctctctgccccatcccttccgctccatgtgggcagtgtcggaggcctgccacccgctttcgcctttgggaaggagagtttatcttggcagggcttccccagctgagggcacaacaggcccttggggaaaatgtggggagtgaagagtcactggtgggtgatgtgggcagctcccgtgactcctctacattcagggccatcctcaggagacaaggtaacacctcccctttgcagggtttaggaatgttaagtgagccgtgtttgaagggaatgtggtctgtactctggcgtgtgtgggtgctcagccaacttcctcacctaagtgtgaaagtgataccttggtttagtgacacctcggggcttctgctggtttaccccactagctgtttcctgccccactgtccctgtccttgttttggctgagccatttccaagaggcagaacctatgcttccttcacctctgtgtcccgcctgagccctacaatctgcccctaaatgggcacagtggggctgactgggggactctgatggacttaacatgtgtcccccccgcccagttcctgtggtgaagccctaactcctaacgtgatggtatttggagatggggcctttgggagttactcagggttagaagagaacatgagggtggggccctaatgatgggattagggccatggtaagaagcagagatcccagcactctctctctctccctgacatgaggacacagtgagaaggcagccgtctgcaagccaggaagagagccctcaccagaacctcaccttgctgtgaccctaacgtcagacttccagcctccagactgacaaatacattttgtttcttaatacgcaccgcctcccccacccaccaagtctaggacactttgtcctagcagccctatgtgactaggacaaggtccatcatctcaggaacttccttcctgactggtatctggaaactgtatcagagccatgggaaagaatgaagaaaggctcggctctttacgactgtcagcacacctccaccccaagtgcagtgtatcacacgtgaaccagtactgctgtgggacacagtgcaagggaatctgtaaacacccatgacatcgtcatatccacacttggggaagccaagcagcttgctcacagcaggtgctgggggtatgctgaggctctcggtgggtttggtctccctgctcacgcagccaggtcactctctgggagccagtgcagttggggcggccccgggcaggtttgcctccagaaaccactcccttcaccactggacaacagatccctgaagaagccatggcctcctgagaaactccatctgacaatgtgagcaaggccggcccccgttagtaaacatgcagtgctttctgacagctaccaggatggacttgctccaggtggctgcccttttgtagctgcactttgattctaacttcagcatcccatgatgtcct

SEQ ID NO: 3587 - DNA, 2516 bp, Homo sapiens
gtcagtgcccagcctgaggggatggcttcaaatggagcatacccagtgctgggacccggcgtgaccgtgaaccctggcacctccctgtctgtgttcacggctctgccctttgccacacccgctcccggcccagcacacaggccgcccctcgtgactgcagtggttcctccagccggccctctggtgctctctgccttccccagcacccctctagtggcaggacaggatggccgcggcccgagtggggccggggcttccaacgtctttgtccagatgaggacagaagtggggcctgtgaagccccctcaggcacagaccttgatcctaactcaggcccccctcgtctggcaggctccaggcaccctctgtggaggtgtcatgtgtccacctcccctactcctggcagctgctcctggggtgcccgttacctctgcccaggtggttgggggcacccaggcctgtgagggaggctggtcccatggccttcctcttccaccaccaccaccggctgcccaggtggcccccatcgtgtccccagggaacgctaggccatggccacaaggggctcatggagagggcagcctggctccctcccaggccaaggcccggccggacgactcctgtaaacccaagagtgtctatgagaacttccgactctggcagcactacaagcccctggcccggaggcaccttccccagagtcctgacactgaagcgctttcctgcttcctcatcccagttctccgatccctggcccggcggaagcccaccatgacgctggaggagggactgtggcaggccatgcgggaatggcagcacacgagcaactttgaccggatgatcttctacgagatggcggaaaagttcctggaatttgaggctgaggaggagatgcagattcagaaatcgcagtggatgaaggggccccagagcctgcctcctccagccccgccgaggcttgaacctcgaggaccccctgcccctgaggtggtcaagcagccagtgtaccttcccagcaaggatggccccaaggccccgactgcctgcctgccaccacccaggccccagaggccagcggagaccaaggcccacctgccaccacccaggccccagaggccagcggagaccaaggtccctgaggagatcccccctgaagtggtgcaggagtatgtggacatcatggaggagctgctggggtctcaccctggggacacaggggagcctgagggacaacgggaaaagggcaaagtggagcagccgcaggaagaggacgggataacctcagacccgggcctcctgagctacattgacaagctgtgttcccaggaagactttgtcaccaaggtggaggccgtcattcacccccgattcctggaagaattgctttccccagatccacagatggatttcttggccctaagccaggagctggagcaggaggaaggactcacccttgcccagctagtggagaagcgcctcctgtccttgaaggagaaagggtgcgggagggcagcccctcgacatggcacggccaggttggactcaagtccttctgagtttgcagctggccaagaagcagcgagagaggtccctgacccccaacaaagggtcagcgtggaaacctccccaccccagacagctgcccaggaccctcagggacagggcagagtgcgcactggcatggccaggtccgaagaccctgctgtgcttttgggatgtcaggattcccccaggctgaaggctgtccggccaacctctcctccccaggaccacagacccacctgccccggcctggggaccaaggacgccttgggtctccctggagagtctcctgtcaaggagtcacatgggctggctaaggggtcaagtgaggagacggaactccctggcatggtctatgtcgtgggttcccaccacaggctgaggccctggaggctgtcccagagccctgtcccttcctcgggccttctcagcccaggagggagaggaccccagggagctcttcagtctccatctgctcagaaaagaggcctcagcccatcaccttctcctgccagcaagtccaagaagcgacctctctttggaagcccatcccctgctgaaaagacaccgcacccagggcctgggctcagggtctctggggagcaatccctggcttgggggctgggtggcccctcacagtctcaaaagagaaagggtgaccccttggcctccaggaggaagaagaagcggcattgtagccagtaggggccgccatggggcagactctctgatgccagtccccaaaagtggggctctgaagtctcggaccctcatggcacccggtgccccaaagcaaaggctgcttctcctccagtgctgatcttgctgggccttagctttggagggtaggggaaggaggggagggagaaggtggctgaacggggagggcaggaagggagggcctggggggtgggaagcagtgccttgggggccttgtgtgtaaatgtgaataaatgtagttgttttggaaaatg

SEQ ID NO: 3588 - DNA, 2063 bp, Homo sapiens
gtcagtgcccagcctgaggggatggcttcaaatggagcatacccagtgctgggacccggcgtgaccgtgaaccctggcacctccctgtctgtgttcacggctctgccctttgccacacccgctcccggcccagcacacaggccgcccctcgtgactgcagtggttcctccagccggccctctggtgctctctgccttccccagcacccctctagtggcaggacaggatggccgcggcccgagtggggccggggcttccaacgtctttgtccagatgaggacagaagtggggcctgtgaagccccctcaggcacagaccttgatcctaactcaggcccccctcgtctggcaggctccaggcaccctctgtggaggtgtcatgtgtccacctcccctactcctggcagctgctcctggggtgcccgttacctctgcccaggtggttgggggcacccaggcctgtgagggaggctggtcccatggccttcctcttccaccaccaccaccggctgcccaggtggcccccatcgtgtccccagggaacgctaggccatggccacaaggggctcatggagagggcagcctggctccctcccaggccaaggcccggccggacgactcctgtaaacccaagagtgtctatgagaacttccgactctggcagcactacaagcccctggcccggaggcaccttccccagaaagtggtgcaggagtatgtggacatcatggaggagctgctggggtctcaccctggggacacaggggagcctgagggacaacgggaaaagggcaaagtggagcagccgcaggaagaggacgggataacctcagacccgggcctcctgagctacattgacaagctgtgttcccaggaagactttgtcaccaaggtggaggccgtcattcacccccgattcctggaagaattgctttccccagatccacagatggatttcttggccctaagccaggagctggagcaggaggaaggactcacccttgcccagctagtggagaagcgcctcctgtccttgaaggagaaagggtgcgggagggcagcccctcgacatggcacggccaggttggactcaagtccttctgagtttgcagctggccaagaagcagcgagagaggtccctgacccccaacaaagggtcagcgtggaaacctccccaccccagacagctgcccaggaccctcagggacagggcagagtgcgcactggcatggccaggtccgaagaccctgctgtgcttttgggatgtcaggattcccccaggctgaaggctgtccggccaacctctcctccccaggaccacagacccacctgccccggcctggggaccaaggacgccttgggtctccctggagagtctcctgtcaaggagtcacatgggctggctaaggggtcaagtgaggagacggaactccctggcatggtctatgtcgtgggttcccaccacaggctgaggccctggaggctgtcccagagccctgtcccttcctcgggccttctcagcccaggagggagaggaccccagggagctcttcagtctccatctgctcagaaaagaggcctcagcccatcaccttctcctgccagcaagtccaagaagcgacctctctttggaagcccatcccctgctgaaaagacaccgcacccagggcctgggctcagggtctctggggagcaatccctggcttgggggctgggtggcccctcacagtctcaaaagagaaagggtgaccccttggcctccaggaggaagaagaagcggcattgtagccagtaggggccgccatggggcagactctctgatgccagtccccaaaagtggggctctgaagtctcggaccctcatggcacccggtgccccaaagcaaaggctgcttctcctccagtgctgatcttgctgggccttagctttggagggtaggggaaggaggggagggagaaggtggctgaacggggagggcaggaagggagggcctggggggtgggaagcagtgccttgggggccttgtgtgtaaatgtgaataaatgtagttgttttggaaaatg

SEQ ID NO: 3589 - DNA, 4888 bp, Homo sapiens
cttcctaagaaaggggacgggaagtaaggctggcctactggtgtggacagattccagcaacatacatgacctgggggcacaaggactgcttcctaaacaatgatgagcacacagccacctaatagcctggatcagctgaggccattctgatttcaaacactcagtccccttgccttcctaagaacccctgtgtttctcagactgaaaacgtgttctgaattttgttaagtaagtgtggcccctgttgaaattcatcaagagtgggaaagagccaaagtgggaaggagcatgggttgattggcacaaaagtaggtctgttgataaagaatggaagtaaaggggacatcaggtagaagcttttgctgtgagtcagaaggacaatttaaaagttgcctaaagaggcgcacactgtctgtgttgctgccatccagttggatggcaaccaactgaaccaagggaacctcaggttcttgcctactggccagagcccttcacagaatgtcccccacccccgccaagcccggctgcccactgcccctccccctctgcagaatgtctggggtcctgtgttccaaacctgtttatatgcaaattatccctgctccacttggactcaggaggatctgctgagtcaggtcactctctgggtcctgcccttgacttttttcattgcggaagctgccagacagtggtggtcagtgcccagcctgaggggatggcttcaaatggagcatacccagtgctgggacccggcgtgaccgtgaaccctggcacctccctgtctgtgttcacggctctgccctttgccacaccctctcccggcccaacacacaggccgcccctcgtgactgcagtggttcctccagccggccctctggtgctctctgccttccccagcacccctctagtggcaggacaggatggccgcggcccaagtggggctggggcttccaacgtctttgtccagatgaggacagaagtggggcctgtgaagccccctcaggcacagaccttgatcctaactcaggcccccctcgtctggcaggctccaggcaccctctgtggaggtgtcatgtgtccacctcccctactcctggcagctgctcctggggtgcccgttacctctgcccaggtggttgggggcacccaggcctgtgagggaggctggtcccatggccttcctcttccaccaccaccaccggctgcccaggtggcccccatcgtgtccccagggaacgctgggccatggccacaaggggctcatggagagggcagcctggctccctcccaggccaaggcccggccggacgactcctgtaaacccaagagtgtctatgagaacttccgactctggcagcactacaagcccctggcccggaggcaccttccccagagtcctgacactgaagcgctttcctgcttcctcatcccagttctccgatccctggcccggcggaagcccaccatgacgctggaggagggactgtggcgggccatgcgggaatggcagcacacgagcaactttgaccggatgattttctacgagatggcggcaaagttcctggagtttgaggctgaggaggagatgcagattcagaaatcgcagtggatgaaggggccccagagcctgcctcctccagccccgccgaggcttgaacctcgaggaccccctgcccctgaggtggtcaagcagccagtgtaccttcccagcaaggatggccccaaggccccgactgcctgcctgccaccacccaggccccagaggccagcggagaccaaggcccacctgccaccacccaggcccccgaggccagcagagaccaaggtccctgaggagatcccccctgaagtggtgcaggagtatgtggacatcatggaggagctgctggggtctcaccctggggacacaggggagcctgagggacaacgggaaaagggcaaagtggagcagccgcaggaagaggacgggatgacctcagacccgggcctcctgagctacattgacaagctgtgttcccaggaagactttgtcaccaaggtggaggccgtcattcacccccgattcctggaagaattgctttccccagatccacagatggatttcttggccctaagccaggagctggagcaggaggaaggactcacccttgcccagggggccccttcagatgctctggggactgacagatgctgaggaagccctgatccctcccaccatccactcacaaggccccgcctgctttagggaggcttctcggggcctcccatcattatcagtatccctggaaaatcctgggatggagagagctggctggctttttttctgctcggtgggagctgaggagaaggcagctgcctgcaacatggacatggggagaggcggctgctcctgcttaaccctcatcaggaagagcacgggcactgggctgaggggagacgttgaggtgaccgtccacatgggtgtgtttgggatatgatgaggggcgcagagcaggggcctgtttctgggcaggagagagtcttgtccaactggctgaagcagatgctccttgctgtggccacatggaatggcctcaggggccctcagggtcttgcatggagctcccccaacagctatgattcccttcccatatgatgactgaactcgtgtggaattgatgtagacacagatttacattggcatctaaaacagttccctcccaacacaccatcaccaacgggaacaagcatgaccagcctgccaggcgcaaggtgggtgtgtctgctggtcccagggccaggagaagctggggcccaggccgagaggggccgagggtcagtcgcccttctgccaggcacagaccccaagggcagagcaggggctgcctgggatgtggcactggctgtctggaagtgccctgagagtcgggggccaggtgttcactgaagggagacttctggagtctatgagtgagatgaggactgcatcaggagagggactgaggctggggaggatactctgctttttcccaggttgtcctgtcctccccatctctgctgaactcccctcaccccatgtggccgacctctgccccccttacccctaacccacctctcagaatctcagatcccagcatggacaggacccagcacctgccctggttccctcctggccaacaccttcttctccacagtctgagttctgattcctctccagggcccttgttggctcaggaccgctgtgactgccagagcactggtcccagcactgcctgcatgcagagctgtggtcatggtgctgggagttggcccagcagcagaagctgatggggcaaagctctctggtatatggcggcctggtccctctgccaagtgacaaagggagccatgtttgggttctctctggccccatctgcccacagaacacagcagtcagccagacagatgcctctctgccccatcccttctgctgcatgtgggcagtgtcggaggcctgccacccgctttcgcctttgggaaggagagtttatcttggcagggcttccccagctgagggcacaacaggcccttggggaaaatgtggggagtgaagagtcactggtgggtgatgtgggcagctcccgtgactcctctacattcagggccatcctcaggagacaaggtaacacctcccctttgcagggtttaggaatgttaagtgagccgtgtttgaagggaatgtggtccgtactctggcgtgtgtgggtgctcagccaacttcctcacctaagtgtgaaagtgataccttggtttagtgacacctcggggcttctgctggtttaccccactagctgtttcctgccccactgtccctgtccttgttttggctgagccatttccaagaggcagaacctatgcttccttcacctctgtgtcccgcctgagccctacaatctgcccctaaatgggcacagtggggctgactgggggactctgatggacttaacatgtgtcccccccgcccagttcctgtggtgaagccctaactcctaacgtgatggtatttggagatggggcctttgggagttattcagggttagaagagaacatgagggtggggccctaatgatgggattagggccatggtaagaagcagagatcccagcactctctctctctccctgacatgaggacacagtgagaaggcagccgtctgcaagccaggaagagagccctcaccagaacctcaccttgctgtgaccctaacgtcagacttccagcctccagactgacaaatacattttgtttcttaatacgcaccgcctcccccacccaccaagtctaggacactttgtcctagcagccctatgtgactaggacaaggtccatcatctcaggaacttccttcctgactggtatctggaaactgtatcagagccatgggaaagaatgaagaaaggctcggctctttacgactgtcagcacacctccaccccaagtgcagtgtatcacacgtgaaccagtactgctgtgggacacagtgcaagggaatctgtaaacacccatgacatcgtcatatccacacttggggaagccaagcagcttgctcacagcaggtgctgggggtatgctgaggctctcggtgggtttggcctccctgctcacgcagccaggtcactctctgggagccagtgcagttggggcggccccgggcaggtttgcctccagaaaccactcccttcaccactggacgacagatccctgaagaagccatggcctcctgagaaactccatctgacaatgtgagcaaggccggcccccgttagtaaacatgcagtgctttctgacagctaccaggatggacttgctccaggtggctgcccttttgtagctgcactttgattctaacttcagcatcccatgatgtcct

SEQ ID NO: 3590 - DNA, 2516 bp, Homo sapiens
gtcagtgcccagcctgaggggatggcttcaaatggagcatacccagtgctgggacccggcgtgaccgtgaaccctggcacctccctgtctgtgttcacggctctgccctttgccacaccctctcccggcccaacacacaggccgcccctcgtgactgcagtggttcctccagccggccctctggtgctctctgccttccccagcacccctctagtggcaggacaggatggccgcggcccaagtggggctggggcttccaacgtctttgtccagatgaggacagaagtggggcctgtgaagccccctcaggcacagaccttgatcctaactcaggcccccctcgtctggcaggctccaggcaccctctgtggaggtgtcatgtgtccacctcccctactcctggcagctgctcctggggtgcccgttacctctgcccaggtggttgggggcacccaggcctgtgagggaggctggtcccatggccttcctcttccaccaccaccaccggctgcccaggtggcccccatcgtgtccccagggaacgctgggccatggccacaaggggctcatggagagggcagcctggctccctcccaggccaaggcccggccggacgactcctgtaaacccaagagtgtctatgagaacttccgactctggcagcactacaagcccctggcccggaggcaccttccccagagtcctgacactgaagcgctttcctgcttcctcatcccagttctccgatccctggcccggcggaagcccaccatgacgctggaggagggactgtggcgggccatgcgggaatggcagcacacgagcaactttgaccggatgattttctacgagatggcggcaaagttcctggagtttgaggctgaggaggagatgcagattcagaaatcgcagtggatgaaggggccccagagcctgcctcctccagccccgccgaggcttgaacctcgaggaccccctgcccctgaggtggtcaagcagccagtgtaccttcccagcaaggatggccccaaggccccgactgcctgcctgccaccacccaggccccagaggccagcggagaccaaggcccacctgccaccacccaggcccccgaggccagcagagaccaaggtccctgaggagatcccccctgaagtggtgcaggagtatgtggacatcatggaggagctgctggggtctcaccctggggacacaggggagcctgagggacaacgggaaaagggcaaagtggagcagccgcaggaagaggacgggatgacctcagacccgggcctcctgagctacattgacaagctgtgttcccaggaagactttgtcaccaaggtggaggccgtcattcacccccgattcctggaagaattgctttccccagatccacagatggatttcttggccctaagccaggagctggagcaggaggaaggactcacccttgcccagctagtggagaagcgcctcctgtccttgaaggagaaagggtgcgggagggcagcccctcgacatggcacggccaggttggactcaagtccttctgagtttgcagctggccaagaagcagcgagagaggtccctgacccccaacaaagggtcagcgtggaaacctccccaccccagacggctgcccaggaccctcagggacagggcagagtgcgcactggcatggccaggtccgaagaccctgctgtgcttttgggatgtcaggactcccccaggctgaaggctgtccggccaacctctcctccccaggaccacagacccacctgccccggcctggggaccaaggacgccttgggtctccctggagagtctcctgtcaaggagtcacatgggctggctaaggggtcaagtgaggagacggaactccctggcatggtctatgtcgtgggttcccaccacaggctgaggccctggaggctgtcccagagccctgtcccttcctcgggccttctcagcccaggagggagaggaccccagggagctcttcaatctccatctgctcagaaaagaggcctcagcccatcaccttctcctgccagcaagtccaagaagcgacctctctttggaagcccatcccctgctgaaaagacaccgcacccagggcctgggctcagggtctctggggagcaatccctggcttgggggctgggtggcccctcacagtctcaaaagagaaagggtgaccccttggcctccaggaggaagaagaagcggcattgtagccagtaggggccgccatggggcagactctctgatgccagtccccaaaagtggggctctgaagtctcggaccctcatggcacccggtgccccaaagcaaaggctgcttctcctccagtgctgatcttgctgggccttagctttggagggtaggggaaggaggggagggagaaggtggctgaacggggagggcaggaagggagggcctggggggtgggaagcagtgccttgggggccttgtgtgtaaatgtgaataaatgtagttgttttggaaaatg

SEQ ID NO: 3591 - DNA, 2193 bp, Homo sapiens
cctaactcaggcccccctcgtctggcaggctccaggcaccctctgtggaggtgtcatgtgtccacctcccctactcctggcagctgctcctggggtgcccgttacctctgcccaggtggttgggggcacccaggcctgtgagggaggctggtcccatggccttcctcttccaccaccaccaccggctgcccaggtggcccccatcgtgtccccagggaacgctgggccatggccacaaggggctcatggagagggcagcctggctccctcccaggccaaggcccggccggacgactcctgtaaacccaagagtgtctatgagaacttccgactctggcagcactacaagcccctggcccggaggcaccttccccagagtcctgacactgaagcgctttcctgcttcctcatcccagttctccgatccctggcccggcggaagcccaccatgacgctggaggagggactgtggcgggccatgcgggaatggcagcacacgagcaactttgaccggatgattttctacgagatggcggcaaagttcctggagtttgaggctgaggaggagatgcagattcagaaatcgcagtggatgaaggggccccagagcctgcctcctccagccccgccgaggcttgaacctcgaggaccccctgcccctgaggtggtcaagcagccagtgtaccttcccagcaaggatggccccaaggccccgactgcctgcctgccaccacccaggccccagaggccagcggagaccaaggcccacctgccaccacccaggcccccgaggccagcagagaccaaggtccctgaggagatcccccctgaagtggtgcaggagtatgtggacatcatggaggagctgctggggtctcaccctggggacacaggggagcctgagggacaacgggaaaagggcaaagtggagcagccgcaggaagaggacgggatgacctcagacccgggcctcctgagctacattgacaagctgtgttcccaggaagactttgtcaccaaggtggaggccgtcattcacccccgattcctggaagaattgctttccccagatccacagatggatttcttggccctaagccaggagctggagcaggaggaaggactcacccttgcccagctagtggagaagcgcctcctgtccttgaaggagaaagggtgcgggagggcagcccctcgacatggcacggccaggttggactcaagtccttctgagtttgcagctggccaagaagcagcgagagaggtccctgacccccaacaaagggtcagcgtggaaacctccccaccccagacggctgcccaggaccctcagggacagggcagagtgcgcactggcatggccaggtccgaagaccctgctgtgcttttgggatgtcaggactcccccaggctgaaggctgtccggccaacctctcctccccaggaccacagacccacctgccccggcctggggaccaaggacgccttgggtctccctggagagtctcctgtcaaggagtcacatgggctggctaaggggtcaagtgaggagacggaactccctggcatggtctatgtcgtgggttcccaccacaggctgaggccctggaggctgtcccagagccctgtcccttcctcgggccttctcagcccaggagggagaggaccccagggagctcttcaatctccatctgctcagaaaagaggcctcagcccatcaccttctcctgccagcaagtccaagaagcgacctctctttggaagcccatcccctgctgaaaagacaccgcacccagggcctgggctcagggtctctggggagcaatccctggcttgggggctgggtggcccctcacagtctcaaaagagaaagggtgaccccttggcctccaggaggaagaagaagcggcattgtagccagtaggggccgccatggggcagactctctgatgccagtccccaaaagtggggctctgaagtctcggaccctcatggcacccggtgccccaaagcaaaggctgcttctcctccagtgctgatcttgctgggccttagctttggagggtaggggaaggaggggagggagaaggtggctgaacggggagggcaggaagggagggcctggggggtgggaagcagtgccttgggggccttgtgtgtaaatgtgaataaatgtagttgttttggaaaatg

SEQ ID NO: 3592 - DNA, 2063 bp, Homo sapiens
gtcagtgcccagcctgaggggatggcttcaaatggagcatacccagtgctgggacccggcgtgaccgtgaaccctggcacctccctgtctgtgttcacggctctgccctttgccacaccctctcccggcccaacacacaggccgcccctcgtgactgcagtggttcctccagccggccctctggtgctctctgccttccccagcacccctctagtggcaggacaggatggccgcggcccaagtggggctggggcttccaacgtctttgtccagatgaggacagaagtggggcctgtgaagccccctcaggcacagaccttgatcctaactcaggcccccctcgtctggcaggctccaggcaccctctgtggaggtgtcatgtgtccacctcccctactcctggcagctgctcctggggtgcccgttacctctgcccaggtggttgggggcacccaggcctgtgagggaggctggtcccatggccttcctcttccaccaccaccaccggctgcccaggtggcccccatcgtgtccccagggaacgctgggccatggccacaaggggctcatggagagggcagcctggctccctcccaggccaaggcccggccggacgactcctgtaaacccaagagtgtctatgagaacttccgactctggcagcactacaagcccctggcccggaggcaccttccccagaaagtggtgcaggagtatgtggacatcatggaggagctgctggggtctcaccctggggacacaggggagcctgagggacaacgggaaaagggcaaagtggagcagccgcaggaagaggacgggatgacctcagacccgggcctcctgagctacattgacaagctgtgttcccaggaagactttgtcaccaaggtggaggccgtcattcacccccgattcctggaagaattgctttccccagatccacagatggatttcttggccctaagccaggagctggagcaggaggaaggactcacccttgcccagctagtggagaagcgcctcctgtccttgaaggagaaagggtgcgggagggcagcccctcgacatggcacggccaggttggactcaagtccttctgagtttgcagctggccaagaagcagcgagagaggtccctgacccccaacaaagggtcagcgtggaaacctccccaccccagacggctgcccaggaccctcagggacagggcagagtgcgcactggcatggccaggtccgaagaccctgctgtgcttttgggatgtcaggactcccccaggctgaaggctgtccggccaacctctcctccccaggaccacagacccacctgccccggcctggggaccaaggacgccttgggtctccctggagagtctcctgtcaaggagtcacatgggctggctaaggggtcaagtgaggagacggaactccctggcatggtctatgtcgtgggttcccaccacaggctgaggccctggaggctgtcccagagccctgtcccttcctcgggccttctcagcccaggagggagaggaccccagggagctcttcaatctccatctgctcagaaaagaggcctcagcccatcaccttctcctgccagcaagtccaagaagcgacctctctttggaagcccatcccctgctgaaaagacaccgcacccagggcctgggctcagggtctctggggagcaatccctggcttgggggctgggtggcccctcacagtctcaaaagagaaagggtgaccccttggcctccaggaggaagaagaagcggcattgtagccagtaggggccgccatggggcagactctctgatgccagtccccaaaagtggggctctgaagtctcggaccctcatggcacccggtgccccaaagcaaaggctgcttctcctccagtgctgatcttgctgggccttagctttggagggtaggggaaggaggggagggagaaggtggctgaacggggagggcaggaagggagggcctggggggtgggaagcagtgccttgggggccttgtgtgtaaatgtgaataaatgtagttgttttggaaaatg

SEQ ID NO: 3593 - DNA, 4161 bp, Homo sapiens
acacgctgcgcaggcgcaggagcggctccgggtagtccccacagctgcgccggtgactgaggggccgggcagtggagaagtggtggcggcgggcggcgggcggcaaaggagcagccatgagggccgggcccagtcaccgacctgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccccgaatgtgaccgtgtctacctcaactatccccctttcaatggcggccactctgcagcacagccagcctccggacctgagtagcatcgtgcaccagatcaaccagttttgccagacgagggcaggcatcagcactacctcagtgtgtgagggccagatcgccaaccccagccccattagtcgcagtctgctcatcaatgcaagcacccgggtgtcgacccacagcgtccccacaccaatgccttcatgtgtggtcaatcccatggagcacacccacgcggccaccgccgcgttgcctgctgcaggtcctgtcaacctgcccacaggcatctctcgcgtccccactggctaccctagcgacctcaagccagtcacctggaaccagcaccagctggcccacctacagcagatgtgcagcgaggctagtgggacgccagcccctggcctgacaggcaagcatgcggcaggacgcgagttggcagggcctggctttgtgggcaaggcccctgcctacccgcaggaactctgcctggcgcagtccttccatctgaagccacccctggaaaagccgaccccatccccaccagtcaacggcatggcagccccattggcctaccccaatggtcactacttccaacccctgtggaacaacattctgcccactcccaatagcgacagctcggggtctcaggaccttgccatgccgttccacggtgggcagcccacaggtgcacccctcgactgtgcggcagctcccggggcccactaccgagcagggaccgggggcggtccagtggcaagccagaacagcttgatgcaaacagtggattacctaagtggggatttccaacaggcctgcttccgagaacagagcctggccatgctgagcaaggcccaccgagcccctggcaaccgagcccccgatcccacagagagtcgaagtcttcatattcagcacccagggtatagataggtagccctgctgccctccacgtgcaacacatcatacatcaccctcctaggtttagtcttttaagtaactggatagtttcaaagtttcactgctccagtgtgatcattcttagatgtctaagaaagggaatttggtgggatctaagtggggacagaaggggtcctctcgtcctcccctccagcaacttttggttttatgttagaacctaaccctaagcccaggcttttctctccactgactgcctgtcagctagtctctccaccttggccatttccagccagctcccacccatcttttcttgaatctcttcctgtttcccttaggacgactgaggtgtgggctgacggaatgccctagttgaggtagtataggtgctcaggcccctaatccagacctctacctgttgctaccccccttcccctccctccaggactaagaagcaagatttcccaggtgctctgaaagctaattacttactcatcgaaggatctcaaatcaaagctgacccagtcttcatatccttcaagttcctttccattcctcaaggctttgttttgtgtctatattgatcccacagccactgcacttgcccttgccacacttgatctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggattaaaaacaccaaaaaaaaaaaaatgcatttggttctctctacactggctaagaatattgctctacactgtaagttttaaacgttacgtttctgtatgaatgtagtgtgggtttgagtagcattgtgtgtgagtggccccacaggtacattcaccctctagtgcagcccctcagtttaatgaaggaaaaaaaaacaaacacaaagccttaagctctttgagtacttcctttaccaaatgagcatggttctaacacctggagctgggcctacattggaaacaagcccctcctgccctctgtccattcttagagcataccttcatccactccatgctcagcacgtctcatcccaagcgacaattagttggctagaaacacttttctgtaattttaaacttagactgttttgttacaaatttttgcaccattctgttaaagatgcagaattgggcttttttattttttacagatgaaataagcccttacctttcctcttgtctctggggaatgtcagctgatggttcttatttaaggttttgcattttgttcactatccactactgttcgttagccagaaattctctagtgatctgaagcaatgtgactgaagaccagttttaagttatgtgttggcaagttgccttatatttaaaaggaaaaagaaaaaaaaaaaagcctgattgtgttatgccaaatgatagcaacatgaagtcctaatttattgttcccaattgttttcctgccgtctgtgaacactggtacctccctgtcctgatcccccaggagcacctgtagcttctgactcaatgccttctccgaaggtgttggccgccatctcacccagggccctcttccagttcctgcttttctgagtcagatttaaagagcaccactgtcttccccctaccccttgcttgatctccaaagcagatattcttgctgtatttttttttcctccccaatacctctccctgaaaggtgagctgctattttaggaaactggaccagacaccaacttgggggctttaagtcaaacaacctcaaacccatctcttcctgtgtaggggtgcaagcctctgaagctctcactcccacccttagtctgcatggaaaatgtactgtgatccccctgcccccaactgccctcgcctttggtgtgagatgttccttctttcggagttcagcctgagtccctctcccctctgccagccaacccccagccagcaataagggtccaagccagggcctcctctccacactccctgtctccatcctacactaccctagggaatacctggattccccattctatccacatactgtagcattcattctccatctctctcacctcacctgtggtggtttatgggtgtgatggggtttttaagattattataaaccagtaaaaataagaaaacctc

SEQ ID NO: 3594 - DNA, 1356 bp, Homo sapiens
ggaacccgcggcgcagggggcggagtgctcgcgcggcgctgcgtccgggagacgtttttccaggggcattgttatttgtgaccacaatgaaaaatgtagacagtgatgatctggtaactggcacacttcccaagctcaagagctcaaaagaatggttggagcccaagcccctttgttttatggaggttttagctaaagaagatactgaggcagctattcaatcaatattatacaaagaaaattctgtaattaaggaactagataagtatttacaacatcatgccttcttaaatgcaagaagaaaggagatgttatataaaagatgggttgactgtgtggcagatcctcttcagaagaaaattatagaaaaagtttgctcacataagaagattaaaaaaaggaggcaaggggaattagatggctttttaaaacatgtaaataaaaagggaaatgcatttatagaacattatgatccaaaagagtatgatcccttttatatgagcaagaaggaccccaattttctgaaggttaccatcccaccatttcatgaccctttgaaaaaagcacaatatgacaaggataacgaaaaaagaactcttcttcagtgtgagactggcaaaatatattcaataaaggaattcaaagaagttgagaaggttcagctgcattccagattcccacaaatttctaattcaaggcactttataactccaaacgagtggctgaaactgcctacaagatacatagaaagtgaattttgtagaaggagaaggttaaaggtgaaagtgaattttaatgactgtagttttgatttgaaacctttggcaagagctccttatcttttggaatcccaggaagaagaaaaaacagttatttacaaaaacaaagggtcatcctttctagaaagagaaccgctgtgctatcaggagggaaataatccaagtgccaaagaggccatctctgaagggtatttttcttccttgagcctcagcaggaacgggaggaagaccaggatgggtctccctccccgcgtttggggctgctgaagctggagctataagaaagaagagggaggtttcagcaaccaaggagcacacaccctgatccttgattggtgaaaggatacacaaaatcaggctgcttcagaggaagtcatctgctcacaggaatcagggtgaaggccaaggacggcactcaagaattgtcctgtctctaaaaaaaaagcatctgcaacgaacttcctttaatttttgagttcagtgtctgtgataattaagaaatggcaataccatgtattttccccagaagttaagaaatattgctgaacgaaccaataaaaataattacagctccctc

SEQ ID NO: 3595 - DNA, 596 bp, Homo sapiens
tccctctttctcagattacaggtttgagaagttccaaatatccgatgccctagaggtttttttcccttaattttattgttacaattggccttcatctagctctggatggttgaactgtagcatggcaaagatgtttgatctcaggacgaagatcatgatcggcatcggaagcagcttactggttgccgcgatggtgctcctaagtgttgtgttctgtctttacttcaaagtagctaaggcactaaaagctgcaaaggaccctgatgctgtggctgtaaaaaatcacaacccagacaaggtgtgttgggccacgaacagccaggccaaagccaccaccatggagtcttgtccatctctccagtgctgtgaaggttgtagaatgcatgccagttctgattccctgccaccttgctgttgtgacataaatgagggcctctgacttgggaaagctgggcacaaaaatcttcatgagcaatatttctttcttaatagaatgttttattattcaagtcaagttctagagtgtttacatactattatataatgtacagtgttattttctgtacttctgaataaatgtgcaatattggaaataa

SEQ ID NO: 3596 - DNA, 345 bp, Homo sapiens
cactgtctgctgccacacgatgctgggaggcctggggaagctggctgccgaaggcctggcccaccgcaccgagaaggccaccgagggagccattcatgccgtggaagaagtggtgaaggaggtggtgggacacgccaaggagactggagagaaagccattgctgaagccataaagaaagcccaagagtcaggggacaaaaagatgaaggaaatcactgagacagtgaccaacacagtcacaaatgccatcacccatgcagcagagagtctggacaaacttggacagtgagtgcacctgctaccacggcccttccccagtctcaataaaaagccatgacatgtgta

SEQ ID NO: 3597 - DNA, 362 bp, Homo sapiens
tcagcatcctagttcgccactgtctgctgccacacgatgctgggaggcctggggaagctggctgccgagggcctggcccaccgcaccgagaaggccaccgagggagccattcatgccgtggaggaagtggtgaaggaggtggtgggacatgccaaggagactggagagaaagccattgctgaagccataaagaaagcccaggagtcaggggacaaaaagatgaaggaaatcaccgagacagtgaccaacacagtcacaaatgccatcacccatgcagcagaaagtctggacaaacttggacagtgagtgcacctgctaccacggcccttccccagtctcaataaaaagccatgacatgtgta

SEQ ID NO: 3598 - DNA, 345 bp, Homo sapiens
cactgtctgctgccacacgatgctgggaggcctggggaagctggctgccgagggcctggcccaccgcaccgagaaggccaccgagggagccattcatgccgtggaggaagtggtgaaggaggtggtgggacatgccaaggagactggagagaaagccattgctgaagccataaagaaagcccaggagtcaggggacaaaaagatgaaggaaatcaccgagacagtgaccaacacagtcacaaatgccatcacccatgcagcagaaagtctggacaaacttggacagtgagtgcacctgctaccacggcccttccccagtctcaataaaaagccatgacatgtgta

SEQ ID NO: 3599 - DNA, 301 bp, Homo sapiens
cactgtctgctgccacacgatgctgggaggcctggggaagctggctgccgagggcctggcccaccgcaccgagaaggccaccgagggagccattcatgccgtggaggaagtggtgaaggaggtggtgggacatgccaaggagactggagagaaagccattgctgaagccataaagaaagcccaggagtcaggggacaaaaagatgaaggaaatcaccgagacagtgaccaacacagtcacaaatgccatcacccatgcagcagaaagtctggacaaacttggacagtgagtgcacctgcta

SEQ ID NO: 3600 - DNA, 362 bp, Homo sapiens; identical to SEQ ID NO: 3597

SEQ ID NO: 3601 - DNA, 362 bp, Homo sapiens; identical to SEQ ID NO: 3597

SEQ ID NO: 3602 - DNA, 345 bp, Homo sapiens; identical to SEQ ID NO: 3598

SEQ ID NO: 3603 - DNA, 616 bp, Homo sapiens
cagtccccgaggcttggcaaagcaggagccctctgtggcagtgcttgggtgtcggggctctgaggatccggcctcacctctccacggggtcgacgggaacgtctccggatgccaggagtcgcaaagggccgaccacgatgaggaaaccccaggcggggacgggggaagcagcacgggatcccagcctcaggcctgcccggacggtgttggttggggatcaagatgagtacactgcagccgagaacaagagccccagaggaactctttgtcccacaggagagcagcggatccacgccagagaagatgcttgtatcttttcacggctcttctctgagaaatgaagccacaccacgatacagtcagcaagaggaagccgggaatgggagatggcaacagtccctgtcactggaacgctggcctccctggacaagccaccctttaggaaccccaccccttatgcctgtggcggtggcacggtgctgtatcctgcctgggctctggcctctactctctcctccctctggctctgcctcccctgtttctcaggggcctggatgcctctcgctctggccaaatgccttcaaaaaagatgacttcccagtccgtcagggagaca

SEQ ID NO: 3604 - DNA, 616 bp, Homo sapiens
cagtccccgaggcttggcaaagcaggagccctctgtggcagtgcttgggtgtcggggctctgaggatccggcctcacctctccacggggtcgacgggaacgtctccggatgccaggagtcgcaaagggccgaccacgatgaggaaaccccaggcggggacgggggaagcagcacgggatcccagcctcaggcctgcccggacggtgttggttggggatcaagatgagtacactgcagccgagaacaagagccccagaggaactctttgtcccacaggagagcagcggatccacgccagagaagatgcttgtatcttttcacggctcttctctgagaaatgaagccacaccacgatacagtcagcaagaggaagccgggaatgggagatggcaacagtccctgtcactggaacgctggcctccctggacaagccaccctttaggaaccccaccccttatgtctgtggcggtggcacggtgctgtatcctgcctgggctctggcctctactctctcctccctctggctctgcctcccctgtttctcaggggcctggatgcctctcgctctggccaaatgccttcaaaaaagatgacttcccagtccgtcagggagaca

SEQ ID NO: 3605 - DNA, 1338 bp, Homo sapiens
tcttgatcctagaaaagagaccgctcaggatggggatatttcaattgctccgggaccgaagaatctcctcacgtgggccaggccttcacacacccaaagcggaaccgcgtcggcgaaaaggattgacaaccggtctcatgacccaggcagagaggcagaaacaggctcaccaaagacaggccaccatgcgagaaacagctttgtggtgcacagggcacattcggccaaggacacacatgcacacgggcacacacacacaaaccgacagagagagggaaagaaacacacagagactgagagacagagagagaagagagaatgggagacacacacacatacacacacagacacacagacagagtcttatagcaaaggcattgaaagacacacacccaggcaacccctgaggctgtggggttctgctttcgacgagaacgacccttcggtgagagagcaccccaggggcacgcaggccgtcctgtcctcgagatcaccgcatcacgacttttggggagactcacccccaccaacaccgtccagagaggcctgagggagggattccatgctgccttctccggactctgcgtcgggtttcctcaccctgttcggccctttgtgactcttggcatccggagactttcccctcgacccagtggagtcgtcaggccggagcctcagagccttgacacccaagcactgccacggaagtctccccctttgccaagcctcggggactggtttctaagacaaccgtgggaaccactgtgacgggagaaaccgcttgtacttcgcgcatgcgcattggctgggccgactcgttctcccctcctggcagtcaggccgcgtcccctttaaagaacgccaccgctgagaactgaccctcacatctcccttcctgaatttctttagggaaagcaacaaccatccctgtaagccatgggttttcatgcggaggaaggagagggctagttgtctgagagggaaactgcttaaggctgcagactaggaaatgggattccaggtttaagatagctcctttctggacctcagtccttcacctagtcacctagtcacagggtggatcgcctctaaggatacttagtggaaaaggaaccaaattcgggatggttctccttgctttaagccttgatgggagacggggaggccaacccttctctgcagaccgtgatcctcactagacagaggagctccaaacctgcccatctcatcccatgcaccgacagtgcctggcctggctccaaactcccgaaaggaactattttacaggtgccaaaaaggggacagtgttgataataataataaaatgaaacaatctga

SEQ ID NO: 3606 - DNA, 609 bp, Homo sapiens
ctgaggcttcgcaaagcaggagccctccgtagcagggcttcggtgtcggggctccgaggctccggcctgacttctccacggggtacacaggaacgtctccggacgccaggacctgaaatgggccgactaggatgacgaaaccacaggcagagtccggggaagcagcgcggcatcccatcttcaggcctgcccggagggtgttcgggatcaagatgaccacactccagccaaggataaaagccccacaggagctcactgtcctgcaggagaggagcaggcccacgtccaagaagatggctgtatgttttcacggctcttctctgagaagtgaagccacaccacgatacagtcttgaagaggaagccaggaatgggagatggcaacaagccctgtcatggtggcctctctgaacaagttacccttttggcacccctccccttatgcccgtggcggtggcacagtgctgtatcctgcctgggctctggcccctgctctgtcctccctcttactctgtctcccttgtttctgaggggcctagatgcttctaggtctggctgaatgtcttcaaaaaagatcacttcccagtccatcagggagacagttggtgga

SEQ ID NO: 3607 - DNA, 3402 bp, Homo sapiens
acgggcggccggatttgcccggaggccgcacccgcctccggcggggctctcagtgaaaaatgtactctgacctgaatcctgaattttccttgatggtcaaaagattaagaaatcatgagtggaggatctcaagtccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaactataaagtcccagaatctattggttctccagatcttagtggtcatttcttagcaaactgtatgaatagacatgttcatgtgaaagatgactttgtacgttctgtttctgaaacacagaatatagaatcccagaagattcactcctctagactgagtgatataactagctctaatatgcaaatatgtggatttaaaagcacagttccgcatttcaccgaagaagaaaagtatcaaaagcttctcagtgaaaataaaattagagatgaacagcctaaacatcagccagatatatgtggtaagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaacgcagtagataagtcaaggtctgaagcagcagttaggaaggtctcagaccttaaaatatcaactgatacagaatttctcagtataattacctccagccaggttgcttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtgggccagtctgaagctctatctagagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacataaaattcggaccaaattctggctctaaagtgcctttagcaacagttacagtaattgatcaatcagaaactaagaagaaggtttttctgtggaggactgcagcattttgggcatttacagtgtttcttggagatataattttactcacagatgttgttattcatgaggaccaatggattggcgagacagtactacaatcaacatttagcagtcagttattaaatcttgggagttattcatctattcagcctgaagaatattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggagtggttctgattaaagcccagatttcagagctggcatttcctattacagcatctcagaagatagcgctaaatgctcacagttctctgaagagtattttttcttctcttcccaacatcgtatatactggttgtgcaaaatgtggattggaactagaaacagatgagaacaggatctacaaacaatgttttagctgcttgccatttactatgaagaaaatatattataggccagcgttaatgactgccattgatggaagacatgatgtttgtatccgtgtagaatcaaagctgatagagaagattcttctcaacatttctgcagactgcctcaacagagtgatagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttactttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtgcttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatg

SEQ ID NO: 3608 - DNA, 3609 bp, Homo sapiens
acgggcggccggatttgcccggaggccgcacccgcctccggcggggctctcagtgaaaaatgtactctgacctgaatcctgaattttccttgatggtcaaaagattaagaaatcatgagtggaggatctcaagtccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaactataaagtcccagaatctattggttctccagatcttagtggtcatttcttagcaaactgtatgaatagacatgttcatgtgaaagatgactttgtacgttctgtttctgaaacacagaatatagaatcccagaagattcactcctctagactgagtgatataactagctctaatatgcaaatatgtggatttaaaagcacagttccgcatttcaccgaagaagaaaagtatcaaaagcttctcagtgaaaataaaattagagatgaacagcctaaacatcagccagatatatgtggtaagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaacgcagtagataagtcaaggtctgaagcagcagttaggaaggtctcagaccttaaaatatcaactgatacagaatttctcagtataattacctccagccaggttgcttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtgggccagtctgaagctctatctagagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacataaaattcggaccaaattctggctctaaagtgcctttagcaacagttacagtaattgatcaatcagaaactaagaagaaggtttttctgtggaggactgcagcattttgggcatttacagtgtttcttggagatataattttactcacagatgttgttattcatgaggaccaatggattggcgagacagtactacaatcaacatttagcagtcagttattaaatcttgggagttattcatctattcagcctgaagaatattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggttatatttgggaatttaaatatctttttgttcagtgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggagtggttctgattaaagcccagatttcagagctggcatttcctattacagcatctcagaagatagcgctaaatgctcacagttctctgaagagtattttttcttctcttcccaacatcgtatatactggttgtgcaaaatgtggattggaactagaaacagatgagaacaggatctacaaacaatgttttagctgcttgccatttactatgaagaaaatatattataggccagcgttaatgactgccattgatggaagacatgatgtttgtatccgtgtagaatcaaagctgatagagaagattcttctcaacatttctgcagactgcctcaacagagtgatagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttactttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtgcttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatg

SEQ ID NO: 3609 - DNA, 2463 bp, Homo sapiens
agatgaactgccaccaaatgagatacgtattgagttgtgtagctcaggaatactgtgttcccaactaaataccttccacaaaagtgctattaaaagaagctgtacctctgaagataaagtgggccagtctgaagctctatctagagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacataaaattcggaccaaattctggctctaaagtgcctttagcaacagttacagtaattgatcaatcagaaactaagaagaaggtttttctgtggaggactgcagcattttgggcatttacagtgtttcttggagatataattttactcacagatgttgttattcatgaggaccaatggattggcgagacagtactacaatcaacatttagcagtcagttattaaatcttgggagttattcatctattcagcctgaagaatattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggttatatttgggaatttaaatatctttttgttcagtgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggagtggttctgattaaagcccagatttcagagctggcatttcctattacagcatctcagaagatagcgctaaatgctcacagttctctgaagagtattttttcttctcttcccaacatcgtatatactggttgtgcaaaatgtggattggaactagaaacagatgagaacaggatctacaaacaatgttttagctgcttgccatttactatgaagaaaatatattataggccagcgttaatgactgccattgatggaagacatgatgtttgtatccgtgtagaatcaaagctgatagagaagattcttctcaacatttctgcagactgcctcaacagagtgatagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttactttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtgcttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatgaacaa

SEQ ID NO: 3610 - DNA, 3295 bp, Homo sapiens
agaaatcatgagtggaggatctcaagtccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaactataaagtcccagaatctattggttctccagatcttagtggtcatttcttagcaaactgtatgaatagacatgttcatgtgaaagatgactttgtacgttctgtttctgaaacacagaatatagaatcccagaagattcactcctctagactgagtgatataactagctctaatatgcaaatatgtggatttaaaagcacagttccgcatttcaccgaagaagaaaagtatcaaaagcttctcagtgaaaataaaattagagatgaacagcctaaacatcagccagatatatgtggtaagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaacgcagtagataagtcaaggtctgaagcagcagttaggaaggtctcagaccttaaaatatcaactgatacagaatttctcagtataattacctccagccaggttgcttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtgggccagtctgaagctctatctagagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacataaaattcggaccaaattctggctctaaagtgcctttagcaacagttacagtaattgatcaatcagaaactaagaagaaggtttttctgtggaggactgcagcattttgggcatttacagtgtttcttggagatataattttactcacagatgttgttattcatgaggaccaatggattggcgagacagtactacaatcaacatttagcagtcagttattaaatcttgggagttattcatctattcagcctgaagaatattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggagtggttctgattaaagcccagatttcagagctggcatttcctattacagcatctcagaagatagcgctaaatgctcacagttctctgaagagtattttttcttctcttcccaacatcgtatatactggttgtgcaaaatgtggattggaactagaaacagatgagaacaggatctacaaacaatgttttagctgcttgccatttactatgaagaaaatatattataggccagcgttaatgactgccattgatggaagacatgatgtttgtatccgtgtagaatcaaagctgatagagaagattcttctcaacatttctgcagactgcctcaacagagtgatagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttactttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtgcttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatg

SEQ ID NO: 3611 - DNA, 3499 bp, Homo sapiens
agaaatcatgagtggaggatctcaagtccacattttttggggtgctccagttgcttcactgaaaatgacagtatcagaagacacagcttctttaatgtctgttgctgacccctggaaaaaaattcagcttttatacagtcaacattctttatatctgaaggatgaaaaacagcacaaaaatcttgaaaactatgaagtcccagattctattggttctccagatctttgtggtcatttcttagcaaactgtatgaatagacatgttcatgtgaaagatgactttgtacattctgtttctgaaacacagaatatagaatcccagaagattcactcctctagactgagtgacataactagctctaatatgcaaatatgtggatttaaaagcacagttccgcatttaaccgaagaagaaaagtatcaaagcttctcagtgaaaataaaattagagatgaacagcctaaacatcagccagatatatgtggtcagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaactcagtagataagtcaaggtctgaagcagcagttaagaaggtctcagaccttaaaatatcaactgataaagaatttctcagtataattacctccagccaggttgctttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacatattgagttgtgtagctcaggaatactgtgttcccaactaaataccttccacaaaagtgctattaaaagaagctgtacctctgaagataaagtgggccagtctgaagctctatctggagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacaaaattcggaccaaattctggctctaaagtgcctttagcaacagttacagtaagtgatcaatcagaaactaagaagaaggtttttctgtggaggactgcagcattttgggcatttacagtgtttcttggagatataattttactcacggatgttgttattcatgaggaccaatggattggtgagacagtactacaatcaacatttagcagtcagttattaaatcttgggagttattcatctattcagcctgaagaatattccagcgtagttagtgacgttgtacttcaagacttactggcatatgtgtcctcaaaacattcctacctcagagatcttcctccgagacagcctcagagggtgaacagtatagactttgtagaattggagcaccttcaacctgatgtgttagtccacgcagtactaagagttgttgatttcctatactgacagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggttatatttgggaatttaaatatctttttgttcagcgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggagtggttctaattaaagcccagatttcagagctggcatttcctcttacagcagctcagaagatagctctaaatgctcacagttctctgaagagtattttttcttctcttcccaacatcatatatactggctgtgcaaaatgtggattggaactagaaacagatgagaacaggatctacaaacaatgttttagctgcttgccatttactatgaagaaaatatattataggccagcgttaatgactgccgttgatggaagacataatgtttacatccgtgtagaatcaaaactgatagagaagattcttctcaacatttctgcacactgcctcaacagagtgataggcaatatatcaagatcacctatgggatggttgtggcagacctgttccactccttgttggcagtcagcgcagaaccttgtgtattgaagattcagagcctttttgtgttagatgaaaacagctatccattacaacaagatttctccctcctggatttttatcctgacatggtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagataaattaaaacttttttctaagaaaatcctgtgaggtttaaaaagattgtttttgtcttttggtttcttcctttcttctggagaaatgatctaccagtcaaggcaatatgtagcagatccctgggaattaaaggtttgcccatttgttcactgtatttagtccctgctacattccaggcatcgtactaagtatggggaaccacagagaagacactccttcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaagtgaaggaaatgagatcatgtttcaatttattaaagcagggaagagcgttctgtggttagttcgtgtctaggatttgagtgccttactgaatgtatttaccagcaaacatgtagcaatctgttctctcattgtgattgtggaagaagctcatgtaaaatgatagtcattaatgaggaagtatggcgtggtacttattctgtaagctcagagtatgctgagtgttaatagattgtcatattgcctgaaaataaattcatgatgacatgaacaa

SEQ ID NO: 3612 - DNA, 1219 bp, Homo sapiens
tggaatcttctgctaaagaaaatcagactgctgttgatgtttttcgaaggatgattttggaggcagaaaaaatggacggggcagcttcacaagattccagcgtagttagtgacgttgtacttcaagacttactggcatatgtgtcctcaaaacattcctacctcagagatcttcctccgagacagcctcagagggtgaacagtatagactttgtagaattggagcaccttcaacctgatgtgttagtccacgcagtactaagagttgttgatttcctatactgacagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggagtggttctaattaaagcccagatttcagagctggcatttcctcttacagcagctcagaagatagctctaaatgctcacagttctctgaagagtattttttcttctcttcccaacatcatatatactggctgtgcaaaatgtggattggaactagaaacagatgagaacaggatctacaaacaatgttttagctgcttgccatttactatgaagaaaatatattataggccagcgttaatgactgccgttgatggaagacataatgtttacatccgtgtagaatcaaaactgatagagaagattcttctcaacatttctgcacactgcctcaacagagtgatagttccttcctcagagatcacctatgggatggttgtggcagacctgttccactccttgttggcagtcagcgcagaaccttgtgtattgaagattcagagcctttttgtgttagatgaaaacagctatccattacaacaagatttctccctcctggatttttatcctgacatggtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagataaattaaaacttttttctaagaaaatcctgtgaggtttaaaaagattgtttttgtcttttggtttcttcctttcttctggagaaatgatctaccagtcaaggcaatatgtagcagatcc

SEQ ID NO: 3613 - DNA, 5115 bp, Homo sapiens
aaagcgagctgaaccctgaggggagccgctgaccagcagcatggaggaccccgccgcgcctgggaccgggggcccgcccgcaaatggcaatggcaacggcggcggcaaagggaagcaggcggcgcccaagggccgcgaagcgttccgaagccagcggcgggagtcagagggctctgtggactgtcccactctggagtttgagtatggagatgcagatgggcatgcagccgagttgtcagaattgtatagttacactgagaacctggaattcaccaataacaggaggtgctttgaagaagatttcaagactcaagtgcagggcaaggaatggctggagttggaagaagatgcccaaaaggcctatataatgggactcttggaccggctagaggtggtcagtagggaacggcggctgaaggtggcccgggctgttctctacctggcccaaggtacttttggggaatgtgattcagaggtcgatgtgctacactggtccaggtacaactgcttcctgctgtatcagatggggaccttctccaccttcctggagctactccacatggaaattgacaacagccaggcctgtagcagtgcccttcggaaaccagctgtctccatagctgatagcacagagctcagggtgctgctgagtgttatgtacctaatggtggaaaatattcgcctggagcgagagacagacccctgtgggtggagaacagcccgggagaccttccgcactgaattaagcttctccatgcataatgaggagccttttgcccttttactcttctccatggttaccaagttctgcagtggcctggctcctcacttccccataaagaaggtcctgctcctgctctggaaggtggtcatgtttaccctcggtggatttgagcatctgcagactctcaaagtacagaagcgggcagaattgggcctgcctccactggctgaagacagtatccaggtggtgaagagcatgcgtgctgcctccccgccctcttacactcttgacctgggagagtctcagctggcacccccaccctccaagctgcgaggccgccgtggctctcgaaggcaactcctcactaagcaggacagcctggacatctacaatgaaagggatctcttcaagactgaggagcccgccacagaggaggaagaggagtctgctggtgatggagaacgaaccttggatggagagctagacctgctagagcaggaccctctggtgccacctccaccctcacaggcacccctctctgctgagcgggtggcttttcccaagggcctgccctgggccccaaaggtcagacagaaggacattgagcacttcttggagatgagcaggaacaagttcatcggattcaccctggggcaggacacagatacattggttggattacccaggcccatccatgagagtgtgaagaccctaaagcagcacaagtatatctccatcgcagatgtgcagatcaagaatgaagaggagctggagaagtgccctatgtctttgggggaagaggtggtaccagagacgccatgtgaaatcctctaccagggaatgctgtacagccttccgcagtatatgatcgctctgcttaagattctgctggctgcagctcccacctctaaggctaagacagactctatcaatatcctggcagatgtcctacctgaggagatgcccatcactgttctccagagcatgaagctgggcatcgatgtgaacaggcacaaggagattattgtaaagagtatctctaccctgcttctgctactcctcaaacacttcaaactcaaccatatctaccagtttgaatatgtatcgcaacatttggtatttgccaactgcatccccttgatcctgaagttcttcaatcaaaatatcttgtcatacatcactgccaaaaacagcatctcagtcctggattatccttgctgtaccatccaggatttgccggagcttactactgaaagtctggaagctggagacaacagccagttctgctggaggaacctcttttcctgcatcaacctcctgaggctgctcaataaactgaccaaatggaaacattcccggaccatgatgctggtagtgtttaaatcggcaccaatcttaaagcgggccctcaaggtcaaacaggccatgctgcaactttatgtcctaaagctactaaagttacagaccaagtacctggggcgccaatggaggaaaagcaacatgaaaaccatgtcagccatttaccagaaagtgcgtcaccgcatgaacgatgactgggcttacgggaatgacatcgatgccagaccatgggacttccaagcagaagaatgtaccttgagggccaacattgaggcttttaacagccgtcgctatgacagaccccaggactctgagttttcacctgtggataactgcttgcagagcgtactggggcagaggttggatctgcctgaagatttccactattcatatgagctctggctcgagagagaggtgttttcacagcccatctgttgggaggagctgctccagaatcactgactaagttcttgtcaacaagcatcaatagatagaggtcagctccaataaactgtgctctgcctaccctgtccatacaggcgctgttaccagttcagggctcttctgggggctcttgggcctaaagatggtgcaagggtgggatcctgaatcacaataaaatgatcaacttgccctggggtcagttgggtgcccagttggccttggaaatcttttggtggatcaattctagacaagctctttggtaggaccttttcctgctttagtcttggctacaaccaggctagactttgctggctctaaaagaggaaatttgttatggcatttgacccatggcattcatcacagatagtgggaggtacaagtcataaaatagggagaaagttttcttcttgctcacactggattcctaggacttatcagagatttggaaaaaccaactttgaaattaagtttgcattttaaatttcaaatttggaagcctctttctgaaatcattagctctaagattattttagagcacctgcaccttctttgtgaaggatgatgatttactattccctcaatactgcatgttatcgaaaagtgtgttgtgtaaagtgtttttttcctcattctgtaagagatctatattcaatgtgaaaattatttccttgtgtactctgtatagggcatggaatgctctgccatttttaaagagccacaaccaatatgaaataattaggtcctctctaaggatgtttcatgtttttcttaaatgactccagtcttcaaatggctgagcatactgcagaaaattatccttttcatctaattcattttttaaatgacaagttaactacaggaggctttatttattcagatggtatgtccacttgtggtcgtgatcaatatatttttctaattgaaaagtaaaagcatcacagcttaccatttttctttttctgcagtgttgattaatgatttttttcccgtttattgctagcagtttcaaagtgtcatgtggagatttagcaatactgtctctacttaaaagtattgcacatttcattgaaaatgtgagagttgatataccagcctctttatatttctcttttacagcagaatcacatacttctcaagataaacaaggtttttaaaaaagtttctgatttagttaggatcatatgcttttttttttttttttttttttttttttttttttgagacagagtttcgctcttgttgcccaagctggagtgcaatggcacgatctcggctcactgcaacctccgcctcccgggttcaagcgattctcctgcctcagcctcccaaggagctgggattacaggcacgcaccaccatgcctggctaattttttgtatttttagtagaaacagggtttcaccatgttagccaggctgacctcaaactcctgacctcaggtgatccgcccgcctccacctcccagggtgctgggattacaggtgtgagccaccatgcccagcctcttcaagcttttttactatacatgttgcccctctcccccaacttaggcactactgaattttttatgatggcaccaggtcactttatgctgggtgatatagtcaaaatttgcttatttactctgcccctcgtcaaccacagtatcatttcaaggacatgaataaaatacttgacagtatccaaaggagctataccaaaatctaacaagtaaattttggattttgcctctttgtgctttaaagtaccaggatttctgtctctatggataggtcttggagaatgttaagtaatggatgaaactttttaaaataatttgtaaattttacctaagtaggacagtagtccttactgcaatcaaaataatttactgagcacaactcctgtaaattaatctacagtcaggctagtatgattttaatatgatttgagtaaaaagataattttcaaggaaagagtaatcatccatcaatttattataaagccagatagtattcaatttatgtcaagaacaaagaaattgcccttttaaaagcatgtacgtgaatgctttttgaggcacagaagtatgctaagctttaacattttgtatttatttacaacccttttctaagggaaggttacttctcagtgcagatggagaaactgaagcactaaggataaatgattagtttccaatcacatcatttttttccacagacttgctgggactagctttcaggtattgacagccagccccatatattaaggtaaccaggttgaatcttccaatttgagaacccatgtatgggttgcagtgagccgagatcatgccactgcactccatcctgggcaacaagaacgaaactccgtctcaaaaacaaagaaggatataataaagttaatatataaaccatgtatgtggttaggaataaattcaaattcaccagtctccaatggtgattacttttactacatagaaaaacattttagtgacttacagaggatttttatttgtgaatatttcagtaaagtttgtgttgattgttgataacactgttcatctactgaagcactttaataaaaataaaatgagctggaattagaaa

SEQ ID NO: 3614 - DNA, 2866 bp, Homo sapiens
ccctgaggggagccgctgaccagcagcatggaggaccccgccgcgcctgggaccgggggcccgcccgcaaatggcaatggcaacggcggcggcaaagggaagcaggcggcgcccaagggccgcgaagcgttccgaagccagcggcgggagtcagagggctctgtggactgtcccactctggagtttgagtatggagatgcagatgggcatgcagccgagttgtcagaattgtatagttacactgagaacctggaattcaccaataacaggaggtgctttgaagaagatttcaagactcaagtgcagggcaaggaatggctggagttggaagaagatgcccaaaaggcctatataatgggactcttggaccggctagaggtggtcagtagggaacggcggctgaaggtggcccgggctgttctctacctggcccaaggtacttttggggaatgtgattcagaggtcgatgtgctacactggtccaggtacaactgcttcctgctgtatcagatggggaccttctccaccttcctggagctactccacatggaaattgacaacagccaggcctgtagcagtgcccttcggaaaccagctgtctccatagctgatagcacagagctcagggtgctgctgagtgttatgtacctaatggtggaaaatattcgcctggagcgagagacagacccctgtgggtggagaacagcccgggagaccttccgcactgaattaagcttctccatgcataatgaggagccttttgcccttttactcttctccatggttaccaagttctgcagtggcctggctcctcacttccccataaagaaggtcctgctcctgctctggaaggtggtcatgtttaccctcggtggatttgagcatctgcagactctcaaagtacagaagcgggcagaattgggcctgcctccactggctgaagacagtatccaggtggtgaagagcatgcgtgctgcctccccgccctcttacactcttgacctgggagagtctcagctggcacccccaccctccaagctgcgaggccgccgtggctctcgaaggcaactcctcactaagcaggacagcctggacatctacaatgaaagggatctcttcaagactgaggagcccgccacagaggaggaagaggagtctgctggtgatggagaacgaaccttggatggagagctagacctgctagagcaggaccctctggtgccacctccaccctcacaggcacccctctctgctgagcgggtggcttttcccaagggcctgccctgggccccaaaggtcagacagaaggacattgagcacttcttggagatgagcaggaacaagttcatcggattcaccctggggcaggacacagatacattggttggattacccaggcccatccatgagagtgtgaagaccctaaagcagcacaagtatatctccatcgcagatgtgcagatcaagaatgaagaggagctggagaagtgccctatgtctttgggggaagaggtggtaccagagacgccatgtgaaatcctctaccagggaatgctgtacagccttccgcagtatatgatcgctctgcttaagattctgctggctgcagctcccacctctaaggctaagacagactctatcaatatcctggcagatgtcctacctgaggagatgcccatcactgttctccagagcatgaagctgggcatcgatgtgaacaggcacaaggagattattgtaaagagtatctctaccctgcttctgctactcctcaaacacttcaaactcaaccatatctaccagtttgaatatgtatcgcaacatttggtatttgccaactgcatccccttgatcctgaagttcttcaatcaaaatatcttgtcatacatcactgccaaaaacagcatctcagtcctggattatccttgctgtaccatccaggatttgccggagcttactactgaaagtctggaagctggagacaacagccagttctgctggaggaacctcttttcctgcatcaacctcctgaggctgctcaataaactgaccaaatggaaacattcccggaccatgatgctggtagtgtttaaatcggcaccaatcttaaagcgggccctcaaggtcaaacaggccatgctgcaactttatgtcctaaagctactaaagttacagaccaagtacctggggcgccaatggaggaaaagcaacatgaaaaccatgtcagccatttaccagaaagtgcgtcaccgcatgaacgatgactgggcttacgggaatggtgagtcttcccaaagctcttgacttcctggagtttcctggggtttagacaaaactaaataaatatttatcactcctcttttggcatgaattgttacatattttagatgaaaaaatatgtgattataggtcaggcgctgatacaccaaactttaaggttatgcctcaaattctagtatgtacccttgtcctatgtaaactatgaaaatccgttttataaaacaagtaaattgagagataattaattgcctttccaaaacattcttttaaatgacagctttctccaaaagatttaaattaaaacaactttttattattacaaagcagttagaaaaaaagatagaaaatacaagtaaacaaacattttactatattatatttatgccatatttgtactatgcagaaattgccaccattaacatcttattgtatattcctccagatctttttctatgcatatacatgcatattttatcaaaatgaaagcaagttatgtatgctattttgtaattttctcttttaacattatctctaccttttcatgtcagtacattttcatttcatctaataaagttcatattcacaa

SEQ ID NO: 3615 - DNA, 1924 bp, Homo sapiens
taattgtgactttgggattatctatgctatgttccctggctaatggcagggttacctgagaacttcttgtcctgttattgggccgggtggggacagtaggttaaggtggggaattggatgttttcgcaagggctgtgttcagattccatgttccctgaaatgtggaggcctgtggatatggggtggcctcagacaaggatgcccagagtgagatctctgcatgcctaccctcccttctttcccctccagcaactcctcactaagcaggacagcctggacatctacaatgaaagggatctcttcaagactgaggagcccgccacagaggaggaagaggagtctgctggtgatggagaacgaaccttggatggagagctagacctgccctgggccccaaaggtcagacagaaggacattgagcacttcttggagatgagcaggaacaagttcatcggattcaccctggggcaggacacagatacattggttggattacccaggcccatccatgagagtgtgaagaccctaaagcagcacaagtatatctccatcgcagatgtgcagatcaagaatgaagaggagctggagaagtgccctatgtctttggtgagccaaggaagccctacacaggaggagagtagaagaaaacctgtcttcagtgttgtcacagagcatgtgtgcatgcattcattcagcatattaggctgtaactgtgttccagggggaagaggtggtaccagagacgccatgtgaaatcctctaccagggaatgctgtacagccttccgcagtatatgatcgctctgcttaagattctgctggctgcagctcccacctctaaggctaagacagactctatcaatatcctggcagatgtcctacctgaggagatgcccatcactgttctccagagcatgaagctgggcatcgatgtgaacaggcacaaggagattattgtaaagagtatctctaccctgcttctgctactcctcaaacacttcaaactcaaccatatctaccagtttgaatatgtatcgcaacatttggtatttgccaactgcatccccttgatcctgaagttcttcaatcaaaatatcttgtcatacatcactgccaaaaacagcatctcagtcctggattatccttgctgtaccatccaggatttgccggagcttactactgaaagtctggaagctggagacaacagccagttctgctggaggaacctcttttcctgcatcaacctcctgaggctgctcaataaactgaccaaatggaaacattcccggaccatgatgctggtagtgtttaaatcggcaccaatcttaaagcgggccctcaaggtcaaacaggccatgctgcaactttatgtcctaaagctactaaagttacagaccaagtacctggggcgccaatggaggaaaagcaacatgaaaaccatgtcagccatttaccagaaagtgcgtcaccgcatgaacgatgactgggcttacgggaatgacatcgatgccagaccatgggacttccaagcagaagaatgtaccttgagggccaacattgaggcttttaacagccgtcgctatgacagaccccaggactctgagttttcacctgtggataactgcttgcagagcgtactggggcagaggttggatctgcctgaagatttccactattcatatgagctctggctcgagagagaggtgttttcacagcccatctgttgggaggagctgctccagaatcactgactaagttcttgtcaacaagcatcaatagatagaggtcagctccaataaactgtgctctgcctaccctgtccatacaggcgctgttaccagttcagggctcttctgggggctcttgggcctaaagatggtgcaagggtgggatcctgaatcacaataaaatgatcaacttgccct

SEQ ID NO: 3616 - DNA, 3141 bp, Homo sapiens
ggcaggcgagccggacgccgctcgcagcaccggagagggcgcactgcaaaggcgggcagcagaccgtggagagcccgggagcggagctggacaccgcctcggagggaagaaatgaggtagcggcggttcccggacccggccatgcccgtcccctgttctcggagcccagcgccgtctcggccaggccagcccggacactgagcgggccgagcgcgagtccccggcgtccggcggagcgaagatgcagtgagtccccgcgggactgctgcgcggggcccgccgcggccagccggacccagcatccgaccgcactttgggcgagctgctgacttgagaccagcccaaacggggggctttccatctccagcacccctcggaggtggggagcaccggcccctaggcacactcgctgtagagtttccgcgggttttggccccagtcctgagggttgtgtgtgttaggggacccacctcacgttcgccgaggagttcctgcatattcttgcaccatcccgggtgctgttgctggggctctctttatttgcacgcgcgcttctagcttttttcctgacattttccactctacgctcgttctttctcccttgcattttgttgcttgcctgagactctttgctctcgcccttgcccaggctggggtaattctgtgtgcgcgcgtgtctcccccgcaccaaccttttttgcacactcgaagctgaatattttcttttttagagaatttacccgcacctcctgcggggttcctaagcactctctctgctcccctccccccaactccctaccacagggccgctcccagtagttttattcttcgatcttgcccgggccgagcctggcaggggccggtggctcagcgggcctcgcacccggcgctccgccgccgccgccgcccagctgcgccggggcgccctccggagatgctgccgtggaagaagcacaagttcgagctgctggccgaggcgccgccgcggcaggcgtccaagcccaagggctacgctgtgagcctgcactactcggcgctcagctcgctggcgcgggcgtgccccgaaggcgcgcttagccgggtgggcagcatgttccgctccaagcgcaagaagctgcacatcactagcgaggacccaacttacaccgtgctctacctgggcaatgccaccaccatccaggcgcgcggcgacggctgcaccgaccttgctgtgggcaagatctggagcaagagcgaggcgggccgtcagggcaccaagatgaagctgacggtgagtgcgcagggtatccgcatggtgcacgccgaggagcgcgcgctgcgccgcccgggccacctctacctgctgcaccgcgtcacctactgcgtggccgacgcgcggctgcccaaggtcttcgcctgggtgtaccggcacgagctgaagcacaaggccgtgatgctgcgctgccacgccgtgctggtgtccaagcccgaaaaggcgcaggccatggccctgctgctctaccagacgtcggccaacgcgctggcggaatttaaacgcctcaagcggcgggacgacgcgcgtcaccagcagcaggagctggtgggcgcacacaccatcccgctagtgccgctgcgcaagctgctcctacacggaccctgctgctataaaccgccggtggagcgcagccgcagcgcgcccaagcttggctccatcaccgaggacctgctcggcgaacagctggagcaggagctgcaggaggaagaggaagaggagcaacccgagggctgcccggaggaggaggagaaccgtgcggcagagggagatccagcagaggaggaggccgaggcgcagcgtgcgctagtggtcgccatgcactttgagtgcggggacttgttggatactctggagaatggccgtggggaggcgctaggaggcggcgggggctccctgggcccgggggccgggccgccgcctctgctgctgggcagcgcctccgacatgaaggctgagctgtcgcaacttattagcgacctgggcgagctcagcttcggcaacgacgtgcgcaccctgcaggccgacttgcgggtgacgcgcctgctgtcaggcgacagcacgggcagcgagagctccatcgagggcgggggccctgacgccacctccgccaccgccggggactcgtcccgccaggccgacggcgccagtgcagacgagccccactcgggctgagctcctccgcgcgtcgccggcgctccaccgtggctacccatccgtggtcccgacaacctccctgtcccttgcccgcccccaggaagggggaaatggggcatttggggcccagacctacacttggagcccaggtccagcgttcccccgaccgctttcccctacctcccggcccccgctcccgccccagcacttttggctctgttgcgcgtggggatgcggggagatttgagaggggaaaaccccgccaggagggagagagaggcacccctctgggatgcgggtgagggaaggttggctgaagttcctagtctcaggccgtaggtgcctggccagtttcctgtttgtggggcagctggggcctgaggaggaggggttcacttcctcctcccaccccctgggagcggccctgcgctgtcactgacatctcattaaaaaaaaaaaaaaatttgctctcaaggtgtttgaggctttaatgcaaccctttagcccttggttctttttggtgcaagaattctggctgtttacctcagactcagacccctgaaatgttgccaaattcttcaaataactgtttggggggtggggggagatgaaagagagtcgcgttttgtttacagttaaagacatccaatatcttaaaaaggagttttcctttagaaacacacacacccttcctcttgctcaaaagatctcactccatgatactgtgtaaaatatttttgcactgttgtgaagtatttttgacttttttctgtacataactgtgttctcagagctgaatgtttatatcttttgctgtgcaaaagaaacatgtaaaatgttgttcagttgtatatacagaaatgtgtataaaacattttgttattttttaaaagtagcactgttctggttctgtttgcacgccagtggggagagaataaagaggaaaatttaac

SEQ ID NO: 3617 - DNA, 2581 bp, Homo sapiens
agcctgcgtggggggaggggagaagagggcaaggggaggggacaagagagctagcggtcccgcccggtgatgtaggcagcccggggaggtggagccgcgacgcctgaaggagtccccaccgcagccgcgctctcggtctgccccactaagcagccgccagcggctccggcgacccaaattgcggcggcagggaccgcggaaatcccaccgtttgggcttggtggacgtccagcccacctcacccccagccccggcccctcctcgcttcccagacggctggagacactcccgggaaaagcggtcctcagccactcggccgccgtccgcacctcggctgctggcccggctgggcaccgggcatctgcgaagctagccctgcctggcactgggcatctccaggcaacgactgtccccggccctgcccagcttctcgcgactccagggcggtggacttctgcgcgccttccctcccccggtctcccgacaggacgccggtgagctccctgcgcccccagcccctttcgccgccgccgcgatgctgccctggagacgtaacaaattcgtgctggtggaggacgaggccaagtgcaaggcgaagagcctgagtccggggctcgcctacacgtcgctgctctccagcttcctgcgctcctgcccggacctgctgcccgactggccgctggagcgcttgggccgtgtgttccgcagccggcgccagaaagtggagctcaacaaggaggacccgacctacaccgtgtggtacctgggcaacgccgtcaccctgcacgccaagggcgacggctgcaccgacgacgccgtgggcaagatctgggctcgctgcgggcctggcgggggcactaagatgaagctgacgctggggccgcacggcatccgcatgcagccgtgcgagcgcagcgccgccgggggttcggggggccgcaggccggcgcacgcctacctgctgccgcgcatcacctactgcacggcggacgggcgccacccgcgcgtcttcgcctgggtctaccgccaccaggcgcgccacaaggccgtggtgctgcgctgccacgctgtgctgctggcgcgggcgcacaaggcgcgcgccctggcccgcctgctccgccagaccgcgctggcggccttcagcgacttcaagcgcctgcagcgccagagcgacgcgcgccacgtgcgccagcagcatctccgcgctgggggcgccgccgcctcggtgccccgcgccccactgcgccgcctgctcaatgccaagtgcgcctaccggccgccgccgagcgagcgcagccgcggggcgccgcgcctcagcagcatccaggaggaggacgaggaggaggaggaggacgacgcggaggagcaagagggaggagtcccccagcgcgagcggccggaggtgctcagcctggcccgggagctgaggacgtgcagcctgcggggcgccccggcgcccccgccgcccgcgcagccccgccgctggaaggccggccccagggagcgggcgggccaggcgcgctgagagccgaaggacaggactcgcagccccaggcccgacccgccagactcacagcctccaaccccggccctgcccgcttcggctgccccggcccccggcccgtgtctcccccgtggtctccgtgttgtccgccccgccgcctcattttggctcagggtgatgcctgatacgcccttggttattggggggtgttcctctctccccacacccggagtttcccgggcctgccattgtggacccgccccctatgctttacacctagtctctttgcccacagacctcctcattccctcccaaaacatcctctcaagagaagggaggagaagtttcaagaaatcaggaggggtgggtttggaccctgggcagggtggaggcagtgaccttgcccttggtccctctagccttcttccctgtgcaaaaaaaaatgaccctggagaggcattcttgtaggagaagaatctagcggccggggagaattggggccgggccggcggtgggcagagtccgctgctatacacacagggaggaattctcacgcccaagccccgcctctctacgccttggaggactcctgtgacttcactgctctgcctctggagaacactgggagagtcctaccgacgttcaaacaacaggttaggccaggtaacagccctgcaccaggccgctgcccacgcctctgccctggcacccccaggggattccttgcccatcccatctctctgcagacggatgtgtgtggccccctcctaggtgccccacaaccaggaccaagatggggctcccaaaggaggtaaggagaacctttggcaggtgcttaggacactgactacctagaaagtagacgcagcagagttgctcccaagtcgaggctcctcagagcaggtgggtcctgacagcagtggattctcccagcaggatgaggaaggagggtgtgttaaccaaccaagggagtgggccccccacccaggtgtctccgcaagaccacaaaaagcccaaagatctatgtgtcactgatcattgtaaataaagtggacctgcttttacagccctgtcact

SEQ ID NO: 3618 - DNA, 1648 bp, Homo sapiens
agagctgcgcgccgcggcggcggaagatggctgcggccgaggtggcggacactcagctgatgcttggagtcgggctgatcgaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaaaaggtgactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacctggctggctccatcaaagacattgtatctcagtttggaatggaaactgttatcttacacacagcactgatgctaaagaaaagaattgtggtgtatcaccccaagatagaagcggtccaggagttcaccaggactctgcctgccctggtgtggcaccgacaggactggaccatccttcactcttacgtgcacctcaacgccgatgagctggaagccctgcagatgtgcacaggttacgtcgctggatttgtagacttggaggtgagcaacagaccagacctctatgatgtgtttgtgaatctggcagagagtgagattaccattgctccccttgcaaaagaggccatggcaatgggcaaactgcacaaagaaatgggtcagctaattgttcagtctgcagaagatccagagaaatcagagagccacgttatacaggatattgctctaaaaacaagagaaatctttaccaacctagcaccgttttcagaagtttcggctgatggagaaaagagagtccttaatttggaggcgctaaagcaaaaacgatttccaccagcaacagaaaacttcctttatcatctagcagcagccgaacaaatgctgaaaatctgactgtgtgacagaacgtatcactgatgactgatagaaagccctctttcactctgattacccactcactacatgaagtcctgaaaataacagagaaactgttatatctttttaatgatttatttgcaagtattgagatttgacctgaaaaacaatgaaacacatgaacacacttccgattttctcctcgctgattagcttcctgcctgctgtcagtgctggacgaagtgctataactactttatgtaacattacagaacagctagaggtcctggggtaagagaaaaaaagcacatcacaacaaatgtgaaagccttcattattacacgttccagtttgtctcgctgtgtaggcataagctaatggtttattttcagaaagctgcctgaaacgttgctttgtattcttctaggaagaactttaattcctcctgaggaactctactttctgagccaaactgctaattttctgcggaactgtctagaagatcattcaagagaccctgcagttgcactttctcgtaaaagttaaaaaaaaaaaaaaaaaaaaaa

SEQ ID NO: 3619 - DNA, 997 bp, Homo sapiens
gtgcgaggccggtcctgcaggcggcagccagagctgcgcgccgcggcggcggaagatggctgcggccgaggtggcggacactcagctgatgcttggagtcgggctgatcgaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaaaaggtgactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacctggctggctccatcaaaggactctgcctgccctggtgtggcaccgacaggactggaccatccttcactcttacgtgcacctcaacgccgatgagctggaagccctgcagatgtgcacaggttacgtcgctggatttgtagacttggaggtgagcaacagaccagacctctatgatgtgtttgtgaatctggcagagagtgagattaccattgctccccttgcaaaagaggccatggcaatgggcaaactgcacaaagaaatgggtcagctaattgttcagtctgcagaagatccagagaaatcagagagccacgttatacaggatattgctctaaaaacaagagaaatctttaccaacctagcaccgttttcagaagtttcggctgatggagaaaagagagtccttaatttggaggcgctaaagcaaaaacgatttccaccagcaacagaaaacttcctttatcatctagcagcagccg

SEQ ID NO: 3620 - DNA, 1115 bp, Homo sapiens
agagctgcgcgccgcggcggcggaagatggctgcggccgaggtggcggacactcagctgatgcttggagtcgggctgatcgtgaccatctttccaccgtagaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaaaaggtgactcatttttctattgtcctgaccgccaaagattttaacccagagaagtatgctgccttcactaggatattgtgtagacattgtatctcagtttggaatggaaactgttatcttacacacagcactgatgctaaagaaaagaattgtggtgtatcaccccaagatagaagcggtccaggagttcaccaggactctgcctgccctggtgtggcaccgacaggactggaccatccttcactcttacgtgcacctcaacgccgatgagctggaagccctgcagatgtgcacaggttacgtcgctggatttgtagacttggaggtgagcaacagaccagacctctatgatgtgtttgtgaatctggcagagagtgagattaccattgctccccttgcaaaagaggccatggcaatgggcaaactgcacaaagaaatgggtcagctaattgttcagtctgcagaagatccagagaaatcagagagccacgttatacaggatattgctctaaaaacaagagaaatctttaccaacctagcaccgttttcagaagtttcggctgatggagaaaagagagtccttaatttggaggcgctaaagcaaaaacgatttccaccagcaacagaaaacttcctttatcatctagcagcagccgaacaaatgctgaaaatctgactgtgtgacagaacgtatcactgatgactgatagaaagccctctttcactctgattacccactcactacatgaagtcctgaaaataacagagaaactgttatatctttttaatgatttatttgcaagtattgagatttgacctg

SEQ ID NO: 3621 - DNA, 2172 bp, Homo sapiens
gtcctgcaggcggcagccagagctgcgcgccgcggcggcggaagatggctgcggccgaggtggcggacactcagctgatgcttggagtcgggctgatcgaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaaaaggtgactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacctggctggctccatcaaagacattgtatctcagtttggaatgaactgttatcttacacacagcactgatgctaaagaaaagaattgtggtgtatcaccccaagatagaagcggtccaggagttcaccaggactctgcctgccctggtgtggcaccgacaggactggaccatccttcactcttacgtgcacctcaacgccgatgagctggaagccctgcagatgtgcacaggttacgtcgctggatttgtagacttggaggtgagcaacagaccagacctctatgatgtgtttgtgaatctggcagagagtgagattaccattgctccccttgcaaaagaggccatggcaatgggcaaactgcacaaagaaatgggtcagctaattgttcagtctgcagaagatccagagaaatcagagagccacgttatacaggatattgctctaaaaacaagagaaatctttaccaacctagcaccgttttcagaagtttcggctgatggagaaaagagagtccttaatttggaggcgctaaagcaaaaacgatttccaccagcaacagaaaacttcctttatcatctagcagcagccgaacaaatgctgaaaatctgactgtgtgacagaacgtatcactgatgactgatagaaagccctctttcactctgattacccactcactacatgaagtcctgaaaataacagagaaactgttatatctttttaatgatttatttgcaagtattgagatttgacctgaaaaacaatgaaacacatgaacacacttccgattttctcctcgctgattagcttcctgcctgctgtcagtgctggacgaagtgctataactactttatgtaacattacagaacagctagaggtcctggggtaagagaaaaaaagcacatcacaacaaatgtgaaagccttcattattacacgttccagtttgtctcgctgtgtaggcataagctaatggtttattttcagaaagctgcctgaaacgttgctttgtattcttctaggaagaactttaattcctcctgaggaactctactttctgagccaaactgctaattttctgcggaactgtctagaagatcattcaagagaccctgcagttgcactttctcgtaaaagttaaaaaaaaaaaaaaaaaaaaaaggtttttcccggcctttgaacattttgcctatgagagttttgcatatattttatacttgagtagacaactttaataatccatatttatactatcgcagaagtaagcatttggcaaacgttcagccattagcactcatttaaccctgttagcaatattcttttgaaaaaagtgccagtccttatgtgataaactaagaagcccattgaatataaaagtgtgtaggactgaaacagtgaccttatattattgctaagggaatatgagattaacttcctacaggggccaaaaccagagaaaggcttccagcaacttcgatgaaagtagtttggccacatgtcaagccaattgtttgtactatttatgtacctttttcataactggaattgccaaataagcatggagatctaaatgatgtacttgttagtgtattcattcatattgactgtaaaggattatttttcactcagtactgatgtccttggaaatcttacctggaaacatgtttgc

SEQ ID NO: 3622 - DNA, 5664 bp, Homo sapiens
aaaaaaagtactgaagacattttccccgcacaactgctaaagctccagagacacgagcgtgtgtggcagcaagagccgccagttcgggaccaccgcagctggggtggcagcggcgcaggaggggtcgcggggagggagtggtgagcgcaggcggcaggggtctgggaaagacgaagtcgctatttgctgtctgagcgcgctcgcagctcctggaagtgttgccgcctctcggtttcgctctcgctcgctgcgctcctagaaggggcggccgcctccaggtgacacagacgggactctcgcttgcgctttccagatgcatcagagatacttttggactgaccagggccaagtggcgctcggcgggcactacatggcggagggtgaagggtacttcgccatgtctgaggacgagctggcctgcagcccctacatccccctaggcggcgacttcggcggcggcgacttcggcggcggcgacttcggcggcggcgacttcggcggtggcggcagcttcggtgggcattgcttggactattgcgaaagccctacggcgcactgcaatgtgctgaactgggagcaagtgcagcggctggacggcatcctgagcgagaccattccgattcacgggcgcggcaacttccccacgctcgagctgcagccgagcctgatcgtgaaggtggtgcggcggcgcctggccgagaagcgcattggcgtccgcgacgtgcgcctcaacggctcggcagccagccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggaagcttatgtgcagaaaatggttaaagtgtgcaatgactctgaccgatggagtcttatatccctgtcaaacaacagtggcaaaaatgtggaactgaaatttgtggattccctccggaggcagtttgaattcagtgtagattcttttcaaatcaaattagactctcttctgctcttttatgaatgttcagagaacccaatgactgagacatttcaccccacaataatcggggagagcgtctatggcgatttccaggaagcctttgatcacctttgtaacaagatcattgccaccaggaacccagaggaaatccgagggggaggcctgcttaagtactgcaacctcttggtgaggggctttaggcccgcctctgatgaaatcaagacccttcaaaggtatatgtgttccaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagagaaaaaaaaaaaaaagaaaaaaaaaagagtgatccagcccttattagggatgtgttttgtgcaatgatgatatgctcctggttttaagtttggcaaagcttatgtatcttttaatagatgtgggagcatgatctcgaaaggatccttttcccttctcttattctcctacccaattggattctatcctgcaaaaaaagagagacctgtcattagaagcaaccaggttctcctgatacaagagaagaaatgtgtgatgacaatatgggtttgctgtatctgctcccatagctttgccataggaaaaaaaaaagtggaaagtttcttttaagatggaattcataaaagggaaaatacggaggaaaaaaggtctcactccaacttgtgaatcagtttaggagttcagatattaatagtaacaatacaggaaaaaggggaactccaacgttgggattactgtctgaggcttgtagcaagtgctttctgtggaatgatcttgttttgctaacaaacggcttgctccaaatgaacagtagtaggttggtgcagttctcgtaacaatcagcagaacttatgatgacacaatccattaattccagctgcgtgcatagatcacatttttaaaatgtaaaaatgcaagcaaaaacagctgtaacaaagaaagtgtgctcaaggaccaaagatttaacagataaaaatacccaattagaagagatatagtagactatatgaagagagattatatttgttacacaccaatatacatcaaagtgcctgttgccttctgaaaatttgaagtggcaaaattattttatggtttaatgattattttattttatcagggactgcctcaagaagaaaataacataagcttgtgaatggtggagaaaatgccctattttttcttgcaaatacttgtataaagttaacatttgttgatctgatattatcataggtacatgtgtatgtgtgtataaattatatgtgtgtgtgtatatatacattttatatatacattttatatgtatatatacacagtagattgactatgatctagaataatgtctcaaataggaaatgtttaaatactgtgtgtttttatgttttcaacaggataacatgagacgtgggcatattgcaatgatgaattaaatccacatctaaaaaaattaaatgaaggagggaaccaagtaatatatttcataggaagagcagaaattatactgttttagtgggatttttttttctttttttttttttctttggtgagccataaaattccacaaatgggagaatatttgtttggcagagcactcttttttatattgaactgccattttgacagttggaacccatttattaaaaaaaaaattgcattcctctatgatgtttaatctagtggatcatggatcagtaataggctacttaaatccctgactgctaaaaaggatttccggtgatctaaacactacttgctaatgtttaaatgaattttaatgaatgcattctgcatttctggaccactagaatttagtaatgtgaaatgaccctttttacagaatatttgcacaattgcttaaaatttatatatgagatatatattatatataacattttataaatcatgtcaatatgaaacatctttgatctggttgtcacactgcatttaaatatttagtactgtactttaaatcgctttccattaaatcaaatccaactttattttctttcttacaaaaataccagttatacctttgtgaaatgaactggcattactatttcagttcaataacagctaatcctaaaaccaccctttctcctagccagtagttcctctagatactggtctctgaaaatgcatttgttaaaaacaaaacaaaactaacacataagaaccttccctttgtgttgtgaaacaaccacataatctccacaaccttagtggatgactgcttgctatgataattcctcgaagacccaattagaagattttcatcatcagttaaagagagaccacgggagaaaaaaatatcctcctgttggcagtataatttgtttgtttgtttatctagggatcctcagatgcttagtgctaggttaatccaggttaatccgtctggactaccttttgtgcatctttctttgaagccttaatgggaacctgatgggtttgctgtagcagcttccttgtgaattctgtcagagctgcaacagccgctgcactgccactcagttttctaaggaactcctcctactaccatcttggctcagtctccctcacttaagccctgggtttgaaaaattaattgcaacttcccaggaaacattgttcagtttgcagattaagcctggcactcacctatcagaaaccagagctccgcctgcttagttgtttcaaagttttctgaaagaaaactaggggagcacttgtgaacacaggagcagctggtgatctgctttcttaccctaactcttgacaaatgagtcgtctactattttaaagagtctggaggtctctgactctgccataacaataacctgctgttaatttataacacagatttttgtttggaagagccttatttgaaatacactttgatttattttcttaaatatttatattcttttcttgcttacttcagggttggtagcttagttggaagtgccagcacctggcacctattcatatagaacaggctgtactcaagacaacttctagcatttactttaagacttatataatttatttctattttgtgtgtactatagtcttgtgcatatgtagttgaacacacagtgaaatatatgtctctctttgtggatgtgcggcctaaaaatttgaatgtctggtgagagagagccatgtgtataggtcagagaaaagaacagctcccgactccctattagcgcctgtgatttgtttccttttgtgtttatctggcctagtgtgctgtttctttaaaccaggaagaagttttgtcttttggaggctcttctcacctgtccagcctggcatgtcagagaacacatagcctgtgacaatgccgtttttaaaggtttacttaatttgcagtaaatccagctgcctcaagaactcctacaccaagatggacatttcctttccagaaatgggatcaagtatctgctcactttggtattggatggactaataatgtagctccaaaaatgcaaggatggaagaatatgtgtaatccaaaccaaggaaggaaatgaaaagtgaacgtactgtttttaccacccctttctgtttgcttattgttggttgcttcactgtgcataaagttgttttcaatgcaacgcttgttaaataaatattgtgaactattttgtaaatgaaatgtattatgttgaaagctgtcagttcaaaaataagcttttttgttgttgttgaagatgaagtgtgttaggtgaaaccaaaaagccaaaaaaagtaatttcatatatagcatctatttgaatataatctttctttaaaatttcttttagcatagcattttcagtgctaagaaagaatctctatgttatattttgttaaaataatggctttctaacaaagcaaatggtaaagtacaaagttggaagatgtcaagttaacgagacttgctgcaaagccttgcagaacggaggaggctctgcctgctggctgtctctccctccaacctctctacaatcatgcctgctttgaggtgttctgttgcagcaagctgcaccttgggtcactcttttggaatattttgactataggctgcgtcacaggcagaaaaggagttgatggaaaatggactaaaaaactgacatgtttgaatcagtgctagagggaacagattgtgaattttgtttacagcatccaatatttggatttttttgtaaataaaaaagttatttttttctattga

SEQ ID NO: 3623 - DNA, 5537 bp, Homo sapiens
atgcagatgaggagggtgtggcgaacgtgccgctctgggccccggaagcgcagagaagcccggtataaaaaaagtactgaagacattttccccgcacaactgctaaagctccagagacacgagcgtgtgtggcagcaagagccgccagttcgggaccaccgcagctggggtggcagcggcgcaggaggggtcgcggggagggagtggactgaccagggccaagtggcgctcggcgggcactacatggcggagggtgaagggtacttcgccatgtctgaggacgagctggcctgcagcccctacatccccctaggcggcgacttcggcggcggcgacttcggcggcggcgacttcggcggcggcgacttcggcggtggcggcagcttcggtgggcattgcttggactattgcgaaagccctacggcgcactgcaatgtgctgaactgggagcaagtgcagcggctggacggcatcctgagcgagaccattccgattcacgggcgcggcaacttccccacgctcgagctgcagccgagcctgatcgtgaaggtggtgcggcggcgcctggccgagaagcgcattggcgtccgcgacgtgcgcctcaacggctcggcagccagccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggaagcttatgtgcagaaaatggttaaagtgtgcaatgactctgaccgatggagtcttatatccctgtcaaacaacagtggcaaaaatgtggaactgaaatttgtggattccctccggaggcagtttgaattcagtgtagattcttttcaaatcaaattagactctcttctgctcttttatgaatgttcagagaacccaatgactgagacatttcaccccacaataatcggggagagcgtctatggcgatttccaggaagcctttgatcacctttgtaacaagatcattgccaccaggaacccagaggaaatccgagggggaggcctgcttaagtactgcaacctcttggtgaggggctttaggcccgcctctgatgaaatcaagacccttcaaaggtatatgtgttccaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagagaaaaaaaaaaaaaagaaaaaaaaaagagtgatccagcccttattagggatgtgttttgtgcaatgatgatatgctcctggttttaagtttggcaaagcttatgtatcttttaatagatgtgggagcatgatctcgaaaggatccttttcccttctcttattctcctacccaattggattctatcctgcaaaaaaagagagacctgtcattagaagcaaccaggttctcctgatacaagagaagaaatgtgtgatgacaatatgggtttgctgtatctgctcccatagctttgccataggaaaaaaaaaagtggaaagtttcttttaagatggaattcataaaagggaaaatacggaggaaaaaaggtctcactccaacttgtgaatcagtttaggagttcagatattaatagtaacaatacaggaaaaaggggaactccaacgttgggattactgtctgaggcttgtagcaagtgctttctgtggaatgatcttgttttgctaacaaacggcttgctccaaatgaacagtagtaggttggtgcagttctcgtaacaatcagcagaacttatgatgacacaatccattaattccagctgcgtgcatagatcacatttttaaaatgtaaaaatgcaagcaaaaacagctgtaacaaagaaagtgtgctcaaggaccaaagatttaacagataaaaatacccaattagaagagatatagtagactatatgaagagagattatatttgttacacaccaatatacatcaaagtgcctgttgccttctgaaaatttgaagtggcaaaattattttatggtttaatgattattttattttatcagggactgcctcaagaagaaaataacataagcttgtgaatggtggagaaaatgccctattttttcttgcaaatacttgtataaagttaacatttgttgatctgatattatcataggtacatgtgtatgtgtgtataaattatatgtgtgtgtgtatatatacattttatatatacattttatatgtatatatacacagtagattgactatgatctagaataatgtctcaaataggaaatgtttaaatactgtgtgtttttatgttttcaacaggataacatgagacgtgggcatattgcaatgatgaattaaatccacatctaaaaaaattaaatgaaggagggaaccaagtaatatatttcataggaagagcagaaattatactgttttagtgggatttttttttctttttttttttttctttggtgagccataaaattccacaaatgggagaatatttgtttggcagagcactcttttttatattgaactgccattttgacagttggaacccatttattaaaaaaaaaattgcattcctctatgatgtttaatctagtggatcatggatcagtaataggctacttaaatccctgactgctaaaaaggatttccggtgatctaaacactacttgctaatgtttaaatgaattttaatgaatgcattctgcatttctggaccactagaatttagtaatgtgaaatgaccctttttacagaatatttgcacaattgcttaaaatttatatatgagatatatattatatataacattttataaatcatgtcaatatgaaacatctttgatctggttgtcacactgcatttaaatatttagtactgtactttaaatcgctttccattaaatcaaatccaactttattttctttcttacaaaaataccagttatacctttgtgaaatgaactggcattactatttcagttcaataacagctaatcctaaaaccaccctttctcctagccagtagttcctctagatactggtctctgaaaatgcatttgttaaaaacaaaacaaaactaacacataagaaccttccctttgtgttgtgaaacaaccacataatctccacaaccttagtggatgactgcttgctatgataattcctcgaagacccaattagaagattttcatcatcagttaaagagagaccacgggagaaaaaaatatcctcctgttggcagtataatttgtttgtttgtttatctagggatcctcagatgcttagtgctaggttaatccaggttaatccgtctggactaccttttgtgcatctttctttgaagccttaatgggaacctgatgggtttgctgtagcagcttccttgtgaattctgtcagagctgcaacagccgctgcactgccactcagttttctaaggaactcctcctactaccatcttggctcagtctccctcacttaagccctgggtttgaaaaattaattgcaacttcccaggaaacattgttcagtttgcagattaagcctggcactcacctatcagaaaccagagctccgcctgcttagttgtttcaaagttttctgaaagaaaactaggggagcacttgtgaacacaggagcagctggtgatctgctttcttaccctaactcttgacaaatgagtcgtctactattttaaagagtctggaggtctctgactctgccataacaataacctgctgttaatttataacacagatttttgtttggaagagccttatttgaaatacactttgatttattttcttaaatatttatattcttttcttgcttacttcagggttggtagcttagttggaagtgccagcacctggcacctattcatatagaacaggctgtactcaagacaacttctagcatttactttaagacttatataatttatttctattttgtgtgtactatagtcttgtgcatatgtagttgaacacacagtgaaatatatgtctctctttgtggatgtgcggcctaaaaatttgaatgtctggtgagagagagccatgtgtataggtcagagaaaagaacagctcccgactccctattagcgcctgtgatttgtttccttttgtgtttatctggcctagtgtgctgtttctttaaaccaggaagaagttttgtcttttggaggctcttctcacctgtccagcctggcatgtcagagaacacatagcctgtgacaatgccgtttttaaaggtttacttaatttgcagtaaatccagctgcctcaagaactcctacaccaagatggacatttcctttccagaaatgggatcaagtatctgctcactttggtattggatggactaataatgtagctccaaaaatgcaaggatggaagaatatgtgtaatccaaaccaaggaaggaaatgaaaagtgaacgtactgtttttaccacccctttctgtttgcttattgttggttgcttcactgtgcataaagttgttttcaatgcaacgcttgttaaataaatattgtgaactattttgtaaatgaaatgtattatgttgaaagctgtcagttcaaaaataagcttttttgttgttgttgaagatgaagtgtgttaggtgaaaccaaaaagccaaaaaaagtaatttcatatatagcatctatttgaatataatctttctttaaaatttcttttagcatagcattttcagtgctaagaaagaatctctatgttatattttgttaaaataatggctttctaacaaagcaaatggtaaagtacaaagttggaagatgtcaagttaacgagacttgctgcaaagccttgcagaacggaggaggctctgcctgctggctgtctctccctccaacctctctacaatcatgcctgctttgaggtgttctgttgcagcaagctgcaccttgggtcactcttttggaatattttgactataggctgcgtcacaggcagaaaaggagttgatggaaaatggactaaaaaactgacatgtttgaatcagtgctagagggaacagattgtgaattttgtttacagcatccaatatttggatttttttgtaaataaaaaagttatttttttctattga

SEQ ID NO: 3624 - DNA, 546 bp, Homo sapiens
gaagcgcattggcgtccgcgacgtgcgcctcaacggctcggcagccagccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggaagaaagtcacacaaccacatattttctgaacataagctgaacttctacttccatggagtgagttacttcacctcattggcaaaagacaacagaagagtccaaagtctgaggggactgggcaagcttctgtcacatgctttcagaatgaagacaatctgcaagaattttaagttgtgacctctacagagaaaagaatgaaaagtagccaaatctccacatgagagattttggactattttgcagtgtaaaccccatctgatttatatgaagtaagcagactttctctccaagagttcaaaataaattaattctaatgctaaa

SEQ ID NO: 3625 - DNA, 356 bp, Homo sapiens
accaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggc

SEQ ID NO: 3626 - DNA, 2368 bp, Homo sapiens
gttagtcgtcgccgtctgaggtgttccctggctttgtctcgccgtcgttgccgccccgtccctgccttcgtgccccccgccttggcccctgcccagccgctctccctgtcctcctccccttaaccacccccacggtttctgccgtcggggcccgggggccgggcggatgatgccgtcggagagcggagctgagcgcagggaccgggcggctgctcaggtggggacggctgcggccacggcggtggccacggcagccccggcaggcggcggccccgacccggaggccttatcggccttccccggacggcacctgagtgggctgagctggccacaggtgaagcgactggacgctcttctgagcgagccgattcccattcacgggcgcggcaacttccccacgctgagcgtgcagccccggcagatcgtgcaggtggtccgcagcaccctggaggagcagggactacatgtgcacagtgtgcggctgcatggttcagctgccagccacgtgctgcaccctgagagtggcctgggctacaaggatctggacctggtgttccgggtggacctgcgcagtgaggcatccttccagctgaccaaggcagtggtgctggcctgcctactagacttcctgccggccggtgtgagccgggccaagatcacgccactgacactcaaggaggcatacgtgcagaagctggtgaaagtgtgcacagactcggaccgctggagcctcatctcactgtccaacaagagcggcaagaacgtggagctcaagtttgtggactcggtgagacgccagtttgaattcagcatagactccttccagatcatcctggactccctgttgctctttggccagtgctcgtccactcccatgtctgaggccttccacccaacggtcacaggcgaaagcctgtacggggacttcaccgaggccctggagcacctgcggcaccgtgtcatcgccacgcgcagtcccgaggagatccgaggtggtggcctcctcaagtactgccacctcctggtgcggggcttccggccccggcccagcaccgatgtgcgcgccctgcagcgctacatgtgctcccgcttcttcatcgactttccagacctggtggagcagcggcgcaccctagagcgctacctggaggcccacttcggtggggcagatgcagcccgccgttacgcctgcctggtgacactgcaccgggtggtcaacgagagcaccgtgtgcctcatgaaccacgagcgccgccagacgctggacctcattgccgcactggcgctgcaggcactggctgagcagggcccagctgccactgccgccctggcctggcgccctccaggcactgacggggttgtgccagccactgtcaattactacgtgacccccgtgcaacctctcctggctcacgcctatcccacctggctgccttgtaactgactcagaccctggccagaagggaagggactgggcctcacggggtggggtggggcctccaagagtgtgtggaggacatgaccagaggcgcagaatgtgccaggaggcccagcactgcagggttgggcctttgattgaacagaccagactttcccgagcacgaggcccctgtgggcttaatgccagcctggggctctcagcaggaggaccctttggttattgcatcacacttttggaccagcatgccggtggggtgcaggcgccatttgtcttggaagtcaatttccttcaggagacaaagcaagtttggggtggtagccttaatgcccagcaccttggattgattcccatggtctaagagggtctttttgactaaggccagcctgtggtgatcccagcagctttggagggcctgcagcccacacactgactgatacatggtatgttacagggacttgtcactttggatcaggctgggccactacagggcctgatgggccaacttgggtaatcactgggaggagggaaactgaggcccgaggcagatacctgggtttggggagggctgggtttagcccggttctctgaactacatacccccagctgtgaagccttcctcttgaggggttgaggtgggcagtatacaggagccaagcagcccagggtgggtcgcagcccaggccccttccagggtgccactcctttcccccttgtgttgcaaggagccctcctgcctgggagcttgttctttggaaggtgctgagcctgaatttgccacagtcaagtcaacgttcccaccccactggcttggttacagggctctcacatggggtaggggagccatactcccacccccttgcgtattcccctgggtttgttgatattttgcactcttaacacctgccaataaagacggtctacactgaa

SEQ ID NO: 3627 - DNA, 3011 bp, Homo sapiens
gaatgtgtggagatcaggtgatgcagaactctggtaaaggatgttagtcttcagagtaagactgttaaattcagcaaagtctactatcagaagacacgtttttctggttggtgtattactttattcagtgataatatgaaaattactatcttcactgaaggatctactgaataatcattttaactcaactatattgcattcttgaaagcaatcctttcaattgatctactgacttcacaatgtctgaaatcagattcaccaatctcacttgggatcaagttataacactggatcaagtgttagatgaagtaattccaattcatggaaaggggaatttccccacaatggaggtaaaaccaaaagacatcattcatgttgtgaaagatcaactcatagggcaaggaattattgttaaagatgccagattgaatggttccgtagcaagttacatacttgcaagccacaatggaatcagctataaggatctggacgttatttttggtgttgagcttccaggtaacgaagaatttcaggttgttaaagatgcagttctagactgtctacttgactttttaccaaaagatgtaaagaaggaaaagctctccccagatatcatgaaagacgcttacgtacagaaattggtcaaggtttgcaatgggcatgattgttggagtcttatctccctttcaaataacactgggaagaatttagaactaaaatttgtgagttcactcagacggcagtttgaatttagtgtagattcctttcaaattgttttggatcccatgttagacttctacagtgacaaaaatgccaagctaaccaaagaatcctatcctgttgtggtagctgaaagcatgtatggagacttccaggaagcaatgacacatttgcaacacaagctcatatgtaccaggaaacctgaagagattagaggtggtggccttctgaagtactgcagcttgctggttcatggcttcaagccagcctgtatgtcagaaatcaaaaacctagaacgttatatgtgctctagattctttattgattttcctcatatagaagaacagcaaaagaaaattgaatcatacctccacaaccatttcataggtgaaggaatgaccaagtatgactaccttatgaccttgcatggagttgtgaatgaaagcactgtttgcctcatgagttatgaaagaagacagattctccacctgatcaccatgatggctttgaaagtacttggagaactaaatattctacccaatacacaaaaggtaacttgcttttatcagcctgctccgtactttgcagctgaggcaaggtaccctatttatgtaatacctgagccaccccccgttagcttccagccataccacccactgcactttcgtggatcaaatggtatgagttaaaaaatacacatgcaaccatagaaactttgatttaattaaacaccatttaaaagcaagtttccaaatgtaaaattcaagatctgtttttatttttgtacagttaccaattattttcaattacagttgatggaatagtagttaccaactatttttgatcaattaagccatcatagtaaatacaatatctataaaccaaccactttaaatgtttttcaaacgttattgactagctataataactttcaaatgttgtgttccccttgaagtgattttcaaatcttttgactacttgtgactttcaaatttactgtgacaaatatattagagatgcctgcatctttgactataacataaaaggacagattcatgttttaaaattaagatgtacagtgaagtatcaaattttttatattcagtcagttcctttgttacatttagttctttttttctattgaacaataccatcaataaatgttcagtacttaacagaaatgcctaatttcaaaagcaacagattcagaagacattaaaaccctggacttttcaagcatttttttttgacaattaaattgggttggatacaaaaatcctactatagtttaaaggaatactggaaaaaaatggttctggaaagccctggacattagtaatttgtcatctatataataaaacatttagttaatttgtggatttgaataacaataccatacagctgtgcaactactactgagatcagatacagggttttttgcccctcaaaataagttaaaacgaatgaaaatgaccagctctgaatgtgaaagctttctatcatcatctactacaaagagactctaaatggcaaacaggaaaaaaacaggcagaggtttatagccatagcatttaccattttatggcttatttgaaaaacatctttatgttgagaaacattccatttcagtaagttaaaatattttcattgtaactaaatgaagcaggtttttcattttgcctttaccaaagatcattttctaacatgccactcaagtgcctcttcgtgtgaatttttgcgtaacactataatttattcaacaactgtatacctttacagtatatctaaatatatacttactacatcgagtatactgctagaaaaatctaccagtgggattaaaaatgtattttcttcccataatgaaaataattcatgaccaatattacctgaagtgtcagaagaggagctgtcttaaattaatatggatcaggccattggaaaacttcagtatttccacttggttatgattttttgtgagtttccatttcagtttttattgaccatcacgttttctatcacaacatgacctgacagttgtatcccgataatttgccagttatagactgtgcttatcttcactgtattacaatattggacagaagtacaccaaatacggcattttcaaataaccaatatttctgagatgttttataccacagcacaagtggccatcagtatatttttaaagaattatatatcacagaaccctgaggctttaaaacactatggacttaccactttcttgacaaagaatttgtaattacaataaaatatttagaaatgaaagg

SEQ ID NO: 3628 - DNA, 3106 bp, Homo sapiens
acgcgccccagctcccaccttgggtccttcgcctgcacccagtctaacctggcacctaaagatttcactctgtccttggcccctcaccattgtctcagagtttaagccttaacggatgaaggaaaaagattatttgtgaaaagaaattatctaacacttctcatctatctaactggagtttcactagctggagtttttctggttggtgtattactttattcagtgataatatgaaaattactatcttcactgaaggatctactgaataatcattttaactcaactatattgcattcttgaaagcaatcctttcaattgatctactgacttcacaatgtctgaaatcagattcaccaatctcacttgggatcaagttataacactggatcaagtgttagatgaagtaattccaattcatggaaaggggaatttccccacaatggaggtaaaaccaaaagacatcattcatgttgtgaaagatcaactcatagggcaaggaattattgttaaagatgccagattgaatggttccgtagcaagttacatacttgcaagccacaatggaatcagctataaggatctggacgttatttttggtgttgagcttccaggtaacgaagaatttcaggttgttaaagatgcagttctagactgtctacttgactttttaccaaaagatgtaaagaaggaaaagctctccccagatatcatgaaagacgcttacgtacagaaattggtcaaggtttgcaatgggcatgattgttggagtcttatctccctttcaaataacactgggaagaatttagaactaaaatttgtgagttcactcagacggcagtttgaatttagtgtagattcctttcaaattgttttggatcccatgttagacttctacagtgacaaaaatgccaagctaaccaaagaatcctatcctgttgtggtagctgaaagcatgtatggagacttccaggaagcaatgacacatttgcaacacaagctcatatgtaccaggaaacctgaagagattagaggtggtggccttctgaagtactgcagcttgctggttcatggcttcaagccagcctgtatgtcagaaatcaaaaacctagaacgttatatgtgctctagattctttattgattttcctcatatagaagaacagcaaaagaaaattgaatcatacctccacaaccatttcataggtgaaggaatgaccaagtatgactaccttatgaccttgcatggagttgtgaatgaaagcactgtttgcctcatgagttatgaaagaagacagattctccacctgatcaccatgatggctttgaaagtacttggagaactaaatattctacccaatacacaaaaggtaacttgcttttatcagcctgctccgtactttgcagctgaggcaaggtaccctatttatgtaatacctgagccaccccccgttagcttccagccataccacccactgcactttcgtggatcaaatggtatgagttaaaaaatacacatgcaaccatagaaactttgatttaattaaacaccatttaaaagcaagtttccaaatgtaaaattcaagatctgtttttatttttgtacagttaccaattattttcaattacagttgatggaatagtagttaccaactatttttgatcaattaagccatcatagtaaatacaatatctataaaccaaccactttaaatgtttttcaaacgttattgactagctataataactttcaaatgttgtgttccccttgaagtgattttcaaatcttttgactacttgtgactttcaaatttactgtgacaaatatattagagatgcctgcatctttgactataacataaaaggacagattcatgttttaaaattaagatgtacagtgaagtatcaaattttttatattcagtcagttcctttgttacatttagttctttttttctattgaacaataccatcaataaatgttcagtacttaacagaaatgcctaatttcaaaagcaacagattcagaagacattaaaaccctggacttttcaagcatttttttttgacaattaaattgggttggatacaaaaatcctactatagtttaaaggaatactggaaaaaaatggttctggaaagccctggacattagtaatttgtcatctatataataaaacatttagttaatttgtggatttgaataacaataccatacagctgtgcaactactactgagatcagatacagggttttttgcccctcaaaataagttaaaacgaatgaaaatgaccagctctgaatgtgaaagctttctatcatcatctactacaaagagactctaaatggcaaacaggaaaaaaacaggcagaggtttatagccatagcatttaccattttatggcttatttgaaaaacatctttatgttgagaaacattccatttcagtaagttaaaatattttcattgtaactaaatgaagcaggtttttcattttgcctttaccaaagatcattttctaacatgccactcaagtgcctcttcgtgtgaatttttgcgtaacactataatttattcaacaactgtatacctttacagtatatctaaatatatacttactacatcgagtatactgctagaaaaatctaccagtgggattaaaaatgtattttcttcccataatgaaaataattcatgaccaatattacctgaagtgtcagaagaggagctgtcttaaattaatatggatcaggccattggaaaacttcagtatttccacttggttatgattttttgtgagtttccatttcagtttttattgaccatcacgttttctatcacaacatgacctgacagttgtatcccgataatttgccagttatagactgtgcttatcttcactgtattacaatattggacagaagtacaccaaatacggcattttcaaataaccaatatttctgagatgttttataccacagcacaagtggccatcagtatatttttaaagaattatatatcacagaaccctgaggctttaaaacactatggacttaccactttcttgacaaagaatttgtaattacaataaaatatttagaaatgaaagg

SEQ ID NO: 3629 - DNA, 1624 bp, Homo sapiens
agcgccctgcaccgcaggcccagcgctcgccccaccgaaattgccgaacctggttcacacactcatttactcattccgcagataggtctgagggcctcccatgggccacgcgctggggattcaaggtggctgggacattcccctgctctagaggcgctcgcaagttagcggggacaccgttaccgcaattacaacacaatgtagcaagtgcttctaccaggtgcctgctgagatcatgccagcaagcatgttctgcctggatgacctagggccccacattgaactggggcctgggggatgcataagtttgtcacgtaaggggcatgtgcaagaatggaagatgtgcaaaaaagggaggaggaggcatttcacggagaaggaaacggagtggaagcagcctgaggccctcatccaatgcagatgtctgtgccgtgcgtcttgtccagcctgcagaaccatgagccaaataaacctcttttcactacccaatctcagctcttatcaaaggtgctggaagtgcttgatcctgaccggaagctggaggacacatgggcttattgtcaggacaccaggaaaggaatgaaggaacccacgaagcttttaaaaaaacattctacccaagtctacctgggaccttccaagaagacgtctgtgtcaaacgcaggccaatggctttatgaagaaaagccacataaaatggatttgctccatgaaaatggtcctcgtcctggtcttcatgaaaatgtatgcaaagcagttagtgacttctgcaagtgggttactacttttggaatttcggacatcgatgaagagttcatcttgaaacagtttgacattgactatgagaccaaaccaagccatgatgcgctccacacgatgaagctaaatcaggttcctctggagctaaagcgtagtgtggggctcagtaaactgcaggagacagagttcttccagaaactaggctatgagaggaaactccagaaaccacagaatccttataagccaaagtgggtgaagatgaggtatggagcatggtatttgaaccccaagttgtggaaaaagcaaagagtagacgagcctctggttgaccctgaggtctcacataaggctcaagaggagaattttaaaaaggagctgcaggaacaggaggagttacttgcagaccttcacggaacagttgcctttaaggatttcattctaagcaggggctacaggacgccacgtttccttgagaatatgtatatcgggaaggaatgtaaacgtgcatgtaataagactcctataaaacgaactcaagcatagaagaatcgtaggagaatgattaggcagattttattactacgtacttggctatttctctgtctccttttaaagattaaacagagtttatgatgagtgtcccactgtggatgttcaactttgacttggcaacatctgtaaatgtaatacctgatggttataagcatttctcaatggatttctgcttcagttaatcaacattttgtatactttatcacccatgagatcaatattcacatgtaatcttctcatatttttgtggcacgtgaatattatataggtatatcaactattggtaaaaataaataaaggcataaataaaaac

SEQ ID NO: 3630 - DNA, 3029 bp, Homo sapiens
acggtggccgcgaagctagggccaccatggcggaccgcaggcggcggctccggccggggacgttggccccggtgcgcgagggcgtgaactgcaggtccagatgtttcacaaagcacaagaacgggctgaagttccccacctctctgcacagccggcagttggtatttccaagaaaggggctggacgacttcaggaagggctgcccgccttgcactggtctggtgactcaggtccctgtggagggctttctgccccagatttatcacagagctccccaactggccccaaagaagaggcagatcaagctgctcaaggaagcagacgtgctttccaagctctcgccagcccagcaggctcggaaggcattcctggaggacgtggaggcccacctgaccccacatcccttagcgctctacctgaatctggaagaagctatgcccatagagctcttatcaaaggtgctggaagtgcttgatcctgaccggaagctggaggacacatgggcttattgtcaggacaccaggaaaggaatgaaggaacccacgaagcttttaaaaaaacattctacccaagtctacctgggaccttccaagaagacgtctgtgtcaaacgcaggccaatggctttatgaagaaaagccacataaaatggatttgctccatgaaaatggtcctcgtcctggtcttcatgaaaatggaatttcggacatcgatgaagagttcatcttgaaacagtttgacattgactatgagaccaaaccaagccatgatgcgctccacacgatgaagctaaatcaggttcctctggagctaaagcgtagtgtggggctcagtaaactgcaggagacagagttcttccagaaactaggctatgagaggaaactccagaaaccacagaatccttataagccaaagtgggtgaagatgaggtatggagcatggtatttgaaccccaagttgtggaaaaagcaaagagtagacgagcctctggttgaccctgaggtctcacataaggctcaagaggagaattttaaaaaggagctgcaggaacagagcatcttcaagaaagcaatggacatttgatttctaagaccaaagaccttggtaaactgcaagcagcatcatggagattgcagaatccttccagggaagtctgtgacaattcaagagaacatgttccttctggacagtttccagacacagaagctccagctacctctgagaccagtaactctaggagttactctgaagtttcaagaaatgaaagccttgaatctcctatgggagaatggggattccaaaaaggacaagagatatctgctaaagcagctacatgttttgcagagaagttgccttctagcaacctgctcaagaacagagctaaagaagaaatgagcctctctgatttgaacagtcaggaccgggttgaccacgaggagtgggaaatggtgcctaggcactcatcttggggggatgttggtgtgggtggcagtcttaaggctccagtgttaaacctaaaccagggaatggacaatggaagaagcactttggtggaagcaagaggtcagcaagtgcatgggaaaatggaaagggtagcagtgatgcctgcagggtctcagcaagttagtgtcaggttccaggtccattatgtcacaagcactgatgtgcaattcattgcagtaactggagaccatgagtgtcttgggagatggaacacttacatcccactccactataacaaggatgggttctggtctcattccattttcctgcctgcagatacagtggtggagtggaagtttgtgttggtagagaatgggggagttacccgctgggaagaatgcagcaatagattcctagaaactggccatgaggataaagtggttcacgcatggtgggggattcactgattcagtttgcaaagtaatggagaagctgtagaacaatgtggaagaggctgaggttgtggaacacactgaataaaataaaggcagtgtgactccaaattcagccatctgaattgtttaaatttgctagtggattttgtctaatgtgcagaaatatatatgtctaatgtgcagaaatatatatgtgtgtatgtgtgtatatatatgcacacacacacagataatgcttccagtgaatgtgaacttcttttccctgtggcactgattgacagacttgtgctgatccattattactttagggcttgattctcttggggagtgacttggctaagcttcaggtgtaaactgtggtcacggagcaaaaacattaaccagctgcccagggttcaagcttgagcctttaggtgatctttaaactatggtagtaaaataagcctcactcaaacatagctgacttcctattggtacagcttgaaaagcactttttactacatacacattttatgcttaaaaagttaacatgatacgaaactgtgattagaaaatatctggtctggatgtgattagtaaggatacaagataatgttctaagactgcctaatgctttttgtttgattttcatctgccaggcgttgttatgtgctatgagggtagcaagtacgtctttgtcttaatgatctaaggctggtgtagaaacaaagggcctaatgagaaccaatcatcatggaagtcagttgcgggggcagcccataaggaaagggaaagtgagtggggttgggcataggctgagtgaggtggcctgaatgacacctcttagaggactgtgaagtacaggcacagcccgactgcagggagggatgcacccatcatttacccatgggagcatctgtaggaccatctctctcccacttcttctcccctcccccaccgcatctggccagatggactgtcctacagcaatcgtttccatctgtcaccctcttccctctcctttcataccagtcactatcttgggtaacaaatttatacaggacagtggtacagaaatacatctttgctctgagaatacagcaaatattaacttaaattattataactgaacaaataataaaacctgaatttt

SEQ ID NO: 3631 - DNA, 2579 bp, Homo sapiens
agggatctgggacctcagaagctggagacgtggcaccacagcgagggccaccatgggggaccagaggctgcaggactggctgaggtccccgggcatggactccaagccctggtactgtaacaaacggccttccaagtgcttcgcgaagtgcaagcacaggcgcctgaggttcccacccatggacacccagaactgggtatttgtgaaggagggcatggacgacttccgctacggctgtccgtctcccgaagatactctcgtttgtcgccgtgacgagtttttactccccaaaatatctctcagaggtccccaagctgaccccaaaagcgggcagaaaaagctgctcaagaaagcggccctattttccaagctctctccagcccagctagcacggaaggcgttcgtagagcaagtggaagcccagctaatggccaagcatcccttggccatgtaccccaatctgggagaagatatgcctccagatctcctactacaggtgctgaaacacctggatcctgagagggagctggaggacgcttgggcttgttgtgagacccaggagaagacaacagaggtacccactgagcctggtaaacatccctgtggggaattctgcctgaagcctcccgagactccggtgtcccatctcctcccagagcctcccgagactggagtgtcccatctaagcccggagcctcccaagactccggtgtccagtctccgcccggagcctcctgagactggagtgtcccatctccgcccggagcctccagagactggagtgtcccatatccgcccggggcctcccatcactcgtcggagatccagtctcctacgacagctgctgaaactggattctgagaggaagctggaagacgcacgggctccttgtgagggccgggagaagacaactgacgaacccacagagcctggtaaatacccttgtgggaaattctgtcctcggcctttcgagactccactgtcccatctccgccaggagcctcccaagactccggtgtccagtctccgcccggagcctccggagactggagagtcccatctccgcctagagcattccaagactcgtcgggggtccagtctccgctcggagccttccgagactggagtgtcccgtctccgcctagcgcctcccaagactcgtcgggggtccagtctccacgcggagccttccaagactggagtgtcccatctcagcccggagcctcccaagactgaagtgtctcatctccacccagtgcctcccaagactggagtgtgccatctccgcctggaacctcccgacactagtcaggtgtccaatctcctactatacatactgaaagtgctggattctgggaggacgctgaaggacgtatgggatcgttgtgaggcccgggtgaagaaaactaaggaacccaccgagcctcataaatccccttgtggggaaccctgcctgcagcctcccgagactcaggtgtcccatccccacccggaacatcccaagacacgtcggaggtccagtctccactcgcagcctcccaagactcgtcggacgtccagtctccgctcggagcctcccaagactcgtcggacgtccagtctccgctcggagcctcccaagactcgtcggacgtccagtctcggtccggagcctcccaagactcgtcgagtgtccagtctccgcccggagcttcccaagagtcgtcgggtgtccagtctccacccggagcctcccaaagctccagagtcccatcaattctcggagcctcccaagattcgagcatcctacataaaagaactgcttcaggaagatacaccaagcacaaaagagtgcgtttctgactctcttcaatatagatacacatcggaaaaactccgtgaattcttcaagtgggctggagacctgggagctgatgaagaatccatcaggaatctgtttgactttacccccaagtacagagcaacccatgaggaccaaaagtttaagaaagtaaaggagtgttcctcagagctgaagtacagcatggagctagatgaaaaggatgaggacaaattcttctcacaggaaaaatactggggcaggaaattccacacgccatcgaattcttataccgcacagcgtgtgaagatgaagtatggagcatggtacctcaagcctaagttgtggaaaaagctaagaagtgatgaacctttgattgaccccaagctcttacttaaaaagcctgatgaacctgacgttcttgacgatctttatggaccaattgcctttaaggatttcattctaagcaagggctatgaaatgcctggcatcattcaaaggctgtttgccaggaggggatggacttatgactctgttaagactcctattcaacgtgcaatgatattttacaagtacaaagaaatcgtagaggcatcggaagaagattaggcagttttcaatttactactcaattgggtatttcttgctctcattttaatcatcaatcataatttatgatgactggccccgtggatgcacaactttggcaacatctgtaaattcaatacctaatgtttatcaatatttcttaatgaactgc

SEQ ID NO: 3632 - DNA, 2122 bp, Homo sapiens
agaagctggagaggtggcacaacagagagggccaccatgggggaccggaggccacaggaccggccaaggtcccaaggcatggactccaagccctggtactgtgacaaaccgccttccaagtacttcgcgaagcgcaagcacaggcgcctgaggttcccgcctgtggacacccagaactgggtatttgtgacggagggcatggacgacttccgctacgcctgtcagtctcctgaagatacgcttgtttgtcgccgtgacgagtttttactccccaaaatatctctcagaggtccccaagctgaccgcaaaagcaggaagaaaaagctgctcaagaaagcggccctattttccgagctctcgccagtacagccagcacggaaggcgttcgtagaggaagtggaagcccagctgatgaccaagcatcccttggccatgtaccccaatctgggaaaagatatgcctccagatctcctactacaggtgctgaaacagctggatcccgagaggaagctggaggacgcttgggctcgttgtgaggcccgggagaagacaaccgaggtacccaccgagtctggtaaatatccctgtggggaatcctgcccgcggcctcccgagactccggtgtcccgtctccgtcctcagcttcccaagactccggtgtccagtcgccgcccagagcctcccaagactcgggtgtccagtctccgcccagagcctcccaagactcgggtgtccagtctccacccggaacctccagagactcgcgcatctcatctccgcgtggatcctcccgagactggagtgtcccatctctgcccagagcctcccaagactctggtgtccagtgtccacccagagcctcctgatactggagcgtcccatctctgcccggagcctcccgagactcgcgtatctcatctccacccggagcctcctgagactggagtgtcccatctccgcccagagccttccaagactcaggtgtccagtctctgcccggagcctcccgaggctggagtgtcccatctctgcctggaacctcccaacactcatcgggtgtccagtttcctactacaggtgctgaaactggattctgagaagaagctggaagacgcacgggctcgttgtgagggccaggagatgacaaccgaggaactcaccaagcctggtaaataccatttttgggaatcctgtccgcggccttttgagagtcggatgccccatctccgcctggtgcttcccataactcgtcgaatggccagtctctgcctgaagcctcccaagactcgtcgggtgtccagtctctgcccggagcctaccaagaccggagcgtcccatctaaaagaactgtttcaggaagatacaccaagcacaatggagtgtgtttctgactctcttcaacgtagacacacatcgagaaaactccgtgacttcaagtgggctggagacctaggagttaatgaagaatccatcagcagtctgtttgactttacccctgagtgcagaacaaccgatcaagaccaaaagattaagaaggcaaacgagtgtgcttcaaggctgatgtacggcatggagctagacgacatggatgaggtcgaattcttacggataaaatactgggacaggagacgccgggcggcaccgcattcttatagtgcacagcgtgggaggataaggtatggaccatggtacttcgagcctaagttggggaaaaagctaagaagtgatgaacctttgattgaccccaagcccgtacttgaaaagcctgatgaacccgacattcttgacggtctttatggaccaattgcctttaaggatttcattctaagcaagggctacagaatgcctggcgtcattgaaaagctgtttgccaagaagggatggacttacgactctgttaagactcctattcaacgtgcagtgcaagtttacaagtacaaagaagacgtcacagatgcatcaaaagaagattagatggttttcaatttactgcttaattgggtatttcttgctctcattctaaacatcaatcagaatttatgatgactggccccgtgaatgtacaactttggcaacatctgtaaattcaatacccaatgcttataaatatgtcttaatgacc

SEQ ID NO: 3633 - DNA, 3308 bp, Homo sapiens
agggatcaggaaccgcggaaactggagaggtggcaccccagcgagggccaccatgggggaccagaggccgcaggaccggcccagttccccgggcatggactccacgccctggtactgtgacaaaccgccttccaagtacttcgcgaagcgcaagcacaggcgcctgaggttcccgcctgtggacacccagaactgggtatttgtgacggagggcatggacgacttccgctacggctgtcagtctcctgaagatacgcttgtttgtcgccgtgacgagtttttactccccaaaatatctctcagaggtccccaagctgaccccaaaagcaggaagaaaaagctgctcaagaaagcggccctgttttccaagctctcgccagcacagccagcacggaaggcgttcgtagaggaagtggaagcccagctgatgaccaagcatcccttggccatgtaccccaatctgggagaagatatgcctccagatctcctactacaggtactgaaaccgctggaccctgagaggaagctggaggacgcaggctcttgtgagggccaggagaagacaactgacgaacccacggagcctggtaaatacccctgtggggaattctcccctcggcctcccgagactcgggtgtcctgtctccccccggagcctcccaagactccggtgtccagtctccgcccggagcctccagagactggagtgtcccatctccgcccacagcctcccaagactcaggtgtccagtctccacctggagcctccagagactggagtgtcccatctccgcccagagcctcccaagactcaggtgtccagtctccacctggagcctcccgagactggagtgtcccatctctacctggagcctcctgggactggagtgtctcatctctgcccagagcctcccaagactcgcgtatctcatctccatcgggagcctcctgagactggagtgcctgatctctgcctggagcctcccaagtcacgcgtatctcatctccgcccagagccttctgagactggagtgtcccatctccacccagagcctcccaagactctggtgtccagtctccacccagagcctcccgagactggagtgtcccatctctgcccggaacctccagagactcgcgtatctcctctccgccagctgcctcccgaggctggagtgtcccatctctgcccggaacctcccaagactcgcgtacctcctctccgcccagagacccccaagaatggagtgtctcctctcttcccggagcctcccaagactcgcatatctaatctccgctcggagcctcccaagattggagtgtcccatctctgcctggagcctcccaagactcgcggatctcatctccgcccggaacctcctgagactggagtgtcccatctccgcccagagcctcccaagactcgggtgtccagtctccacctggagcctcctgagactggagtgtcccatctctgcccggagcctccagagaaggacgtatctcatctccgcccagagcctcccgacactggagtgtcccatctctgcccagagccccccaagacacgcgtatctcatctccgcccagagccttctgagactggagtgtcccatctccgcccagagcctcccaagattctggtgtccagtctccaccaggcacctcctgagagtagcgtatctcatctccgcccagagcctcctgagactggagtgtcccatctccgcccagagcctcccaagactcggatgtacagtctccgcccggagcctcccgatactggagtgtcccatctctgcccagagcctcccaagactcgggtgtccagtctccccccggagccccccgagactggagtgtcccatctctgcccggagcctccagagactcgcgtatctcatctccgcccagagcctcctgagactggagtgtcccatctccgcccagagcctcccaagactcggatgtacagtctccgcccggagcctcccaatactggagtgtcccatctctgcccagagcctcccaagactcgggtgtccagtctccccccggagccccccgagactggagtgtcccatctctgcccggagcctccagagactcgcgtatctcatctccgcccagagcctcctgagactggagtgtcccgtctccacccagagcctcccaagactcgggtgtccagtctccacgcggagcctcctgagagtcgcgtatctcatctctgcccggagcctcctgagactggagtgtcccatctccgcccagagcctcccaagcctcgggtttccagtctccgcccagagcctcttgagactcgcgtatctcatctccgcccggagcctcctgagactggagtgtcccatctccacccagagcttcccaagcctcgggtatccagtctccacctggagcctcccaagactcgtcgagtgtccagtctccgcctggagcctcccaagactggtcgggtgtccagtctctgcccggagcctaccaagaccggagcgtcccatctaaaagaactgtttcaggaaggtacatcaagcacaatggagtgtgtttctgactctcttcaacgtagacacacatcgagaaaactccgtgacttcaagtgggctggagacctaggagttaatgaagaatccatcagcagtctgtttgactttacccctgagtgcagagcaacctatcaagaccaaaagaataagaaggcaaacgagtgttcctcagggctgaagtacagcatggagctagacgaaatggatgaggtcaaattcttctcacaggaaaaagacttggacgggaaaatccagaatgcaccaaattctcatagtgcacagcatgtgaagatggggtatggagcatggtacctcaagcctaagttggggaaaaagctaagaagtgatgaacctttgattgaccccaagctcgtacttgaaaagcctgatgaacccgacattcttgacggtctttatggaccaatcgcctttaaggatttcattctaagcaagggctatgaaatgcctggcatcattcaaaggctgtttgccaggaggggatggacttatgactctgttaagactcctattcaacgtgcaatgcaagtttacaagtacaaagaagacgtcacagatgcatcggaagaagattagatggttttgaatttactagttaattgggtatttcttgctctcattttaaacatcagtcagaatttatgatgactggccccaggaatgtacaacgttggcaacatctgtaaattcaatacctaatgtttataaatatttcttaatgacc

SEQ ID NO: 3634 - DNA, 1198 bp, Homo sapiens
atgcagatgtctgtgccgtgcgtcttgtccagcctgcagaaccatgagccaaataaacctcttttcactacccaatctcagctcttatcaaaggtgctggaagtgcttgatcctgaccggaagctggaggacacatgggcttattgtcaggacaccaggaaaggaatgaaggaacccacgaagcttttaaaaaaacattctacccaagtctacctgggaccttccaagaagacgtctgtgtcaaacgcaggccaatggctttatgaagaaaagccacataaaatggatttgctccatgaaaatggtcctcgtcctggtcttcatgaaaatgtatgcaaagcagttagtgacttctgcaagtgggttactacttttggaatttcggacatcgatgaagagttcatcttgaaacagtttgacattgactatgagaccaaaccaagccatgatgcgctccacacgatgaagctaaatcaggttcctctggagctaaagcgtagtgtggggctcagtaaactgcaggagacagagttcttccagaaactaggctatgagaggaaactccagaaaccacagaatccttataagccaaagtgggtgaagatgaggtatggagcatggtatttgaaccccaagttgtggaaaaagcaaagagtagacgagcctctggttgaccctgaggtctcacataaggctcaagaggagaattttaaaaaggagctgcaggaacaggaggagttacttgcagaccttcacggaacagttgcctttaaggatttcattctaagcaggggctacaggacgccacgtttccttgagaatatgtatatcgggaaggaatgtaaacgtgcatgtaataagactcctataaaacgaactcaagcatagaagaatcgtaggagaatgattaggcagattttattactacgtacttggctatttctctgtctccttttaaagattaaacagagtttatgatgagtgtcccactgtggatgttcaactttgacttggcaacatctgtaaatgtaatacctgatggttataagcatttctcaatggatttctgcttcagttaatcaacattttgtatactttatcacccatgagatcaatattcacatgtaatcttctcatatttttgtggcacgtgaatattatataggtatatcaactattggtaaaaataaataaaggc

SEQ ID NO: 3635 - DNA, 1484 bp, Homo sapiens
gccaccatggcggaccgcaggcggcggctccggccggggacgttggccccggtgcgcgagggcgtgaactgcaggtccagatgtttcacaaagcacaagaacgggctgaagttccccacctctctgcacagccggcagttggtatttccaagaaaggggctggacgacttcaggaagggctgcccgccttgcactggtctggtgactcaggtccctgtggagggctttctgccccagatttatcacagagctccccaactggccccaaagaagaggcagatcaagctgctcaaggaagcagacgtgctttccaagctctcgccagcccagcaggctcggaaggcattcctggaggacgtggaggcccacctgaccccacatcccttagcgctctacctgaatctggaagaagctatgcccatagagctcttatcaaaggtgctggaagtgcttgatcctgaccggaagctggaggacacatgggcttattgtcaggacaccaggaaaggaatgaaggaacccacgaagcttttaaaaaaacattctacccaagtctacctgggaccttccaagaagacgtctgtgtcaaacgcaggccaatggctttatgaagaaaagccacataaaatggatttgctccatgaaaatggtcctcgtcctggtcttcatgaaaatggaatttcggacatcgatgaagagttcatcttgaaacagtttgacattgactatgagaccaaaccaagccatgatgcgctccacacgatgaagctaaatcaggttcctctggagctaaagcgtagtgtggggctcagtaaactgcaggagacagagttcttccagaaactaggctatgagaggaaactccagaaaccacagaatccttataagccaaagtgggtgaagatgaggtatggagcatggtatttgaaccccaagttgtggaaaaagcaaagagtagacgagcctctggttgaccctgaggtctcacataaggctcaagaggagaattttaaaaaggagctgcaggaacaggaggagttacttgcagaccttcacggaacagttgcctttaaggatttcattctaagcaggggctacaggacgccacgtttccttgagaatatgtatatcgggaaggaatgtaaacgtgcatgtaataagactcctataaaacgaactcaagcatagaagaatcgtaggagaatgattaggcagattttattactacgtacttggctatttctctgtctccttttaaagattaaacagagtttatgatgagtgtcccactgtggatgttcaactttgacttggcaacatctgtaaatgtaatacctgatggttataagcatttctcaatggatttctgcttcagttaatcaacattttgtatactttatcacccatgagatcaatattcacatgtaatcttctcatatttttgtggcacgtgaatattatataggtatatcaactattggtaa

SEQ ID NO: 3636 - DNA, 1120 bp, Homo sapiens
acacatcttcactcttgcactagtttttggtgttatcttctgctatcctgtcttgaagctctttttcagctagataccttgacttttctgaaaaactaaaaccagaagcatttcacgaagctaagcacaggacagaaggtttgctgggatgggaaacctgctcaaagtccttaccagggaaattgaaaactatccacactttttcctggattttgaaaatgctcagcctacagaaggagagagagaaatctggaaccagatcagcgccgtccttcaggattctgagagcatccttgcagacctgcaggcttacaaaggcgcaggcccagagatccgagatgcaattcaaaatcccaatgacattcagcttcaagaaaaagcttggaatgcggtgtgccctcttgttgtgaggctaaagagattttacgagttttccattagactagaaaaagctcttcagagtttattggaatctctgacttgtccaccctacacaccaacccaacacctggaaagggaacaggccctggcaaaggagtttgccgaaattttacattttacccttcgattcgatgagctgaagatgaggaacccggctattcagaatgacttcagctactacagaagaacaatcagtcgcaaccgcatcaacaacatgcacctagacattgagaatgaagtcaataatgagatggccaatcgaatgtccctcttctatgcagaagccacgccaatgctgaaaacccttagcaatgccacaatgcactttgtctctgaaaacaaaactctgccaatagagaacaccacagactgcctcagcacaatgacaagtgtctgtaaagtcatgctggaaactccggagtacagaagtaggtttacgagtgaagagaccctgatgttctgcatgagggtgatggtgggagtcatcatcctctatgaccatgtccaccctgtgggagctttctgcaagacatccaagatcgatatgaaaggctgcataaaagttttgaaggagcaggccccagacagtgtggaggggctgctaaatgccctcaggttcactacaaagcacttgaacgatgaatcaacttccaaacagattcgagcaatgcttcagtag

SEQ ID NO: 3637 - DNA, 4670 bp, Homo sapiens
agaggcgtactcggcggcggcggagcgggcggcagagcagggcggcggcgactcgcagggtaccaccatcttaaggacagaaaagctacaggactctaggaggccaccgtcctgatttgggaagtccaacttactttggccagacagcagctaagctggttcatcccatcagcctggattggtgaaactgaatcacaggagatatttccaggtttgctgggatgggaaacctgctcaaagtccttaccagggaaattgaaaactatccacactttttcctggattttgaaaatgctcagcctacagaaggagagagagaaatctggaaccagatcagcgccgtccttcaggattctgagagcatccttgcagacctgcaggcttacaaaggcgcaggcccagagatccgagatgcaattcaaaatcccaatgacattcagcttcaagaaaaagcttggaatgcggtgtgccctcttgttgtgaggctaaagagattttacgagttttccattagactagaaaaagctcttcagagtttattggaatctctgacttgtccaccctacacaccaacccaacacctggaaagggaacaggccctggcaaaggagtttgccgaaattttacattttacccttcgattcgatgagctgaagatgaggaacccggctattcagaatgacttcagctactacagaagaacaatcagtcgcaaccgcatcaacaacatgcacctagacattgagaatgaagtcaataatgagatggccaatcgaatgtccctcttctatgcagaagccacgccaatgctgaaaacccttagcaatgccacaatgcactttgtctctgaaaacaaaactctgccaatagagaacaccacagactgcctcagcacaatgacaagtgtctgtaaagtcatgctggaaactccggagtacagaagtaggtttacgagtgaagagaccctgatgttctgcatgagggtgatggtgggagtcatcatcctctatgaccatgtccaccctgtgggagctttctgcaagacatccaagatcgatatgaaaggctgcataaaagttttgaaggagcaggccccagacagtgtggaggggctgctaaatgccctcaggttcactacaaagcacttgaacgatgaatcaacttccaaacagattcgagcaatgcttcagtagagctctgctcaaagaagaggatctatgtgctgacctcagaagatgtatatgtttacataatttaatacagattgatgttaatacttgtgtatttacataaccgtttccttcttgtcactgaaatatatggaccttaatttgtatcctgactgactcaacccagcagagcataaattgacttgagagccttacctttgatgtctgaaatgaaacccccttctccaaaggcaaaattcggagactttgatctttgctactggagtcctttaacaacatctataacgataaaaaattcctaattgtttgtggtagtattttaattctagatgtgttatctctctgggaagtatagtttatagaaacacaaaatatttgatttcctgtgtcggctcagctacaagaaacacaactgttatcttgacagaggaagagaggaatccaagaaaaatgcatgtggagaattaaacccaagtgtttcgaattcagcacaccccctctctgtcctcagactgcagtccacacgtgcaacttttctgtttgcacgtgttttattaatcagcatactccttttctgtttggatttatatccctctaatgttctcctttaatttcacatgaaaaaaaaatctcctgtatttttttcagttagtgggagagcagcagaaatagatagatgtgctgttgccactggactgatgaaggtggctgtcttggaactgggagacaggtcctcagaggtgcactcaggcaacaggacagccatctctctgcttcagccctctgcctacagggattagggaaatggagctctggctttgaagttatttgtgagtttagcaaccttccagttacctgcagagttctgggtgcacagccacccctcataagagccctgttctctgaagaccattcatatgagaacaaaggtctaggatactgcattagttaccagaaaactaggggaatttagagggaaaaaaaatccatgttttctatttcccaggtttttaaaaagtagctcttccccaaccccgttgctagcttgttgcaatataaaagccctggtgcacctgaatttactcctggccttactaatgattcataatgtgatcttgagaaatgtgtttaagctttctgagtcttaacctccttgtctctaaaatgggcaattaaaacaatcttcaagagccctgtaaggttaatgccgataaaatgactgactccgcccttcttccttagtacgtagtatccagcaagcatttgccccaccttgtcttgttgatgaacaatattatgaagcctgcagtcattctctctgtacatcagagcttagttcgaatggaatcatgaaaatctctgattctgacctcctaaggaaaaatgaaacccagaggatgtggtcatacaggatggctcccatgtgggcctagaacccaggatgcttcactcttgactccatgctcttccttttataccatgtggctgtgaatacatactatgggatgggattcaacccttctaagtaaatcctcagtctggtctatattgttacttgcctgtttccactagaaggagtcacccaggcatttagtgaatgataatcctagaagttgagtctgagtacatcagagtttggcattatttgcaacatcccaggaatgagctataagactccattgctttctggactttagtgaccagctgatcttcccttggatcctccaataaaggggaaaaaatacttgtcttatgttgttttagcaagggagttcagccaagtgacaggaaagattccctggtctgcatctaaacattagtcaacagaaggaaaaggctcttttccttggagattttcaagttgaaaaagtacagctgcttggatggagtttctctcatcagaatagaaatatgctaggtggtcttcaagacctttttgaacctacagattctaaaccttagaggaagccagaatatgtgatcataccaggtgaggaaagttaggagatattcatcttaagagatatcctatttggcagtcacatgttacacttgagcaacaattgtctaggctagaaatatagaaccacacaatatttatcatcattgggtcaatttctccccctctatcaagtgaggagattaaggcttaaagaaaggaaaggacttgccagccaccacagggctcatgaggggcttgaacccatgtcgtgtgtctctaccacagctgactctcagctggctaatggagaaaatgtgaggaattacctgtcaaattagattgagctcagagtaaatagatgagcacatttataactctaaattagactttctatcaaatgggaccaaacatatggaaggggctgctgtcctgcctcaatttagccaagacttgtcttgtctcaaagccaagactcagcagtacatggattctgagaagtccagggtctgaattgttgtctctgattactggaaggacaggttaactgaatgtctgtgatcactaacaggtgatgggctttgtgcccactccagagatattgtgggagacaaattcttttaacagcctgtcctcccggcatcaggagtcattgaacaatcatggattgttgtgtttgggatttttttttttttggctttgtttttggtttttgtgtgtgtgtgtgtgtgctgcatgcacatgcgtccaagacttacgggtggtttaggggaaagtgctagcaacagtgtcaatgtcattgttaactatatttcatatttgaggtctcattgttttcaaataaacagtgttttccatgactgagatatttatttttgggaaagcaacgaggtaaaaattatgtttctcagatgcactgctactttggcgttattactgtgttctcagaaactcgttgtgcaccactaggaattagtagtagaaaaaaaaaaacaataacaaaaaaaaaaaacaactggaaatggatgtcttcacattaggggtggagtattaacaaccagaaagaaagtttggatattaccttttaactactagttaacatcatgcttgatcaacatttgctcctagttatcaccattaaattaagaccttaatggtaaactgaggttactgatgcatcatcacatttaagtaaaaataatttcatgttttccccaaagaaaaattaagcctcccaatcttaggatccaattgtgcagtagaattcagagacttctcattcaatcttgtatcctatgcagctacaaatattttttaaatgttagtaataaacattggaattttgtcttaaagagttcaaaaccttggaacccagttttctcactacgtctataaaggccattacagacccaaggctgttttgcagttttcatatgttgtttgctgaagtcattgtaattttttttgcctgctttgcctttttttctacaggagttttgagtgtgaaatgaaaattaaagtttggtacatatatttaaaaa

SEQ ID NO: 3638 - DNA, 1386 bp, Homo sapiens
gtactcggcggcggcggagcgggcggcagagcagggcggcggcgactcgcagggtaccaccatcttaaggacagaaaagctacaggactctaggaggccaccgtcctgatttgggaagtccaacttactttggccagacagcagctaagctggttcatcccatcagcctggattggtgaaactgaatcacaggagatatttccaggcccagtgtaaggaatcatggtcaggagtcatgaaaaaaatgccaacacactgagatggccacacatcttcactcttgcactagtttttggtgttatcttctgctatcctgtcttgaagctctttttcagctagataccttgacttttctgaaaaactaaaaccagaagcatttcacgaagctaagcacaggacagaaggtttgctgggatgggaaacctgctcaaagtccttaccagggaaattgaaaactatccacactttttcctggattttgaaaatgctcagcctacagaaggagagagagaaatctggaaccagatcagcgccgtccttcaggattctgagagcatccttgcagacctgcaggcttacaaaggcgcaggcccagagatccgagatgcaattcaaaatcccaatgacattcagcttcaagaaaaagcttggaatgcggtgtgccctcttgttgtgaggctaaagagattttacgagttttccattagactagaaaaagctcttcagagtttattggaatctctgacttgtccaccctacacaccaacccaacacctggaaagggaacaggccctggcaaaggagtttgccgaaattttacattttacccttcgattcgatgagctgaagatgaggaacccggctattcagaatgacttcagctactacagaagaacaatcagtcgcaaccgcatcaacaacatgcacctagacattgagaatgaagtcaataatgagatggccaatcgaatgtccctcttctatgcagaagccacgccaatgctgaaaacccttagcaatgccacaatgcactttgtctctgaaaacaaaactctgccaatagagaacaccacagactgcctcagcacaatgacaagtgtctgtaaagtcatgctggaaactccggagtacagaagtaggtttacgagtgaagagaccctgatgttctgcatgagggtgatggtgggagtcatcatcctctatgaccatgtccaccctgtgggagctttctgcaagacatccaagatcgatatgaaaggctgcataaaagttttgaaggagcaggccccagacagtgtggaggggctgctaaatgccctcaggttcactacaaagcacttgaacgatgaatcaacttccaaacagattcgagcaatgcttcagtag

SEQ ID NO: 3639 - DNA, 544 bp, Homo sapiens
agaaggggcaggggcgaccgtgctggggcgggtccgcaccagctcctgggagcagagagcagagccgggcaaagagatggggttgtccaggctaggcagggtaccaccatcttaaggacagaaaagctacaggactctaggaggccaccgtcctgatttgggaagtccaacttactttggccagacagcagctaagctggttcatcccatcagcctggattggtgaaactgaatcacaggagatatttccaggtttgctgggatgggaaacctgctcaaagtccttaccagggaaattgaaaactatccacactttttcctggattttgaaaatgctcagcctacagaaggagagagagaaatctggaaccagatcagcgccgtccttcaggattctgagagcatccttgcagacctgcaggcttacaaaggcgcaggcccagagatccgagatgcaattcaaaatcccaatgacattcagcttcaagaaaaagcttggaatgcggtgtgccctcttgttgtgaggctaaagagattttacgag

SEQ ID NO: 3640 - DNA, 579 bp, Homo sapiens
ttaatagggtgggcagaaagggactgggagcgagactgggttcagaatctcaagtaatttggagtgtgcctagggattgggatgatttggctgggcattaatttgaagatccttttgtgacacgcctggcccctcagccacagtcaaaagcagggtaccaccatcttaaggacagaaaagctacaggactctaggaggccaccgtcctgatttgggaagtccaacttactttggccagacagcagctaagctggttcatcccatcagcctggattggtgaaactgaatcacaggagatatttccaggtttgctgggatgggaaacctgctcaaagtccttaccagggaaattgaaaactatccacactttttcctggattttgaaaatgctcagcctacagaaggagagagagaaatctggaaccagatcagcgccgtccttcaggattctgagagcatccttgcagacctgcaggcttacaaaggcgcaggcccagagatccgagatgcaattcaaaatcccaatgacattcagcttcaagaaaaagcttggaatgcggtgtgccctcttgttgtgag

SEQ ID NO: 3641 - DNA, 750 bp, Homo sapiens
atgcagaaggcatcttggaggacttgcagtcatacagaggagctggccacgaaatacgagagggcaatccagcatccagcagatgagaagttgcaagagaaggcatggggtgcagttgttccactagtaggcaaagaaattttacgaattttctcagaggttagaagcagcattaagaggtcttctgggagccttaacaagtaccccatattctcccacccagcatctagagcgagacaggctcttgctaaacagtttgcagaaattcttcatttcacactccggtttgatgaactcaagatgacaaatcctgccatacagaatgatttcagctattatagaagaacattgagtcgtatgaggattacaatgtaccgggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattccttgagggtaatggtgggtgtcataatactctatgaccacgtacatccagtgggagcatttgctaaaacttccaaaattgatatgaaaggttgtatcaaagttcttaaggaccaacctcctaatagtgtgga

SEQ ID NO: 3642 - DNA, 2024 bp, Homo sapiens
aaacggcggcggcggcggcaccggaggctccgaggctcctgcgctcccgcgccgcgctcccctcgcccgcccgggccgccaggagaagaaactgaggcctggaatttgattaactcattcaaggttacccagttggtaattcatttgcacacctgttagcaagaaacagaagttgaaggactggaacaagtgaactaggaaagagggaacgccaatccaaggatagaaggacaaggacagaatcaccagcactggctgaaggcctcctgtttcctgcgctttctccttttcctgtgaaatctccgaggagaagaaagaatgatggacagtttatcctttcactgccacaaggcctgtttacttggcagtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 3643 - DNA, 1817 bp, Homo sapiens
aaacggcggcggcggcggcaccggaggctccgaggctcctgcgctcccgcgccgcgctcccctcgcccgcccgggccgccaggagaagaaactgaggcctggaatttgattaactcattcaaggttacccagttgatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagc

SEQ ID NO: 3644 - DNA, 548 bp, Homo sapiens
ttgattaactcattcaaggttacccagttggtaattcatttgcacacctgttagcaagaaacagaagttgaaggactggaacaagtgaactaggaaagagggaacgccaatccaaggatagaaggacaaggacagaatcaccagcactggctgaagaatattagcactattggaatacttaaagaatttttcattataaggccattaatgaaacttgtcttgggagaattttgagaagaattagagcaacagttgtgccattgtgtacaggaaaaccacatttcacctctaggtcctacatatcaacaccttgagaacccgttttgctgtctgccagagcacagtctgggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaata

SEQ ID NO: 3645 - DNA, 421 bp, Homo sapiens
ccgccaacccggaaacggcggcggcggcggcaccggaggctccgaggctcctgcgctcccgcgccgcgctcccctcgcccgcccgggccgccagatagaaggacaaggacagaatcaccagcactggctgaaggtttgctggcatgggtaatctcattaaggtgctaaccagggacatagaccacaatgcagcacattttttcttggactttgaaagtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagag

SEQ ID NO: 3646 - DNA, 574 bp, Homo sapiens
gtgcgagcgccggcggctcggcttctcgaaggagaagaaactgaggcctggaatttgattaactcattcaaggttacccagttgataactgcagcattggactagaggtggagagagtggtactgggggagtggtgaagcaggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagag

SEQ ID NO: 3647 - DNA, 573 bp, Homo sapiens
ttatttctcgcctggcactcgcccgggctgctgctgctgctgctgctgccgccgcggcgggggcagctcgcaaacctgtggcggtgacgtgagccccgccaacccggaaacggcggcggcggcggcaccggaggctccgaggctcctgcgctcccgcgccgcgctcccctcgcccgcccgggccgccaggagaagaaactgaggcctggaatttgattaactcattcaaggttacccagttgatagaaggacaaggacagaatcaccagcactggctgaagttcctcctaacaggaacccagctggcaaagatgtctgggaaatgtcatttgcattctcagccccagcagtgcagaaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccag

SEQ ID NO: 3648 - DNA, 561 bp, Homo sapiens
ttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggagggtaattcatttgcacacctgttagcaagaaacagaagttgaaggactggaacaagtgaactaggaaagagggaacgccaatccaaggatagaaggacaaggacagaatcaccagcactggctgaaggtttgctggcatgggtaatctcattaaggtgctaaccagggacatagaccacaatgcagcacattttttcttggactttgaaagtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaagg

SEQ ID NO: 3649 - DNA, 1902 bp, Homo sapiens
ggggaggcgcgtcgcgaggcgagcgtcctccttttgtgcgagcgccggcggctcggcttctcgaaggagaagaaactgaggcctggaatttgattaactcattcaaggttacccagttggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 3650 - DNA, 696 bp, Homo sapiens
gaaactgaggcctggaatttgattaactcattcaaggttacccagttgggtggtgaaaacagtaggtattctgaaccaaccttgcacttctcaggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaaggtagaattatctattggccctgattgtt

SEQ ID NO: 3651 - DNA, 2021 bp, Homo sapiens
cggcgccctcacttcctggcattccctcctccccctccccgtcgttaccctgtacatccgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggagggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataa

SEQ ID NO: 3652 - DNA, 1907 bp, Homo sapiens
gtcgttaccctgtacatccgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagc

SEQ ID NO: 3653 - DNA, 699 bp, Homo sapiens
tgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggaggatagaaggacaaggacagaatcaccagcactggctgaagaatattagcactattggaatacttaaagaatttttcattataaggccattaatgaaacttgtcttgggagaattttgagaagaattagagcaacagttgtgccattgtgtacaggaaaaccacatttcacctctaggtcctacatatcaacaccttgagaacccgttttgctgtctgccagagcacagtctgggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttag

SEQ ID NO: 3654 - DNA, 579 bp, Homo sapiens
catccgggtcacttgccctccccgctcggagctgccgcctggcttgtcgcggctctgccacaggggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggaggatagaaggacaaggacagaatcaccagcactggctgaaggtttgctggcatgggtaatctcattaaggtgctaaccagggacatagaccacaatgcagcacattttttcttggactttgaaagtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggc

SEQ ID NO: 3655 - DNA, 367 bp, Homo sapiens
aaacggcggcggcggcggcaccggaggctccgaggctcctgcgctcccgcgccgcgctcccctcgcccgcccgggccgccaggagaagaaactgaggcctggaatttgattaactcattcaaggttacccagttgggtggtgaaaacagtaggtattctgaaccaaccttgcacttctcagatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgc

SEQ ID NO: 3656 - DNA, 2196 bp, Homo sapiens
ggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggagggtaattcatttgcacacctgttagcaagaaacagaagttgaaggactggaacaagtgaactaggaaagagggaacgccaatccaaggatagaaggacaaggacagaatcaccagcactggctgaaggcctcctgtttcctgcgctttctccttttcctgtgaaatctccgaggagaagaaagaatgatggacagtttatcctttcactgccacaaggcctgtttacttggcagtaggtccttaagttccttgcttttttgctgctgtttggtgactggaagaggcaccagagactctcactctggggaggtttgctggcatgggtaatctcattaaggtgctaaccagggacatagaccacaatgcagcacattttttcttggactttgaaagtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 3657 - DNA, 1968 bp, Homo sapiens
ccgcgccgcgctcccctcgcccgcccgggccgccaggagaagaaactgaggcctggaatttgattaactcattcaaggttacccagttgatagaaggacaaggacagaatcaccagcactggctgaaggcctcctgtttcctgcgctttctccttttcctgtgaaatctccgaggagaagaaagaatgatggacagtttatcctttcactgccacaaggcctgtttacttggcagtaggtccttaagttccttgcttttttgctgctgtttggtgactggaagaggcaccagagactctcactctggggaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaa

SEQ ID NO: 3658 - DNA, 581 bp, Homo sapiens
aggcccagtaagtatctgcgggagggctgaatgggtgcgtggacagcattcctctcactgaccccgctgcgaggtgagccaggcaggggctgtcaccattcctgaagtccaggagaagaaactgaggcctggaatttgattaactcattcaaggttacccagttggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaatttt

SEQ ID NO: 3659 - DNA, 1628 bp, Homo sapiens
ggctgtcgcgagagcccggggcgagtgggcctctgctcgtgggtggttctcgtggaggtcagctcccgcgtgtctccgctcgacagggtgcttgggcagagcccatcgggtaggcgcgggccatggcgcagtacaagggcaccatgcgcgaggcaggccgtgccatgcacctcctcaagaagcgcgaaaggcagcgggagcagatggaggtgctgaagcagcgcatcgccgaggagaccatcctcaagtcgcaggtggacaagaggttctcggcgcattacgacgccgtggaggccgagctgaagtccagcacggtgggcctggtgaccctgaacgacatgaaggcccggcaggaggccctggtcagggagcgcgagcggcagctggccaagcgccagcacctggaggagcagcggctgcagcaggagcggcagcgggagcaggagcagcggcgcgagcgcaagcgtaagatctcctgcctgtcctttgcactagacgacctcgatgaccaggccgacgcggccgaggccaggcgcgccggaaacctgggcaagaaccccgacgtggacaccagcttcctgccagaccgcgaccgcgaggaggaggagaaccggctccgagaggagctgcgccaagagtgggaggcgcagcgcgagaaagtgaaggacgaggagatggaggtcaccttcagctactgggacggctcgggccaccggcgcacggtgcgggtgcgcaagggcaacacggtgcagcagttcctgaagaaggcgctgcaggggctgcgcaaggacttcctggagctgcgctccgccggcgtggagcagctcatgttcatcaaggaggacctcatcctgccgcactaccacaccttctacgacttcatcatcgccagggcgaggggcaagagcgggccgctcttcagcttcgatgtgcacgatgacgtgcgcctgctcagcgacgccaccatggagaaggacgagtcgcacgcgggcaaggtggtgctgcgcagctggtacgagaagaacaagcacatcttccccgccagccgctgggaggcctatgaccccgagaagaagtgggacaagtacaccatccgctaacacccgcctgccagagcggaaaccgggggtggggggagacactcatttctaggccccatcaccagtcacttgatttcgtgaccttgatttcttcccccaaatttaataaagacagagggttctcatgattcacattggttgtgctattgctgatgttatgctttggttgcttggttggtcttttctgagtattttagtgttgccacctggatttgctgcattgctctgctgagctgtattgaaaccatgactgggcccactgtcagacagaaattagaataggaggcacattttttacctggtggttatgagcatggacttgggggccacagtgactgagtttgattcccgacacagcctcctccttgctgtgtagttttgggtaagcttattaaacccccatgcctcagtttggtcacctgtaaaaggaaataacaagagcacttactttataagattgatgtgagtattaagtgaattaatatttgtaaaacgcttagctcttaataaatgtttctgttgttatta

SEQ ID NO: 3660 - DNA, 1932 bp, Homo sapiens
acggctgtcgcgagagcccggggcgagtgggcctctgctcgtgggtggttctcgtggaggtcagctcccgcgtgtctccgctcgacagggtgcttgggcaggtaagggtccgctcagtagcccaaccctctctgtatgcagctccccaaattcagcgctgcgctcaggcatggcagccacccgttacgtggggccgttcgcatttgcatttattgaggtcaaataaaatgctggaaattggtgcctggtgacactgtcaggttggtggttaccctagcaggtcggcccagcccctgaacgcttccatcactgccgaaagccctgtgaggaggcgcagagctgagcattccccgccgttgcgtgggcccccctctacctgccgcgtttttcctctttgctgcagagcccatcgggtaggcgcgggccatggcgcagtacaagggcaccatgcgcgaggcaggccgtgccatgcacctcctcaagaagcgcgaaaggcagcgggagcagatggaggtgctgaagcagcgcatcgccgaggagaccatcctcaagtcgcaggtggacaagaggttctcggcgcattacgacgccgtggaggccgagctgaagtccagcacggtgggcctggtgaccctgaacgacatgaaggcccggcaggaggccctggtcagggagcgcgagcggcagctggccaagcgccagcacctggaggagcagcggctgcagcaggagcggcagcgggagcaggagcagcggcgcgagcgcaagcgtaagatctcctgcctgtcctttgcactagacgacctcgatgaccaggccgacgcggccgaggccaggcgcgccggaaacctgggcaagaaccccgacgtggacaccagcttcctgccagaccgcgaccgcgaggaggaggagaaccggctccgagaggagctgcgccaagagtgggaggcgcagcgcgagaaagtgaaggacgaggagatggaggtcaccttcagctactgggacggctcgggccaccggcgcacggtgcgggtgcgcaagggcaacacggtgcagcagttcctgaagaaggcgctgcaggggctgcgcaaggacttcctggagctgcgctccgccggcgtggagcagctcatgttcatcaaggaggacctcatcctgccgcactaccacaccttctacgacttcatcatcgccagggcgaggggcaagagcgggccgctcttcagcttcgatgtgcacgatgacgtgcgcctgctcagcgacgccaccatggagaaggacgagtcgcacgcgggcaaggtggtgctgcgcagctggtacgagaagaacaagcacatcttccccgccagccgctgggaggcctatgaccccgagaagaagtgggacaagtacaccatccgctaacacccgcctgccagagcggaaaccgggggtggggggagacactcatttctaggccccatcaccagtcacttgatttcgtgaccttgatttcttcccccaaatttaataaagacagagggttctcatgattcacattggttgtgctattgctgatgttatgctttggttgcttggttggtcttttctgagtattttagtgttgccacctggatttgctgcattgctctgctgagctgtattgaaaccatgactgggcccactgtcagacagaaattagaataggaggcacattttttacctggtggttatgagcatggacttgggggccacagtgactgagtttgattcccgacacagcctcctccttgctgtgtagttttgggtaagcttattaaacccccatgcctcagtttggtcacctgtaaaaggaaataacaagagcacttactttataagattgatgtgagtattaagtgaattaatatttgtaaaacgcttagctcttaataaatgtttctgttgttatta

SEQ ID NO: 3661 - DNA, 5431 bp, Homo sapiens
ggcgcggggtccgcgcccggagcgccccgccgcgcacaggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgtggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcagccgctcccagccgtgtgtccttaacgacaagaaggtcggtgttaaaaggcggcgccctgaagaagtgcaagagcagaggccttctctagaccttgccaagatggcacagaactgtcagaccttcagcagcctcagctgcctgagcgcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtctctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccgtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagccggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttagggagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgccaggccatctgcctgctcatggggtcctaaagcgcgggctaagcctgcaggaaagccggggcggtggggggggcttagtgccacatgcaccccactcattccaaagccaccaaactgccaggggctgccgtccacccgtggggcccaggggctggggccacagccttgccattttcgttgccataccctcttgccttactcgcggtggaggccggatttgcacgggcagacgtgcacctgggcccgtggggagcttgttctgaccagacgtacagattttcattctcagaaagccttacttttcaaccaaatttttgtagccagttttgtgaatttgtacactgaaagaaaatttaaataaaggggaagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatgggggtggtcactggaatgacggtcactccagacgtcagccggcagggatgcagcaggctggccgcgcaccggggctcgggcaccctctggccccacactggcaatgatgccacaccttgccatgtccacgctgttggtcaaacccctctgtcatgcctctttaaagagaaaagaagagaaagattttttttttttttaatggcagaccgaagtggagatcttgtagcctagataggatagtctgaccttctagcatagtctttttggcaaatgatttgtgttttcagtgtgtggggaagctgtcctgggggctggggcgacagatagcacataggctgtttctggggctgcaggggcttccctgagctggatgttgtgggtgttgccgtgcttcaggaagtgtggcgaccagaaagcgtagacccggggcccagggtctgcccgcccctgcagcctggcctccccgcacaggctgtggcttgcactccagccgctctagtctctcaggaatttgcttgttacttgtactgtgtaaataaagcttcctggttcaatacccaa

SEQ ID NO: 3662 - DNA, 3557 bp, Homo sapiens
gtactgtacttaggacgatggtgaacaaagaaaagctctttgcagcgtttgatgaatgggattctgcctcctataggccacactccgagtcttccatacggtacaatctccggactcggtggtgttaggaaagtggcccccggaatggcttgcattccgggtctgggatcctggggtgggcatttgtgccgtcgccttcgccgccgcgctcgccttgcaggagcgggtgcagatggagccaggctgacggttgttcaacaggaacaaatgtttgttcaattgttggatggtggagaaaagggactgtttcctattgactgctgcaggagttggaatggcattgtttattggcctgggaagccaggcaagcgtcttgtgctgcttacaacatattagcagacttccaaatgacatgctagcatatgtgttcccagcagtccccaccggctggcagggagattcctccttgctccagatcctggactcgtttaaaagatgccacctggtttgaggacttgggaaggaatggagtcagccgaccagggagttgaccacatttggccatttcccagaagggccccaccccaagggtgagtggccaatggggagctgtttctgctgacatcaattccccaggaggtactcaccccaagtctgcccaagtgaagatggctgatacccaccctgggatggagcccagcgcctgaggcccttatcatggtgatggtcctaagtgaaagcctcagcacccggggagctgactccattgcatgtgggaccttcagccgtgaactgcacacgccaaagaagatgagtcaaggacctacacttttctcttgtggaattatggaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgtggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcagccgctcccagccgtgtgtccttaacgacaagaaggtcggtgttaaaaggcggcgccctgaagaagtgcaagagcagaggccttctctagaccttgccaagatggcacagaactgtcagaccttcagcagcctcagctgcctgagcgcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtctctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccgtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttggg

SEQ ID NO: 3663 - DNA, 4375 bp, Homo sapiens
ggagggggtgactcgttagtgaggaaaccacccccatccctaaatcaaagcgccaggctcgttcccaacagcgctgtccgagagacactttgagagagacacgacacggagctgcgccctccatgggtggcttggggggattctgcgagccggagctgtccccctactctcctcagggactcgttggttcgcgccagcgccttttaagggcaccgtggggcgaaccgagcgctcagagctgctccggccgcggccctgggagctggaggaaccgcgactcagcaggcatgactggagagggaagtcccaatggtgctagaatggtgctgcagtggcagaagacggctcacaagtgaggtctggaagaacaacagggaagacatccatcatttgctccaaagtgtgcaagtcaaatcctggggagaatcatgataaccctgatcactgagcagctacagaagcagactctggatgagctgaaatgcacacgcttcagcatcagtctgcctttgcctgatcatgcagacatctccaactgtgggaactctttccagcttgtgtctgaaggtgcttcctggaggggcctgccccactgttcctgtgctgagttccaggacagcctcaacttcagctaccatccctcaggcctgagcctgcacctcagaccacccagtcggggaaactcccccaaggagcagcccttctcccaagtcctaagacctgagcccccagatccagagaagcttcctgtgccccctgcccctccatccaagaggcactgccgctcactctcagtgcccgtggacctgtctcgctggcagccggtgtggcggcccgccccctccaagctgtggactcccataaagcaccggggcagtggtggagggggtgggccgcaggtgcctcaccagagccccccaaagcgggtctccagcctcaggttcctccaagctcccagtgcctcttctcaatgtgccccagctcacagaccctacagccctcctttcttcagcctggccctggcccaagattcctctcgaccctgcgccgcctcccctcaaagtggctcctgggagagtgatgctgagtccttgtcaccttgcccacctcagcgccgcttctccctgtcacccagtctgggcccgcaggcaagccgcttcttgccctctgcccggagctctcccgcatcctccccagagctgccctggcgacctcgaggtctccgcaaccttccccgaagccgctcacagccttgtgatctggatgcccgcaaaactggggtcaagcggcgccacgaggaagacccccggcgtctgcggccttcgttggactttgacaagatgaatcagaaaccatactcaggaggtctttgtctccaagaaacagcccgggaaggcagcagcatctctccaccatggttcatggcctgtagccccccacccctctctgcttcctgcagccccactgggggttcctcccaggtgctgagtgaaagcgaagaggaggaggagggggctgtgcggtggggtcggcaggcgctgagcaagcggacactgtgccagcgggactttggggacctggacttgaatttgattgaggaaaactaaaactgagaggctacttcctggggccacacagactgactctctcatggctactaacaagtgtcgagtccccaaggctgggggccgagcctgggaatgggggtgagtggagggctccgactcagggcagctggaaatcttctcgctccagcaagctcgaccatgccaagagactggccgggacaagataaacggagctggtggcgggagggacagccccagagcagacccttcctatggcggccctgagtgtgagtatccctgccaccaagagagcaatgggcagggaaggaaggggtctgccgaccccagctcggggaatttcactagcccctttgcttcaaagggcacttgtgtcttagaatttggccagggtggggggttgagtcagcctcctcagagaaactgcgtgagagtgtgtgcgtgcatgggagtgtacttgtggaaaggtgtgtttgcgtagccttagggaaggaaggcaattgctccttaacagcagagtatcatgatacccccaggatcttgagttttttacaggatgttgggtttgctcaaggagtcaagaggagggcaccaagttttccttttttctaaatagctctggaaccaggcttgtaatccatagcatcaccgactctgcaaaggatttcattttggggtacagcagggtgttttaagtgctgtgacttcagctaatgatcttttcttcagccccaccccctccccactagctcgatctagtatattggggaatgcaggtggggggtgtcaccatattttttctgagctggcctttttttctcatcagattgtccaggctatattccacctgcctcttttgccctcttgagtagagttgcacacagcacatgggcaactgaagcagggttgaggggctctctctctctctcctctgctgatgggacccttttcccctcaccctctgcccttctaagtcatagactaggtaggaaggccctatattggtccccagcatctactgaggcagacctgcaacagaagtggcattcagtccccagcagacatgggtgagctcaccccagcactgctgttgggaaggtgactgcaggaaaccaattcttacaagatccaggcccagcctttttgacctgcttgagagggaagaaggggtgtttagcatttaatagtttgcttgtcttccactcctgccaggaagtgtttatttgcctctaattgggcctgagagaccatagggaggttggggctcactgagggattggctgaggatgtataaagcaaaggctgtgagaagcagttgggagtttggttgtcattggattgaatttacttttttgtttctcacccgcaacttgagccaggacagctggtccaagtggccacagtgatgggtttaagtaccttggtagggctggcaccagtggaaacacatactgaagctgccaccacaatagcttgtgaggttttatccagctgtggttagaccctgcatgaccaaatttgacctgcccttgtttatggcaagaagggcatttttctcttcaatttccagggtttcctaggacccagttcctcatgtaagggaggaagaccaaggtctttgtgttttcttcctcatggaattgaacctgacattttctggatctcctgcatgtcaggagcatcagtgaggcttcagcctcctcgtctccactccagagaggaggtggctatgtcttcttaagcctctggccctcagaggctcctccctatctcctggctagttaccactaggctaccaggtctctaggggcctgagagaggccctctagagaatccagggaaactgtgagcccaggagttgcccatctatggtttcattcctcccctggctcttctccctcttcaggccataatttccctggtgccaatttcttttcctcctggggcatcctcatcccagggctctctgctgtagattggctgtgccagcttccaacaggttactggcaatgccagtgagtttctgtaggccctaagctgaagaagtgaggcagtgattctgcctccatcctggtttccccaaagccccagggcaccatccttaggggagaaggtctacagttatcattattttaattccattactttcagtctggaaaactaagctagtcagaactgtcatcttgcttcccaatctaagaacctgtggccctggaacacttttcaagaattggttcattttgctttacacagtagatctgttccaacagttctgtgtaaaccaaatgctatttttcaatgcatttggactgctgaccatttaaaagcagcctatgattgcttctttttgtaaagcaagcaacctccctccactttagctgttttgactatttgaattttcacatattgggcttacccagagtggagcacacctccagggcatgtggctgacactgggtcaatgtctgcatctgtgctgtgtgtgtagtgtggttggccagtaggtgagtatccctgtgtgtgtgagtgaagccactccccaggctggtgctctcctcctgtgcccagtgactgcccagtggcagctcagctgcccttcactcccacctgctgccaaagtccctgtgctaatgggattacaaatacaaaaagtggaaaaaaattttcgtaaactttgttttatattaaaagaaaaatccataagtctgtgtgtgttaaacatgaggttctgcctctgtggctgtgtttgaaaaaataaagttttattagaataatccattttcccaagc

SEQ ID NO: 3664 - DNA, 1686 bp, Homo sapiens
tcataatcacaatcccattacctcatcctgctgggggggagggggcggagagagaagagagggagtgaacagccctgggctatcctgagctttacaaagtgttctgggtgagggcaaattacagaaccaagtggaaacgtccccgcaaccattataagtcctgggtttttaaggttcaggccgatccggcagctgcaagaggggctcctgggactccgagcaggccctaatccgcgcttggaccacacttcccagcagccttcacgccgcggacgggtcctttgctgggggaagggggattccttcgaagaggtggtcgtggagggcggggcagcagagcagactcagcaggcatgactggagagggaagtcccaatggtgctagaatggtgctgcagtggcagaagacggctcacaagtgaggtctggaagaacaacagggaagacatccatcatttgctccaaagtgtgcaagtcaaatcctggggagaatcatgataaccctgatcactgagcagctacagaagcagactctggatgagctgaaatgcacacgcttcagcatcagtctgcctttgcctgatcatgcagacatctccaactgtgggaactctttccagcttgtgtctgaaggtgcttcctggaggggcctgccccactgttcctgtgctgagttccaggacagcctcaacttcagctaccatccctcaggcctgagcctgcacctcagaccacccagtcggggaaactcccccaaggagcagcccttctcccaagtcctaagacctgagcccccagatccagagaagcttcctgtgccccctgcccctccatccaagaggcactgccgctcactctcagtgcccgtggacctgtctcgctggcagccggtgtggcggcccgccccctccaagctgtggactcccataaagcaccggggcagtggtggagggggtgggccgcaggtgcctcaccagagccccccaaagcgggtctccagcctcaggttcctccaagctcccagtgcctcttctcaatgtgccccagctcacagaccctacagccctcctttcttcagcctggccctggcccaagattcctctcgaccctgcgccgcctcccctcaaagtggctcctgggagagtgatgctgagtccttgtcaccttgcccacctcagcgccgcttctccctgtcacccagtctgggcccgcaggcaagccgcttcttgccctctgcccggagctctcccgcatcctccccagagctgccctggcgacctcgaggtctccgcaaccttccccgaagccgctcacagccttgtgatctggatgcccgcaaaactggggtcaagcggcgccacgaggaagacccccggcgtctgcggccttcgttggactttgacaagatgaatcagaaaccatactcaggaggtctttgtctccaagaaacagcccgggaaggcagcagcatctctccaccatggttcatggcctgtagccccccacccctctctgcttcctgcagccccactgggggttcctcccaggtgctgagtgaaagcgaagaggaggaggagggggctgtgcggtggggtcggcaggcgctgagcaagcggacactgtgccagcgggactttggggacctggacttgaatttgattgaggaaaactaaaactgagaggcta

SEQ ID NO: 3665 - DNA, 1793 bp, Homo sapiens
agcagtcctgtcatgcggaagtagcagtccggtcctagggactagcaggtgggttggttgggcgcaggaggacgggggcgcgcttcccataacattaccctggctgagcgtgaggctccagggctgggcaccgggttgacctcttattcctcgctgagggcatcgttaccgcctgtggctgcaagccgaggcgcgcgggtggaaactgggtcgaggtctgggtagacgtctgagcgatctgcacaaggagtggcgcagtctggaatttgattgaggattcctaacgccctccgcttgatgttctggtgattcccgggggctcggcttcggaggaaggcaccaagaaactgataatgttcctttgaattggcttctgtatttgcttcatcaatgtctctcatactgaatatcttaagagagatgctggaatattttggcgttcctgtagaacaggttttgctgatttgggaaaataaagactatggatcaactaggagtattgttcgtattattgggaaaatgcttccactggaaccttgtcgaagacctaattttgagttgatcccgctcttgaactctgtagactctgataattgtggatctatggttccatcttttgctgatattttgtatgtggcaaatgatgaagaagccagttatctcagatttcgaaatagtatatggaaaaatgaagaagagaaagtggaaatttttcatcctttgcgactagttcgggatccactgtcacctgctgtaagacagaaagaaactgtgaaaaatgacctgcctgtaaatgaagctgcaattagaaaaatagctgcccttgaaaatgagctgacttttcttcgctctcagattgcagcaattgtggaaatgcaggaactgaaaaatagtacaaattctagttcctttggcttgagtgacgagcgcattagtttgggtcagctgtcatcatcgcgggctgcccatctgagtgtggacccagatcagcttccaggttcagtgctttctcctcctcctcctccaccacttcctcctcagttttcatctctccagccaccgtgttttcctcccgtacaaccaggatctaataatatttgtgactcagataatccagcaactgaaatgagcaaacagaacccggctgctaataagaccaattatagtcatcattcaaaaagccagagaaataaagatattccaaacatgttggacgttctaaaggatatgaataaggttaagcttcgtgcaattgagcggtcacctggcggtagacccattcataagaggaaaagacagaattcacattgggatccagtttctttaatatctcatgcacttaaacagaaatttgcatttcaagaagatgattcttttgagaaagagaatagatcttgggaatcttccccattttctagtccagaaacttcaaggtttggacatcacatttcacagtcagaaggacagcgaactaaagaagaaatggtcaacacaaaagctgttgaccaaggtatcagcaacacaagccttctaaactcaaggatttaaactcaacttaaggttgagctttaaacttccaaaacttcttcctggatgataaattattcttagaaactgatttggactgttaaaggctaaaagtagatgtatttaaagactcttcttgacacattttgcctacacttgctatgtaaatatgtatgcctgtcatttttgtttcctttgttcctttttacgtttatactctgttcttctgtacatagagcttaaaataaacattctttttgaacttg

SEQ ID NO: 3666 - DNA, 1524 bp, Homo sapiens
gggatgcggaagtagcagtcctgtcatgcggaagtagcagtccggtcctagggactagcaggcaccaagaaactgataatgttcctttgaattggcttctgtatttgcttcatcaatgtctctcatactgaatatcttaagagagatgctggaatattttggcgttcctgtagaacaggttttgctgatttgggaaaataaagactatggatcaactaggagtattgttcgtattattgggaaaatgcttccactggaaccttgtcgaagacctaattttgagttgatcccgctcttgaactctgtagactctgataattgtggatctatggttccatcttttgctgatattttgtatgtggcaaatgatgaagaagccagttatctcagatttcgaaatagtatatggaaaaatgaagaagagaaagtggaaatttttcatcctttgcgactagttcgggatccactgtcacctgctgtaagacagaaagaaactgtgaaaaatgacctgcctgtaaatgaagctgcaattagaaaaatagctgcccttgaaaatgagctgacttttcttcgctctcagattgcagcaattgtggaaatgcaggaactgaaaaatagtacaaattctagttcctttggcttgagtgacgagcgcattagtttgggtcagctgtcatcatcgcgggctgcccatctgagtgtggacccagatcagcttccaggttcagtgctttctcctcctcctcctccaccacttcctcctcagttttcatctctccagccaccgtgttttcctcccgtacaaccaggatctaataatatttgtgactcagataatccagcaactgaaatgagcaaacagaacccggctgctaataagaccaattatagtcatcattcaaaaagccagagaaataaagatattccaaacatgttggacgttctaaaggatatgaataaggttaagcttcgtgcaattgagcggtcacctggcggtagacccattcataagaggaaaagacagaattcacattgggatccagtttctttaatatctcatgcacttaaacagaaatttgcatttcaagaagatgattcttttgagaaagagaatagatcttgggaatcttccccattttctagtccagaaacttcaaggtttggacatcacatttcacagtcagaaggacagcgaactaaagaagaaatggtcaacacaaaagctgttgaccaaggtatcagcaacacaagccttctaaactcaaggatttaaactcaacttaaggttgagctttaaacttccaaaacttcttcctggatgataaattattcttagaaactgatttggactgttaaaggctaaaagtagatgtatttaaagactcttcttgacacattttgcctacacttgctatgtaaatatgtatgcctgtcatttttgtttcctttgttcctttttacgtttatactctgttcttctgtacatagagcttaaaataaacattctttttgaacttgcttgtg

SEQ ID NO: 3667 - DNA, 2053 bp, Homo sapiens
cagttatctagttcctctcgcgaggactccgagggacaggcagggtgctgcggagcgcacaggaaaggacctgaccctgtcgcagggaaggaaggtgatgcttaagctgagctctgaggaatgatgaagaatgagctcggcgaagggggtgctggtgtttgatgcagggctcagagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactcagcagcttccttgcagcagagcagggctgaggggaaggggctatgaatgtttgtatacatgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 3668 - DNA, 2099 bp, Homo sapiens
gagtccccgaagggtagttgctcgtcggagttccccagcaaacagtgaccaagccagacctcaggcttctagtttcggcttcgctgcttgacgggccgggctgccccgccgcgcattctgagacctggccgcggctcggaggcttccgcgcactcgggtccgggtcctgtgggtccaagggccgctgggcaggcggcgagcacttggccgaccttggcccagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactcagcagcttccttgcagcagagcagggctgaggggaaggggctatgaatgtttgtatacatgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 3669 - DNA, 2004 bp, Homo sapiens
gtgcgcagctgcggaggatcgcttccggggggcgggtcagcggaagtgagggcggttgaggctgggcggcccaaggtggaaggaggggccgtgaggtgagagagtccgggagcccgagcttgagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactcagcagcttccttgcagcagagcagggctgaggggaaggggctatgaatgtttgtatacatgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaatgc

SEQ ID NO: 3670 - DNA, 1868 bp, Homo sapiens
gagagagtccgggagcccgagcttgagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactcagcagcttccttgcagcagagcagggctgaggggaaggggctatgaatgtttgtatacatgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 3671 - DNA, 756 bp, Homo sapiens
tggaagagctgtggggcataaaccacactgcagagctgaactggccttttggaccttttatcagtcattggcttgggaggtgaaggaaattcccaggtagggagctccgttcttcctgcaaggggatctgagtgggacaccaaatcagcatctacacccaggacagacagccagcgtggacttgcatgatccgccatcgcacaggagggaaagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcgg

SEQ ID NO: 3672 - DNA, 3262 bp, Homo sapiens
gtgaatgacacctcgtctcccaagggtagaagaggggaccctccacaggaggtctccagaaagagctgctttgtcagtctagtctatctcccattcagagcctgtccagggctccccagtgacccggacctcatgacttgccccctacttttgtagctttatcatgctctgctcctctttccatgtccttcaccttcttgtgctggacctgtgctcttgctgttttgtcttcatttcctactccctcgcaacttactacagggcactagggccagagctctgacctcatctggccacctgcctaatgctactcagcctttgctagaagtatgtattcatgtcctatcactctgctggacagcgagttccttgagagcatgactgtgtcttactccttccatagcccctacggtgcccagcacaaggcctggcacaagtgggtactgttggtgtttgatgaacaagtgaatgaacgagcacactgattgcatctgctcaccatgcaaggactgctgtgaagagcagtcagatgtcacctcacccatctgtgtcatgttttaacagttcattaagcactcaaccccatttcactcattgacccttaaggtagcctccagtggcagcttttcctgtctcctttttccagatggaaaaaccaacattcagaaaagttaaataacttgcctgtagctacaaagccagaaggtggctgagccaggataaacttttttggctctttttctctgtagctcatgagactgagattggcatgagctggtgttcgttctcctattttctctgatctctccctttgcaagggcccagcagtgcttttacatctcatcttcaagaatgaatcctgggcttggatagtacttataatttggctagatgagctttgtagctaccaaggattctatttgcatctttagaagttttgcctcaagaaacctgagagcccaggaaggctcttgggttggccaagctcactaggcaaatcttttttttttttttttttttttgagacggagtctcgctctgtcacccaggttggagtgcagtggcgtgatctcggctcactgcaagctctgcctcctgggttcacgccattctcctgcctcagcctcccaagtagctggtactacaggtgcccgccaccacacctggctaattttttgtatttttagtagagacagggcttcactgtgttagccaggatggtctcgctctcctgacctcgtgatccgcccacctcggcctcccaaagtgctgggattacagatgtgagccactgcgcctggccgcagatctttaacagaacctttaagagtctggacttagagctaagtgttgggtgagggcagcctcttgggctggttttctcccctgtgaagtcatggctctgcagggcctggttttttggggcttgtgtggtgaccattaaatccccactgtggggggttgtttcacaagagggaaatctggtgctcctccagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactcagcagcttccttgcagcagagcagggctgaggggaaggggctatgaatgtttgtatacatgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagag

SEQ ID NO: 3673 - DNA, 1869 bp, Homo sapiens
tccggggggcgggtcagcggaagtgagggcggttgaggctgggcggcccaaggtggaaggaggggccgtgaggtgagagagtccgggagcccgagcttgagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactcagcagcttccttgcagcagagcagggctgaggggaaggggctatgaatgtttgtatacatgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 3674 - DNA, 575 bp, Homo sapiens
gagtccccgaagggtagttgctcgtcggagttccccagcaaacagtgaccaagccagacctcaggcttctagtttcggcttcgctgcttgacgggccgggctgccccgccgcgcattctgagacctggccgcggctcggaggcttccgcgcactcggatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccga

SEQ ID NO: 3675 - DNA, 815 bp, Homo sapiens
gactcgccctggcgggtccccgcggggagagggtccgcgcgggtctccggccactgctgcgcgcggcaaagtttcactgagcgcggcggcctccgtgggggcccccgggaccaggggtgctgagcagggccctgcgctggaggagctcccgttctcctgaggggacgcctgtcagcagacagcaactgcagcctccggagggctgcggggcgcagagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctccctt

SEQ ID NO: 3676 - DNA, 555 bp, Homo sapiens
tccggggggcgggtcagcggaagtgagggcggttgaggctgggcggcccaaggtggaaggaggggccgtgaggtgagagagtccgggagcccgagcttgagagggaaatctggtgctcctccagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctg

SEQ ID NO: 3677 - DNA, 5138 bp, Homo sapiens
aagcgattcccctgcctcagcctcccaagtagctgggactacaggtgtgtgccaccacacccagagagttttttgtatttttagtagagatggggtttcaccatgttggccaggctggtctcaaactgctgacctcaagtgatctgcccactttggcctcccaaagtgctgggttacaagcgtgagccaccgtgcctggcctgccatctccatttctgaccaggctggtggcctgagtacatcatcctgagtcccttccttccccacctcccccttcttctgtcacccaagcctgctgggtctcccttcccagtatctcttggtctgtttctgctattccctagctcttctccagaaccccttactggtttgtttacctgactggtctcccggttattttaatagagctgaacctggatcatggtatttctttgctcgaaacactccagtgggtctcatgttgtacagaataaagctttactgctttagcaaggcattcagagcctttcaaatcccagttgctgtctgcatcccctcctgtcctccctctccctaagtccttccctgcaggcacgcaccatctggggcaggtggtctgcttttgtgtctctgtgtctgtgtttacagtgtttcttccacagggaatgcccattctgtgaattccctttgattcttaaggtgcagctcagtgatcctctcagattccgccaggcaggttttgcctacctagccgtcttgtaactcttttgtcacaagtctgttgtagcacttatcacatcctgccaccattgggtactcatcgtctcacccattatatctggatttctttaagggcagactgtattttacacagatttgtaccctctgtgtggcctaccatagtgtctgacacatagtgagtgctccatcaatatctgtgcaataattaaatgaatgaactgtgacagaagcaactaccacaggggcttcagaagctaaagaaggcccagcgcggtggctcacacctgtaatcccagcactttgggaggccatagcaggaggattgctcgagcccaggagtttgagaccagcctgggcaacatcatgagacgtcatctctaataaaaataaaaaattagccaggcatggtggcacatgcctgtggtcccaggtacttgagaggctgaggcaggaggatcccttgagcccagaaggttgaagctgcagtgagttgtgatcatgccactgtactccagcctgggcgacagcaagaccctgtctcaaaaaaaacacccagaggctaaagagtcaccttgtcttctctcgacttgttccctcacctattcatggctctcttcctactgtataaagcttgagaagaggccatccatcagatgccagggcggctcagagcttgttttgtgctcatgtgggtatgcatataacaggtgtctggccagtgaggtgagagagcttacacagggatgtcagcttcacagactggcaatcacttccgtaaagtctgtgtctcctaggggcatgtgctgagcttggcaaagcacgcagccccagactgcaggttgggaaggcctactctcagggaggtggctttgctgggttcaggtcagagcctctgggagagtaggattggatattggaccagggcagggtgtgggaacagagctggggtcagagtggttctcccagggccttcaagggctgggccaggccctggttggcccagtgccacctccatgcggatcagcagcccagggcgatgcacaggatgccagatccagggaagttcaagctcctggaacaggcccgggatgtgcgggagccagtgaggtacttcagcagcgtggaggaggtggccagtgtcttccctgaccgcatcttcgtgatggaagccatcaccttcagcgtcaaggtggtgtcgggcgagttcagcgaggacagcgaggtgtacaacttcacgctgcatgcgggcgacgagctcactcttatgggccaggcggagatcctgtgcgccaagaccaccaaggagcgctcgcgcttcaccaccctcctgcgaaagctgggccgggccggggcgctggccggggtgggcggcggcggcccagcgagcgcgggggccgcgggaggcactggcggcgggggcgccaggccggtcaaaggcaagatgccctgcctcatctgcatgaaccaccgcaccaacgaaagcctgagcctgccctttcagtgccagggccgcttcagcactcgcagcccgctggagctgcagatgcaagagggcgagcacacggtgcgcgccatcatcgagcgcgtgaggctgccggtgaacgtgctggtgcccagccggccgccgcgcaacccctacgacctgcacccggtgcgggagggtcattgctacaagctggttagcatcatctccaagacggtggtgctggggctggcgctgcgccgcgagggcccggcgccgctgcacttcctgctgctcacggacacgccgcgcttcgcgctgccgcagggcctgctggccggggacccgcgcgtcgagcgcctggtgcgcgacagcgcctcctactgccgcgagcgcttcgaccccgacgagtactccacggccgtgcgcgaggcgccagcggagctcgccgaagactgcgccagcccgcgccgcgcgcgcctctgcctgcccgcgccgcgcgcccccgggctcgcccgcgcccccggcccgctagcgccggctcccgccggcgagggcgaccaggagtacgtgagccccgactgggcagccgcgcccgagcccgccgcgccgcccgccgagatcccctacgaggagttgtgggcgcaccaggggcccgagggcctcgtccggccgcccccagggctcgatctcatctccttcggggccgcgggaccgccgcgtcgggagccggaagcgccgccgcctccagtccctcccaaatccgaggcggtgaaggaggagtgccgcctgctcaatgcccctccagtgcctccccggggtggcaatggcagcggccggctctccagcagccccccggttccccctcgcttccccaagctgcagccggtacattcccccagctccagcctctcctactactcctctggcctccaggatggggcgggttcccgcagtggcagtggctccccatcgccggacacctactccctctattgctacccatgcacctggggagactgcaaggaaccagtcctggagcccttcgatccctttgagctggggcagggcagttctccagagcctgagctgctgcgttctcaggagcccagagcagtggggacacctgggcctggaccccgcctttcaccacttggcccctccaaggcctttgagcctgaaggtttggtgctgcaccaggtccccaccccactgtcaccagctgctctgcagggacccgaggcgggaggagcactttttctaacccaagggcgcctggaagggcctcctgccagtccccgggatggagccacaggctttggagtccgagatgcctcctcctggcagccccctgctgacctgtctgcactctccctggaggaggtctctcgcagtctgcgtttcatcgggctctcagaggatgtggtgagcttctttgcccgagaacgcatcgatggtagcatctttgtgcagctcagtgaggacatcctggcagatgacttccacctcaccaagctgcaggtcaagaagatcatgcagttcatcaaaggctggaggcccaagatctgaactgcccagctggagctgcacagctggaatgctggtatgggggccccaggtacagcactccggaggagcaggtgctgcctgcaagaaggatctatgtcgagactgaggctgctcagcagccactgggtggatccaggggagatgcatgtggaaatgtggtcctctggggtcagacccctgcacgggacatcttgcctttgagtgtgcagagtacatggggaaggggctgggggcaccactgtgtacctgggcccagtaaggcatttgccgtgattcccacaacggggtcaaaagctggccttcagggtgacctaacaccacctcatgccctgctatagaccttcacaaacgacttccactgctgaagcctgtaggctctgtttagagacaagaagatggctggtaatttaagcaccgatttcccaagtgcccactctcctttgtgctctgttggcttttggcctaaagctgccccagagtgagggtgtagatgtctgtgtctgtgagatgcctttcccttccccctctgctccaccgtggttgaggggggtggggcctggccccgcacacaggtgagtcgtgtacaagcctaacccatggcacctcagaggctccacctgtgggtcctggttcatgggtgacaactttggaagagcacagctctgcaattgacccgacccacttatctagttaggaagccagacactgcccagatgactctagcaccctggcttctgctctgactttactgcagctagtcatccatccgtcaggtggcgttcagtctcagaatactgattccgtggaagagcaggttgatttaggtcagcttctccttgattctagaagcaagcggtagtcaaccacctccaattccgccaatctcttgcccccatcatttgtctctgacaatacttggtgtttttccctggttttctgtcactggcacaggagggtacagttgggagagtgcgttcctggagctcagtcctgcatttgttcacgtgcctcacagcaggcctttgtgcccttgaatctcaaacatggggatctgcttggtacccagagctctggtcattgtgtccaaccacacaccccaccccatccgtgtcctccatctcacccagaaccacagggtgcccactagtgtcagggcccaaagtgccagccttctcttctgccttacctagtctacctatttatttcctccactttttatcttaaaagtagctaagccatgctggtgcccatactccaagcaggctgcctcagctcagagaagtggtcagagagtagagcacagaacctgtgatgtggggacatttggttttcttgcagatcatttaatgaatcctcaaggactaatgaaataaatgctagactgctg

SEQ ID NO: 3678 - DNA, 3006 bp, Homo sapiens
gaagatggacccggcgccctcgctgggctgcagcctcaaggatgtgaagtggagctcggtggccgtgccgctcgacctcctggtcagcacttaccggctgccccagatcgcgcgcctggacaacggagagtgcgtagaagggctgcgggaaaatgactatctgctgattcattcctgccgccagtggaccaccatcactgcccacagcttggaggagggtcactatgtcattgggccaaagatagagattccggtacattatgcagggcaattcaagctgctggaacaagaccgagatataaaggagccagtgcaatatttcaacagtgtggaggaggtggctaaggcatttcctgaacgcgtgtacgtcatggaggatatcacattcaacgtgaaggttgcttcaggtgaatgcaatgaagacactgaagtttacaacatcaccctgtgtactggggatgaactcactctaatggggcaggcagaaatcctttatgcaaagacattcaaggaaaagtcacgactcaacacaatcttcaaaaagattgggaagctcaattccatcagcaagctgggaaaaggcaaaatgccgtgcctcatttgtatgaatcaccggaccaacgaaagcattagccttccattccagtgcaagggcagatttagcacccgaagtcccctggaacttcagatgcaagagggcgaacacaccatccgcaacattgtggagaaaaccaggcttcctgtgaatgtgactgtgccaagccctccaccgagaaacccatacgacctccacttcatccgtgaggggcaccgctataagtttgtgaacatccagaccaagacggtggtggtttgctgtgtgctgcggaacaacaagatcctccccatgcactttcctttgcacttgactgtccccaagttcagcctcccagaacacctggtgaagggagagagctggcccgaaaccctggtccatcactggctaggtatctgccaagaacagttcgacatcgatgagtattcacgggctgtccgtgatgtgaaaaccgactggaatgaagaatgcaagagccccaagaagggtcggtgctctggccacaaccacgtgcccaattcgctcagctacgcccgcgatgagctcacccagtccttccaccgactctcggtctgtgtgtatggcaacaatctccatggcaacagtgaggtgaaccttcatggttgcagggacctggggggagattgggctccctttcctcatgacatcctgccctatcaggactctggagatagtgggagcgactaccttttcccagaagctagtgaagaatcagcaggcatcccgggaaagtcagaacttccctacgaagagctgtggctggaggaaggcaagcccagccatcagcctctcactcgctctctgagcgagaagaacagatgtgatcagtttagaggttctgtccgatccaaatgtgcgacttctcctcttcccatccctgggactctgggagcagcagtgaagtcttcagatactgccctacctccacctccagtgcctcccaaatctgaagccgtcagagaagaatgccggctcctgaacgccccacctgttccaccccgaagcgcaaagcctttgtccaccagtccctccatccctcctcgcacagtcaagccagcgcggcaacagactcgctctcccagccccaccttgtcctactattcttcagggctacacaacatcagcgtcactaaaactgacacaaatccttctgaaagcactcctgtttcctgctatccatgtaaccgagtgaaaactgattctgtggacctgaaatccccgtttggaagtccttctgctgaagctgtgtcctctcggctctcatggcctaaccattattcaggagcatcagaaagccagaccaggagtgacttcctgctggatccaagcaggagttatagttaccctagacaaaagacgccaggcacaccaaagagaaactgcccagcaccttttgattttgatggctgtgagctcctggccagccccactagcccagtcactgcagaattcagtagcagcgtctctggttgtcccaagtcagccagctactctctggagagcacagatgtgaaatctcttgcagctggtgtgacaaagcagagtacgtcatgccctgccttaccccccagggctccaaaactagtggaagagaaggtcgcctccgaaacatctcctttgcctctgaaaattgatggtgctgaggaagaccccaagtctgggtcaccagatctctcggaggaccagtattttgttaaaaagggcatgcaggacatcttctctgcctcctaccctttctcatctccgctccatctccagctggcccccagatcctgtggcgacggttccccatggcagccacctgctgacctatcaggactctctatagaggaagtgtccaagtcactacggttcattggtttgtccgaagatgtcatatcattctttgttactgaaaagattgatgggaacctgcttgttcagctaacggaagaaatcctctcagaggatttcaaattgagcaaattgcaggtgaagaagataatgcaattcattaatggctggaggcccaaaatatagccaaataacccccggccagcatggaacaaaactgatcaatgcgtgtgctagaaggggtgggctgggacacaatttcatgtttttgcactaaaaaccttctctgtaaatagggataagagaaactcttactatgcagattacgtttttgaatggtgaacaggctattttgtacatcaataaaaatgctgtacagaacacttggaggtgtgccttgtacgtcactcaacaaacactcagcagctgctaaaagaaaaaaaggcatgtgcagagaaatcattcttacccaagtaggtttatgtgagaaggtatgatatttattacaaaatagccaaagctggaagacataaaaatctttaaaaaaaaaaaaaaaa

SEQ ID NO: 3679 - DNA, 7012 bp, Homo sapiens
gcgggtggtgccggtggcggcggcgggggagcgcgggacaggaggcttcggggaagatggacccggcgccctcgctgggctgcagcctcaaggatgtgaagtggagctcggtggccgtgccgctcgacctcctggtcagcacttaccggctgccccagatcgcgcgcctggacaacggagagtgcgtagaagggctgcgggaaaatgactatctgctgattcattcctgccgccagtggaccaccatcactgcccacagcttggaggagggtcactatgtcattgggccaaagatagagattccggtacattatgcagggcaattcaagctgctggaacaagaccgagatataaaggagccagtgcaatatttcaacagtgtggaggaggtggctaaggcatttcctgaacgcgtgtacgtcatggaggatatcacattcaacgtgaaggttgcttcaggtgaatgcaatgaagacactgaagtttacaacatcaccctgtgtactggggatgaactcactctaatggggcaggcagaaatcctttatgcaaagacattcaaggaaaagtcacgactcaacacaatcttcaaaaagattgggaagctcaattccatcagcaagctgggaaaaggcaaaatgccgtgcctcatttgtatgaatcaccggaccaacgaaagcattagccttccattccagtgcaagggcagatttagcacccgaagtcccctggaacttcagatgcaagagggcgaacacaccatccgcaacattgtggagaaaaccaggcttcctgtgaatgtgactgtgccaagccctccaccgagaaacccatacgacctccacttcatccgtgaggggcaccgctataagtttgtgaacatccagaccaagacggtggtggtttgctgtgtgctgcggaacaacaagatcctccccatgcactttcctttgcacttgactgtccccaagttcagcctcccagaacacctggtgaagggagagagctggcccgaaaccctggtccatcactggctaggtatctgccaagaacagttcgacatcgatgagtattcacgggctgtccgtgatgtgaaaaccgactggaatgaagaatgcaagagccccaagaagggtcggtgctctggccacaaccacgtgcccaattcgctcagctacgcccgcgatgagctcacccagtccttccaccgactctcggtctgtgtgtatggcaacaatctccatggcaacagtgaggtgaaccttcatggttgcagggacctggggggagattgggctccctttcctcatgacatcctgccctatcaggactctggagatagtgggagcgactaccttttcccagaagctagtgaagaatcagcaggcatcccgggaaagtcagaacttccctacgaagagctgtggctggaggaaggcaagcccagccatcagcctctcactcgctctctgagcgagaagaacagatgtgatcagtttagaggttctgtccgatccaaatgtgcgacttctcctcttcccatccctgggactctgggagcagcagtgaagtcttcagatactgccctacctccacctccagtgcctcccaaatctgaagccgtcagagaagaatgccggctcctgaacgccccacctgttccaccccgaagcgcaaagcctttgtccaccagtccctccatccctcctcgcacagtcaagccagcgcggcaacagactcgctctcccagccccaccttgtcctactattcttcagggctacacaacatcgtcactaaaactgacacaaatccttctgaaagcactcctgtttcctgctatccatgtaaccgagtgaaaactgattctgtggacctgaaatccccgtttggaagtccttctgctgaagctgtgtcctctcggctctcatggcctaaccattattcaggagcatcagaaagccagaccaggagtgacttcctgctggatccaagcaggagttatagttaccctagacaaaagacgccaggcacaccaaagagaaactgcccagcaccttttgattttgatggctgtgagctcctggccagccccactagcccagtcactgcagaattcagtagcagcgtctctggttgtcccaagtcagccagctactctctggagagcacagatgtgaaatctcttgcagctggtgtgacaaagcagagtacgtcatgccctgccttaccccccagggctccaaaactagtggaagagaaggtcgcctccgaaacatctcctttgcctctgaaaattgatggtgctgaggaagaccccaagtctgggtcaccagatctctcggaggaccagtattttgttaaaaagggcatgcaggacatcttctctgcctcctaccctttctcatctccgctccatctccagctggcccccagatcctgtggcgacggttccccatggcagccacctgctgacctatcaggactctctatagaggaagtgtccaagtcactacggttcattggtttgtccgaagatgtcatatcattctttgttactgaaaagattgatgggaacctgcttgttcagctaacggaagaaatcctctcagaggatttcaaattgagcaaattgcaggtgaagaagataatgcaattcattaatggctggaggcccaaaatatagccaaataacccccggccagcatggaacaaaactgatcaatgcgtgtgctagaaggggtgggctgggacacaatttcatgtttttgcactaaaaaccttctctgtaaatagggataagagaaactcttactatgcagattacgtttttgaatggtgaacaggctattttgtacatcaataaaaatgctgtacagaacacttggaggtgtgccttgtacgtcactcaacaaacactcagcagctgctaaaagaaaaaaaggcatgtgcagagaaatcattcttacccaagtaggtttatgtgagaaggtatgatatttattacaaaatagccaaagctggaagacataaaaatctttaaaaaaaaaaaaaaaacacttttgaacaagtcccttctttcaggagggttgactttagacaattaactgtgttctgtgctctgtcattcagattgcttcttgctaattgttttactcttgtgcctgaaaatgttagtgatacgaattgacactttaatgttgtatgcttggtggggatctttttatcacaaggcattttccaagagtcatatgttgataaagggatatatgttgtccttagaaatcacacaaatcatgaccacaataatttatctgtaactgctgctaattttattgagcagagaaaaaagaatatacatatataaacatgtataggtgcatacacaatacacccggatatgttttacacataattttgattctgatattttagataacatctgttcacttttaaacaatctgttgaggttttgggactgttatctacattgattctcttaggaatagtggacagaatgactccaaagattctcagaaccctgtctcttgaagctcaatcttatttgggttcatcactgaaaacttagaacaaatcagtaaagaatcctgtattgaagaattaagtttgagtttaagcccactcaccgcagggctggtttttgcatgtaatactcccatgatgtctggggaaatgacagtttctgttgaattataattctccggtttaagggtctccttcccctggtgtctgatggtgagaggtctgaagagcatttgtcagagtacattaggcattctcaacctacttcatgctttacgagagctgagaaatcagacgcaccggcctttattattatatatgctacatctgttgagtatttttaaaataccaataagaggacttgtttatttcataaaccacttcttccctctctttcaaagaaaatacattattaccatacttttacattagtctgagaatttttgctaaatatgattaagtattccaaaatataatggcgtcattattcttgacttttttagagaatatacatcttaagactgtattagttctcagagcaaggcatcatctactcccctgcacctgagagtctggccccagattccagatgtgcggacagcccatgaccgaggtgcacacagtgccctcttgaataggaaggtcagccagtgaggcggcagcataacttgcaggatggacttatatcttaccatctcttcctgctaccaaaataaaaaaataaattgaaagacaagacccaccagtctagttttgtagacctgtgaaatgtgtctttatttcttggcattagaagaaagatatttttaatccatatcgtggttttagagttgaagtgaattgatacccaattttccatcttagatctcctttatcaaaaaaaaaagcattttttttctcctaacgtgtctcccaaaatgtaaatactataggcaaaaagagtaccctgtaaaattctcacactggagcacctcttcaaaagtcacagataactcaatgaggaagtgctggtactgcactcacaggacatgagacctatgaagctttcgtgttttgaaagcatccttctgtgtgagggggactgcctcccttagtaaagtaaacctctcagaacttctttttaaaataaaaacagacaagatgcagttactaagctgcaagttttcattggcaaacctagctgaatccgttttaaaatacttagcactcggacacaattctcaaactcaggaagaaggaacagggttggtttgggtttactataaaggttgcctcacataaacaactgactccttttagcgttttttttctttttgtaaaaactttacacaaaatagggttttaaattctttttgcttgttttggacttggtgtatttttgtcaagtttatattgattggcaacgcagagactccttgagggcagggactgtggcctttgattcacttatgctacagtctagtatcactacagtgctgagtaaaagacacagcccctgccctcttggagatcatattgtttatatttgaaatctcagttgctaagagtatgtatgtgtgagtaagaaagacgtgaagtcctatgggcagctgggtatatggagaattacgtgtgtcctgtctttaaaacgtcagcctctattaaggggtacagaacaccccaagatcactaaaacttggaatgtgttggaggcagaaagtatctctctcattgcctagtgttgttgtttttttgttttttgttttttgttttttttactgacctggaattcttttaattgtaataaatatcttctgtcacaaataaatgccacaaataaatgaaattgccattcctaagctgagcacctgtctgtgaaggaccttggtgtcctgactggacagagcattcatagctccaagagaatcatgacaagatatgcaaagcagggataataaggagaaagcccttccctttcgagaagcccttccctttcacagcccttccctgcgattctgcagtgaaaagtgatgcccagagatccacacacagaacccttctaaccagccaggtcaagacttatcatcttatctcctctggcaggtcccctgtaatcaaaagagaggaagtgtctatctaaacaagacccttttgggtccttagattcatggcaaaaatcatcatggcccccatcagaaaagaaaatcagcaataaaccaagccaagcaactaaaatgtataatgtggacctgactcatgttgggaggcagaattcagacactcacagatcaatcttgcaagttttctcttctttaagttgagctgctcaactttatgaactgtgaaatttacttacattctttcaacccacatatatcattgcagtttatgaagttgcagtgaactgcccattcagctaaattgcagtgtttattcttgtctcatgtcgaaatacaacaatcttatgggaaatattatgacagtccgttccaactgttctcagacacatgcataaacagtctctgctcacattccacagccacctgcatgttatccatacagctccctgagaagtccagggatgggaggtggggtgtggaaggatggagggtccttcattttctaaacactttgtataagtcactactcatcgtgcctagcaagtataagattaacattttgaataacaaactggaaaacaaataatccttcaaagaacctagcgaactgttcaaaggaaattttaatttcagtctaccagaaaagttaaatctgttgttggacgtagggggctttcagaaacatgcctcttatatcaatttccactatctttcaagttacctaaaggcaccaggctgcttgagcaagaagaataaaaggcctagagtgcaaattatgtgaagtagagtttttagattgtgggattgtaataatacgggattctcatggttacatcatgttaaatcacactgttcagtctttaaaacttggtgttttaaaatttgtctcattgtgatagccagaaacaaggaataaacgtgatttcagtttaaactatatacaaatatcttctgtaattttgctgctctaatttttaggctataaattttgtaatagagcttatcagatcgcaaatttcctttgtttacaatctcatgtagtagggctcagataatttcttagctataaaccttttctcccactctcatattgtttcatttaaaatatttaagctaagcctaaaaattgaaatcagttaagaatttggagagtttatcttaaatggaaatggtgtattcttttcaaagaattttgtaaccatctttacagtttctttgcttggaaaacttgggttgttaactaccagttaacaatggcattactttccaaaacgttatctaatgggcccaatgtgtacctcaagataaacacagtatgttatgtctaaaaatttccttgtctgttgatttaaatggttctgaaatgtctgta

SEQ ID NO: 3680 - DNA, 4142 bp, Homo sapiens
cgcggcccggcggggctgccaggcggcgagcgccgcggcggccccgggaggtggcggcgggcgcgagagcctgggccgcgcgggactgaccgtcggggccccgggacggcggccccggggcgcccatgccatggagaagctggcggccgggctggccggcctgcgctggagcatgggcgccttcccgctcgacctcatcgtcagccgctgccgcctgcccacgctcgcctgccttgggccaggggagtacgccgagggcgtcagtgagcgagacatcctgctcatccactcctgccggcagtggacaacggtgacagctcataccctggaggagggccactatgtcatcgggcccaagatcgacatccccctgcagtacccagggaagttcaagctcctggaacaggcccgggatgtgcgggagccagtgaggtacttcagcagcgtggaggaggtggccagtgtcttccctgaccgcatcttcgtgatggaagccatcaccttcagcgtcaaggtggtgtcgggcgagttcagcgaggacagcgaggtgtacaacttcacgctgcatgcgggcgacgagctcactcttatgggccaggcggagatcctgtgcgccaagaccaccaaggagcgctcgcgcttcaccaccctcctgcgaaagctgggccgggccggggcgctggccggggtgggcggcggcggcccagcgagcgcgggggccgcgggaggcactggcggcgggggcgccaggccggtcaaaggcaagatgccctgcctcatctgcatgaaccaccgcaccaacgaaagcctgagcctgccctttcagtgccagggccgcttcagcactcgcagcccgctggagctgcagatgcaagagggcgagcacacggtgcgcgccatcatcgagcgcgtgaggctgccggtgaacgtgctggtgcccagccggccgccgcgcaacccctacgacctgcacccggtgcgggagggtcattgctacaagctggttagcatcatctccaagacggtggtgctggggctggcgctgcgccgcgagggcccggcgccgctgcacttcctgctgctcacggacacgccgcgcttcgcgctgccgcagggcctgctggccggggacccgcgcgtcgagcgcctggtgcgcgacagcgcctcctactgccgcgagcgcttcgaccccgacgagtactccacggccgtgcgcgaggcgccagcggagctcgccgaagactgcgccagcccgcgccgcgcgcgcctctgcctgcccgcgccgcgcgcccccgggctcgcccgcgcccccggcccgctagcgccggctcccgccggcgagggcgaccaggagtacgtgagccccgactgggcagccgcgcccgagcccgccgcgccgcccgccgagatcccctacgaggagttgtgggcgcaccaggggcccgagggcctcgtccggccgcccccagggctcgatctcatctccttcggggccgcgggaccgccgcgtcgggagccggaagcgccgccgcctccagtccctcccaaatccgaggcggtgaaggaggagtgccgcctgctcaatgcccctccagtgcctccccggggtggcaatggcagcggccggctctccagcagccccccggttccccctcgcttccccaagctgcagccggtacattcccccagctccagcctctcctactactcctctggcctccaggatggggcgggttcccgcagtggcagtggctccccatcgccggacacctactccctctattgctacccatgcacctggggagactgcaaggtgggcgagtcctctagccgcccagcccccggtcccctaccctcaaccacacagcccagccaggcctcccgggccctcacagagcctctgagcggtcgagccgcctcccttctgggggctgacacccctgttaagacctaccacagctgccctcctctattcaagccctcacatccccagaagcgctttgctccgtttggagctctcaaccctttttccgggcctgcctacccctcaggcccttcagcggccttgtcttctgggcccagaaccacctcgggtcctgtggctacctctggccctgcgtattccccaggcccagcctcgccaggccaggcctattcagctgctcccccctcctcctgcgccccctcctcctcctcttcttctgaatggcaggaaccagtcctggagcccttcgatccctttgagctggggcagggcagttctccagagcctgagctgctgcgttctcaggagcccagagcagtggggacacctgggcctggaccccgcctttcaccacttggcccctccaaggcctttgagcctgaaggtttggtgctgcaccaggtccccaccccactgtcaccagctgctctgcagggacccgaggcgggaggagcactttttctaacccaagggcgcctggaagggcctcctgccagtccccgggatggagccacaggctttggagtccgagatgcctcctcctggcagccccctgctgacctgtctgcactctccctggaggaggtctctcgcagtctgcgtttcatcgggctctcagaggatgtggtgagcttctttgcccgagaacgcatcgatggtagcatctttgtgcagctcagtgaggacatcctggcagatgacttccacctcaccaagctgcaggtcaagaagatcatgcagttcatcaaaggctggaggcccaagatctgaactgcccagctggagctgcacagctggaatgctggtatgggggccccaggtacagcactccggaggagcaggtgctgcctgcaagaaggatctatgtcgagactgaggctgctcagcagccactgggtggatccaggggagatgcatgtggaaatgtggtcctctggggtcagacccctgcacgggacatcttgcctttgagtgtgcagagtacatggggaaggggctgggggcaccactgtgtacctgggcccagtaaggcatttgccgtgattcccacaacggggtcaaaagctggccttcagggtgacctaacaccacctcatgccctgctatagaccttcacaaacgacttccactgctgaagcctgtaggctctgtttagagacaagaagatggctggtaatttaagcaccgatttcccaagtgcccactctcctttgtgctctgttggcttttggcctaaagctgccccagagtgagggtgtagatgtctgtgtctgtgagatgcctttcccttccccctctgctccaccgtggttgaggggggtggggcctggccccgcacacaggtgagtcgtgtacaagcctaacccatggcacctcagaggctccacctgtgggtcctggttcatgggtgacaactttggaagagcacagctctgcaattgacccgacccacttatctagttaggaagccagacactgcccagatgactctagcaccctggcttctgctctgactttactgcagctagtcatccatccgtcaggtggcgttcagtctcagaatactgattccgtggaagagcaggttgatttaggtcagcttctccttgattctagaagcaagcggtagtcaaccacctccaattccgccaatctcttgcccccatcatttgtctctgacaatacttggtgtttttccctggttttctgtcactggcacaggagggtacagttgggagagtgcgttcctggagctcagtcctgcatttgttcacgtgcctcacagcaggcctttgtgcccttgaatctcaaacatggggatctgcttggtacccagagctctggtcattgtgtccaaccacacaccccaccccatccgtgtcctccatctcacccagaaccacagggtgcccactagtgtcagggcccaaagtgccagccttctcttctgccttacctagtctacctatttatttcctccactttttatcttaaaagtagctaagccatgctggtgcccatactccaagcaggctgcctcagctcagagaagtggtcagagagtagagcacagaacctgtgatgtggggacatttggttttcttgcagatcatttaatgaatcctcaaggactaatgaaataaatgctagactgctg

SEQ ID NO: 3681 - DNA, 3163 bp, Homo sapiens
ctctggccgccgcgtttcccgcgccgcggagcttctccccttaaaaggacaatagaggcctcgggagcgcgcgcggtcgccgggacttctccccctcccagcccgcaacgtgcgcgcgcccgtatgcaaataagttcgattcaagagaattttgtgccgggagccgcgcgtgcgcagagggaaagcggaatctacaccttcccggccagcggtagcaactgcagaactgcaggagactatctttctagacaaggcagttgaggaggagggagcgcttgagggggactggcctggcgtgcactccgcacctcggggacattattgcgcgtggaacggctgcttttggaagactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctttctgttttgagaagcagtggttggggcatttttaagatggctggctactcttgttttccctcatgataataaatttgtcataactcagtaacatgaacttgcccctagaggtagttgttaataattttgaaatattaaggtcttgccaagcttctgatgattcacacctgtactactgattattaagcaggacagactgagctttctgttgcaaataccttggaggagaaagtaatttctaaatatacagagaggtaacttgactatatatgttgcatcctgtgcctcccttcatattaatatttgataaagattttaatttatgtaaaacttctaaagcagaatcaaagctcctcttggggaaatggcaagtctttaggataggcaagaccctgtatgaatagtaccaaagcattaccgcatggtagagaacacactcgattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcattgaaaatctgcacaattcagtttcagctctggattacttcagttgacctttgtgaaggtttttatctgtgtagaatgggtgtttgacttgttttagcctattaaatttttattttctttcactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgccagttcagtcttttcaaaatgagggagaaacatttgcctgccttgtaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactagaaaataaaa

SEQ ID NO: 3682 - DNA, 1355 bp, Homo sapiens
ctatctttctagacaaggcagttgaggaggagggagcgcttgagggggactggcctggcgtgcactccgcacctcggggacattattgcgcgtggaacggctgcttttggaaggcacaacttcctgaatggaccatgactcccaccaaagatccctgtctctgattcaccaaacagcttcaaccctgaaaccaggacgagaagttgacaacatctgagtggacagctaattgacctaagacttcagaccaggcctactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttact

SEQ ID NO: 3683 - DNA, 1551 bp, Homo sapiens
gttgttccggcgcaggtgagggaggtggcggcgagcgacgcggttcacctcccgctgccctcgccctcgccccggcgagcggcccccgcaggaactttcctcccgacgcgagatgtcttatttaccaacaaatccaccagggagcattcttgctggctcggcgtctctctcggcagtcaccggagtgcccgagggggaagcacgatttacggaagactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctttctgttttgagaagcagtggttggggcatttttaagatggctggctactcttg

SEQ ID NO: 3684 - DNA, 1555 bp, Homo sapiens
gttgttccggcgcaggtgagggaggtggcggcgagcgacgcggttcacctcccgctgccctcgccctcgccccggcgagcggcccccgcaggaactttcctcccgacgcgagatgtcttatttaccaacaaatccaccagggagcattcttacttgctggctcggcgtctctctcggcagtcaccggagtgcccgagggggaagcacgatttacggaagactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctttctgttttgagaagcagtggttggggcatttttaagatggctggctactcttg

SEQ ID NO: 3685 - DNA, 459 bp, Homo sapiens
attcccaagaccaccagttactggaattatttctggactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctc

SEQ ID NO: 3686 - DNA, 669 bp, Homo sapiens
cgccattcgctcggaaactaagttgccatccgcttccgagctggcggccgagggtctttaaatcggcctttgggggtcagtgctgggctctgccggagcgcacgcggcgtggcgttgtttgctcaactccggagggatgcggatgcgacaatgagagcaacacgcggtcgcttaaaaacagcccgtcttccactcgcctgccctcttcggaccgcgcccaagagcctctggtgtccggggtgctttcggagcccgaagttttgctcccgactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctc

SEQ ID NO: 3687 - DNA, 2400 bp, Homo sapiens
agagaaagggtctgttgtttttctctcctgtttctcgctccctctctgctgatcacaaagctgctgaccgggtcagaaagtcctgatggaaatccaccagcgctgggcaggcccctcctcctccagggagcttgtccttgcctaatttttcttcgtcctgatgagaacaaaaaagagagagagaagaaaagaaaaaccacaaacttcctttgaaaaccagcttgtagtcagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaacgcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccatccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggcacggtggctcactcctgtaatctcaacaatttgagaggccaaggtgggcggatcacctgaggttaggagttcgagaccagcctgcccaaaaaggtgaaaccccgtctctactaaaaatacaagaaattagctgggcgtcatggtgggcgcctgtaatcccagctactcgggaggctgaggcaggagaatcacttgaacctgggaggtgaaagttgcagtgagccgagatcgcaccattgcactccagcctgggcgacaagagcaaaactgtctaaaaaaaaaaaaaa

SEQ ID NO: 3688 - DNA, 1961 bp, Homo sapiens
tttccggcgaggccaagggggcgtggcgtggggcgacgtgggaaacgtagtcccgcaactccgcaatgtccctagcaaccgagggaaggattgttttctgagggatcagtcgttcggtaaacaaatgtctttggggagctgacacctgctgtccttccacctttggtctgcaagtctggattgcttagaggagctaagtcaggagagacatgtaaaggggatgctgcttggtcctcctccttttaatgaaagcacgaaaccttccccctctccttgtcactcttttgcatcccaagcctggcttaggcaagtccctgaggttagtaaacaccttcagtgcccctcagccaagtcccttttgaccatggaataccatcagcctgaggatccagcccctggtaaggccgggactgcagaagcagtcatccctgaaaaccatgaggttctggcaggcccagatgagcaccctcaggacacagatgcaagagatgctgatggggaggctagagaacgggagccagcagaccaagctttgctgcctagccagtgtggggacaaccttgagtcccctctgcctgaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaacgcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctct

SEQ ID NO: 3689 - DNA, 2817 bp, Homo sapiens
ggccaagggggcgtggcgtggggcgacgtgggaaacgtagtcccgcaactccgcaatgtccctagcaaccgagggaaggattgttttctgagggatcagtcgttcggtaaacaaatgtctgctgaccgggtcagaaagtcctgatggaaatccaccagcgctgggcaggcccctcctcctccagggagcttgtccttgcctaatttttcttcgtcctgatgagaacaaaaaagagagagagaagaaaagaaaaaccacaaacttcctttgaaaaccagcttgtagtcagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaagggaagctgactccacccatgtgttcaatcccaccagtcttccctcccaagtctggaagccccacgacctcttggtctcatctggtcacagcaagttagaggtggaaagagctcagcacggggcccttctgtttacacatatactgcccatagccaggagttactgcacaaacactagccagccttctacactacattccttttccaagacttttctgggttagtttgctttccagcccactgatttccttcttattggacaggtcactcttttgcatcccaagcctggcttaggcaagtccctgaggttagtaaacaccttcagtgcccctcagccaagtcccttttgaccatggaataccatcagcctgaggatccagcccctggtaaggccgggactgcagaagcagtcatccctgaaaaccatgaggttctggcaggcccagatgagcaccctcaggacacagatgcaagagatgctgatggggaggctagagaacgggagccagcagaccaagctttgctgcctagccagtgtggggacaaccttgagtcccctctgcctgaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaacgcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccatccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggca

SEQ ID NO: 3690 - DNA, 1546 bp, Homo sapiens
acaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaagctagctcagctccaccggggccaacccttgggacactgcctgaagtagagacaataagggcatgctccatgccccaggagcttcctcagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgcagagcagttcctggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagtcattccctgggcaaggggcctggagcagaaggtgggagtggctccccagaaacgcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctg

SEQ ID NO: 3691 - DNA, 4820 bp, Homo sapiens
cggtctccatagagctgggggcgggcggcccggtatggagagcagccccgagagcctgcagccgctagaacacggggtggcggccgggccagcgtcagggacaggttcttcgcaggaagggctacaggagaccaggctcgccgctggtgatggtcctggggtatgggcggcggagaccagcggcgggaatgggctgggggcggcggccgccaggaggagcctcccggactcggcttctcccgcgggctctcctgaggttcccggaccctgcagctcctccgcgggtttggacttgaaggacagtggtttggagagtcctgctgccgccgaggcgcctctgagagggcagtacaaggtgaccgcctccccggagacagccgtggccggagtgggtcatgagttgggtaccgccggagacgcgggagcccgcccggatctcgccggcacctgccaagcagaactgaccgccgccggctccgaagagcccagcagcgccggcggcctcagcagcagttgcagcgacccgagccctcctggggaatctccgagcctggactctctggagtcgttctctaacctgcattcttttcccagtagctgcgagttcaatagtgaggagggagcggagaacagggtccctgaggaggaggagggcgcggcggtgttgcccggggctgttcctctgtgcaaggaggaggagggggaggagaccgctcaggtgctggcggcctccaaggaacgcttcccgggacaatctgtgtatcacatcaagtggatccagtggaaggaagagaacacacccatcatcacccagaatgagaacggaccctgccccttgctggccatcctcaatgttttgctcctggcctggaaggtgaaacttccaccgatgatggaaatcataactgctgagcagctgatggaatatttaggagattacatgcttgatgcaaagccaaaagaaatttcagaaattcaacgtttaaattatgaacagaatatgagtgatgccatggcaattttgcacaaactacagacaggcctggatgtaaatgtaagattcactggtgttcgagtgtttgaatatacaccagaatgcatagtatttgatcttcttgatattcctttgtaccatgggtggttagtagaccctcagattgatgacattgtaaaagctgttggtaactgcagctacaaccaactagtggagaagatcatctcttgtaaacagtcagacaatagtgagctggttagtgaaggctttgtagctgagcagtttctaaataacacagccactcaactgacataccatggattatgtgaactaacttcaacggttcaggaaggagaactttgtgtgttctttcggaataatcattttagcaccatgaccaaatacaagggtcaactgtatttgttggtaacggaccaggggtttcttactgaagagaaagttgtttgggaaagcctacacaacgtagatggtgatggaaatttctgtgactcagaatttcatcttcgacctccttcagatcctgaaactgtatacaaaggacaacaagatcagatagatcaggattatcttatggcattatctctacaacaagaacagcagagccaagagatcaattgggaacaaatcccggaaggaatcagtgatttggaactagcaaagaaactccaagaggaagaggacagacgggcttctcaatactatcaggaacaggaacaagcagcagctgctgctgctgctgcttctacacaggctcagggccagccagcacaagcctctccatcaagtggaagacaatctgggaatagtgaacgtaaacggaaggaaccacgagaaaaagataaagaaaaagaaaaggaaaaaaatagctgtgttattttgtaacaagtgttggcttctgttggaaccacctatatgtcttgagaaacaaaaccacaggaggaaaggaagaaaaaccgatcaataccgtctgtgcctgatttcctaatggattttgttcgttttttcaggggaacggttgttacttagttacaatcagactttttcaagtcacacaatacactctttatgagctggagtttcatgttacaagttggaaatgctgtgtgttgacattcatgaaaaatactgcacttgtagccagattagcaaatcacagcaaattttgtgtcatagtgacattcataactcatatcagttagtaagctattatatcttctgttctaacaatgaatggaggtaattgatttagtctgattccttcctgaaatctaaatattagcacaatagtttctgaaattttacaatgttaaattatgatctaattcatgagaaaccacgggtttaacatagggattcaaaaaaacaaaaacaaaagaataggaataaataacccttaattgtatattggactagttcagcccttaaacagctttacctttatttaggaatgtacattttaggtattatcttgatcatggagcttagttttaatttagatagcaaaaataaagatttgtatttcttttccaatagcaaaaagttacataacactaatacttataacctatcaatatcagatattaatgactttgtagtgttgtaaaattttgaggaattttggagtctttatcataggtaacctggaccacagttactatttattgacaatgtgattgagtgtatggaggaaagcacagtggatgctaggctttgtaaatatggggatgtagaaaagcagatagttcagtgtctacctttttctagaactaccttgaaccttaaattttaagtcatgttcattgctagaaaattaaatgtacttattaaaaccaatgaaaaagcacatttctgaaatgaagttagagataatctctgtgtcttataaaaagacattaataaaaatctgaaagggccgggcgcagtggctcacgcctgtaatcccaacattttgggaggccaaggtgggcggatcatctgaggccaggagttcgagaccagcctggccagcatggtgaaaccctgtctctactaaaaatacaaaaaatcagcctggcatggtggtgcgtgcctgtagtcccagctactcagggctgaggcaggagaattgcttgaacccggcaggcagaggttgcagtgagccgagatcgccctgctgcactccagcctgggtgacagagggagactccgtctcaaaaaaaaaaaagtctgagagtagctaagaatttatgtaaaagcaatcagagtttttaatttatgggaaccaaataaaactataacctcatagtgtttataagaactcagaaataatatttatttaactttattatgaggccacacatattttcctgtgtttctatatatagtttggaaaactatccttaatagtctgttttatatgccttatatttaaaagtttgttttagttattttgaaagactattgctgctgcaaatagttgtgtgctttacattctaagcttcagtacatttatttaagagcatcataatctgacctgagcatccacttggagagtgttttttttgtgtgtggtctggggtgacaaaagaccacaaaaatgtgtggtctggattttttcaactatgtcattaactttatgatccaagaccagttataggatgaatctgtatgtaaaaatagagtcttatttatggaaggaattattctaagggaaaaatccagggtcaagctgtatcttttatgtcctttatattgcatgtctatttctgttacacaatttgttatttcttcaaatttcctatggtagcatgataaatcatcaaagaacctgtttgggatataaaactctgatagaaaatatttaatgagtatcttgattataacctagaatatgtatacgttagtaaaataaccagatatactacagaactctctattggctcaaacaggttgacctcaatccaagtttactcttgatatcactctgttggctgaaggaggtaactcaaacctcagggtttgtttttcccgggacagatagtagtgatagtgcattatatttgaataagaaaaacaaaccagtataccttgagaaattttaaaaagcatagttgaggcatattttttcataattatatacttatctgtttattgcccatggaaaatatatgtgtagaagtatttcttctgttatttgttactatcttcttaatttgttccaaagaaaatgctgccatactgcattccctctggaaggaaacaaaacaaaacaaaactcactcaaaaccagcagtgctgctatcagataagtagatgtcaatgtatacttacaaggaaaaactaaaaaatgtaatgtgttaattcagcctttttctatgtaatatttccaagtcagactttcttacattcctggaatttactttgatataccaagaataataatgataaaatgtttgctttgattactgtggggggaaagatgaaatgttcaattgtattaaaacaaacaagcttttcagagatactggtttcctgcccttgaagggtataaagaatttagatcatgcctgtaatcccagtactttgggaggccgaggcaggtggatcacctgagatcaggagttcgagaccagcctggccaacatggcaaaaccctgtctctactaaaaatacaataattagccaggcatggtggcgggcacctgtcatcccagctacttgggaggctgaggcaggagaatcgcttgaacccaggaggcagtgattgcagtgagctgagatagcaccactgcatgcaagcctgggcaatagagcgagactccgtctc

SEQ ID NO: 3692 - DNA, 9238 bp, Homo sapiens
aatacagctgtcatggcgtccaaggcgctggctgcggagaagtggccgcggtctccatagagctgggggcgggcggcccggtatggagagcagccccgagagcctgcagccgctagaacacggggtggcggccgggccagcgtcagggacaggttcttcgcaggaagggctacaggagaccaggctcgccgctggtgatggtcctggggtatgggcggcggagaccagcggcgggaatgggctgggggcggcggccgccaggaggagcctcccggactcggcttctcccgcgggctctcctgaggttcccggaccctgcagctcctccgcgggtttggacttgaaggacagtggtttggagagtcctgctgccgccgaggcgcctctgagagggcagtacaaggtgaccgcctccccggagacagccgtggccggagtgggtcatgagttgggtaccgccggagacgcgggagcccgcccggatctcgccggcacctgccaagcagaactgaccgccgccggctccgaagagcccagcagcgccggcggcctcagcagcagttgcagcgacccgagccctcctggggaatctccgagcctggactctctggagtcgttctctaacctgcattcttttcccagtagctgcgagttcaatagtgaggagggagcggagaacagggtccctgaggaggaggagggcgcggcggtgttgcccggggctgttcctctgtgcaaggaggaggagggggaggagaccgctcaggtgctggcggcctccaaggaacgcttcccgggacaatctgtgtatcacatcaagtggatccagtggaaggaagagaacacacccatcatcacccagaatgagaacggaccctgccccttgctggccatcctcaatgttttgctcctggcctggaaggtgaaacttccaccgatgatggaaatcataactgctgagcagctgatggaatatttaggagattacatgcttgatgcaaagccaaaagaaatttcagaaattcaacgtttaaattatgaacagaatatgagtgatgccatggcaattttgcacaaactacagacaggcctggatgtaaatgtaagattcactggtgttcgagtgtttgaatatacaccagaatgcatagtatttgatcttcttgatattcctttgtaccatgggtggttagtagaccctcagattgatgacattgtaaaagctgttggtaactgcagctacaaccaactagtggagaagatcatctcttgtaaacagtcagacaatagtgagctggttagtgaaggctttgtagctgagcagtttctaaataacacagccactcaactgacataccatggattatgtgaactaacttcaacggttcaggaaggagaactttgtgtgttctttcggaataatcattttagcaccatgaccaaatacaagggtcaactgtatttgttggtaacggaccaggggtttcttactgaagagaaagttgtttgggaaagcctacacaacgtagatggtgatggaaatttctgtgactcagaatttcatcttcgacctccttcagatcctgaaactgtatacaaaggacaacaagatcagatagatcaggattatcttatggcattatctctacaacaagaacagcagagccaagagatcaattgggaacaaatcccggaaggaatcagtgatttggaactagcaaagaaactccaagaggaagaggacagacgggcttctcaatactatcaggaacaggaacaagcagcagctgctgctgctgctgcttctacacaggctcagcagggccagccagcacaagcctctccatcaagtggaagacaatctgggaatagtgaacgtaaacggaaggaaccacgagaaaaagataaagaaaaagaaaaggaaaaaaatagctgtgttattttgtaacaagtgttggcttctgttggaaccacctatatgtcttgagaaacaaaaccacaggaggaaaggaagaaaaaccgatcaataccgtctgtgcctgatttcctaatggattttgttcgttttttcaggggaacggttgttacttagttacaatcagactttttcaagtcacacaatacactctttatgagctggagtttcatgttacaagttggaaatgctgtgtgttgacattcatgaaaaatactgcacttgtagccagattagcaaatcacagcaaattttgtgtcatagtgacattcataactcatatcagttagtaagctattatatcttctgttctaacaatgaatggaggtaattgatttagtctgattccttcctgaaatctaaatattagcacaatagtttctgaaattttacaatgttaaattatgatctaattcatgagaaaccacgggtttaacatagggattcaaaaaaacaaaaacaaaagaataggaataaataacccttaattgtatattggactagttcagcccttaaacagctttacctttatttaggaatgtacattttaggtattatcttgatcatggagcttagttttaatttagatagcaaaaataaagatttgtatttcttttccaatagcaaaaagttacataacactaatacttataacctatcaatatcagatattaatgactttgtagtgttgtaaaattttgaggaattttggagtctttatcataggtaacctggaccacagttactatttattgacaatgtgattgagtgtatggaggaaagcacagtggatgctaggctttgtaaatatggggatgtagaaaagcagatagttcagtgtctacctttttctagaactaccttgaaccttaaattttaagtcatgttcattgctagaaaattaaatgtacttattaaaaccaatgaaaaagcacatttctgaaatgaagttagagataatctctgtgtcttataaaaagacattaataaaaatctgaaagggccgggcgcagtggctcacgcctgtaatcccaacattttgggaggccaaggtgggcggatcatctgaggccaggagttcgagaccagcctggccagcatggtgaaaccctgtctctactaaaaatacaaaaaatcagcctggcatggtggtgcgtgcctgtagtcccagctactcagggctgaggcaggagaattgcttgaacccggcaggcagaggttgcagtgagccgagatcgccctgctgcactccagcctgggtgacagagggagactccgtctcaaaaaaaaaaaagtctgagagtagctaagaatttatgtaaaagcaatcagagtttttaatttatgggaaccaaataaaactataacctcatagtgtttataagaactcagaaataatatttatttaactttattatgaggccacacatattttcctgtgtttctatatatagtttggaaaactatccttaatagtctgttttatatgccttatatttaaaagtttgttttagttattttgaaagactattgctgctgcaaatagttgtgtgctttacattctaagcttcagtacatttatttaagagcatcataatctgacctgagcatccacttggagagtgttttttttgtgtgtggtctggggtgacaaaagaccacaaaaatgtgtggtctggattttttcaactatgtcattaactttatgatccaagaccagttataggatgaatctgtatgtaaaaatagagtcttatttatggaaggaattattctaagggaaaaatccagggtcaagctgtatcttttatgtcctttatattgcatgtctatttctgttacacaatttgttatttcttcaaatttcctatggtagcatgataaatcatcaaagaacctgtttgggatataaaactctgatagaaaatatttaatgagtatcttgattataacctagaatatgtatacgttagtaaaataaccagatatactacagaactctctattggctcaaacaggttgacctcaatccaagtttactcttgatatcactctgttggctgaaggaggtaactcaaacctcagggtttgtttttcccgggacagatagtagtgatagtgcattatatttgaataagaaaaacaaaccagtataccttgagaaattttaaaaagcatagttgaggcatattttttcataattatatacttatctgtttattgcccatggaaaatatatgtgtagaagtatttcttctgttatttgttactatcttcttaatttgttccaaagaaaatgctgccatactgcattccctctggaaggaaacaaaacaaaacaaaactcactcaaaaccagcagtgctgctatcagataagtagatgtcaatgtatacttacaaggaaaaactaaaaaatgtaatgtgttaattcagcctttttctatgtaatatttccaagtcagactttcttacattcctggaatttactttgatataccaagaataataatgataaaatgtttgctttgattactgtggggggaaagatgaaatgttcaattgtattaaaacaaacaagcttttcagagatactggtttcctgcccttgaagggtataaagaatttagatcatgcctgtaatcccagtactttgggaggccgaggcaggtggatcacctgagatcaggagttcgagaccagcctggccaacatggcaaaaccctgtctctactaaaaatacaataattagccaggcatggtggcgggcacctgtcatcccagctacttgggaggctgaggcaggagaatcgcttgaacccaggaggcagtgattgcagtgagctgagatagcaccactgcatgcaagcctgggcaatagagcgagactccgtctcaaaaaaaaaaaaaaaaaaaaaattagagctattgtgtctttattttcttaaattttgcccaaggtaacgttatatatcccaccacttcattgctggtttgggtacataggattttgaaagtggtatattaaagtctttccttccaagtattttgtaatacttgaaaattcttagatgtatactgctaacaaaagttagaacttaaacatttttgtttttatcatttatagcctagattagggacatatttgcatcaaccaaatcatcattagatttgaaaataggcagatgaatgaacaaatatggtcattgcactttccttttactttcagagtctaagtatattccttaaggttagtaaccagtctttattaaaaatataaaatttttcttcatgtctaatcccattgcatccacaatgctgtgatttatagtacatgatcaacacttaaaagtactttacatatgtgtgtttctgaagcaagttttcatgacctctgttagattctcaaaagaattcagaacttcaatttaagaatcaccattttaagaatacatgtgtacatatacacattaagcagtataaagcagctaaaattggcattggttttacactggtgcagtgtgcttaggtaaagtaacttcttccatgtttcaaggtcaggttcagagttgaatgaagtgtagatttaaatttaggattaggctttggaatatatcttgtttttattgtctcacatttctgatattgactacttatcccatattctgtttcaaattctttatcatatttcaagttctttctcatacttcttgatcttggcttaactaagcaagttagtatcagagactagttgactgaacccaagattaaacattttgcacttgcacaaaaccttcttagcattttgctttcaatgaatcagaaagtcaattcactaagagacagatcatgagaggaaagagaactagaggccaataaataaaataattgttcatatattaatgttcacatgtgaactacatatctaaaatcttggagaaaaatcaaggcaagaatttccagaactgtcctcaaatagctcatttatttaagttttgttaaaaagcaaaagcgaattgattacatttgattaacttttcctattccatgcacaagttaccttaaaacatgataaaaaccttatgggcattacctatcacacagtacttatgcataaacttataatagtaaaattactaatgtttgataaaataagatggaggcattacaaatagtctacagtttgtattttaaggaattggacatgaagaattctagatcattttgtgtctataaacccgactttctatcttgccttgggcaaactttctgtgcctcaatgtactctttaaatatgtgaaggatgctctttttgattaagtgttttgcactcctgaataaagggcatagtataagcacaaagtatgacttaatttatcacaaatattacacatcctatgttcttgaatgtgcacacttttttctcaataacaaaatatatcttaagtcagtttttttaatgctgtcaaaatttgtagaattttctttgagtatggcgtgatctcttcccaaatgcattttacagttttttgtgtgttctatagactatagagtcaaaatcaagagtattttgagaggatcagaagcatttaaaaatctatttttttctagtatctttcacagatctaaatatttagattctctttgcctttttctccatggaatacggtggtatcaaattactaatacagtatataaacttcgtttgcattggtggaattcatttagatctctcaagtaatattattttagggctatataaattgtgtttttagtgtaaaatgttatttgataatgtgaagttaaatcccttttagaaagtgactgaaaatggtaaaggaactcatcagaatcttagcgttcttaagttctctgataatttagtatattttattaatgatgtccaacacctctaagattgttgagaaaacatgaagaattgaggttactcttctcaggtgacactttaaatattaaaatcagaggcttcctgaacaaaacaaattgcaaaatagcgataatggcatgggagaggccagatgcaggactctggtaaatttaacttactttgaatatctatctaaattttagttcatgcatgttcttacttaatcctggtgtttttgctcttagatgttagagtttaataaattgtgatacgcatatatttttttacatgaaggattctactttctaattttacttttctgatctcaagaaaattaaacttgaaaaacggggtaaaattcttcaactattgcctcaagttcagttttgtcctattgtcctgagaaaggagatttagacttgtctgcctaacacaggtattttttagggcatcgtactatcccagagaaagtgttgagataccatggcagaaatataaaacctaagctttgaaccccagtagacttcttcttctgccattaagtctctctttatctgatattctaaggatttcttcaaactacttaataatttgtcaccattaactttaatatccagttttaatctgcactgtaatatcctgctttgagaagaaagaatgcctcataaattagagaaggacaaaacaaaatgttttggaaggtgatcctggctcctttggctctcataattgttttatagctgaaaataaaaagtcaggaaactggcccggtgcggtggctcatgcctgtaatcccagcactttgggaggctgaggtgggtggatcacctgaagtcaggagttcgagaccagcctggccaacatggtgaaaccctgtctctactaaaaatacaaaaaaaattagctgggtgtggtggcacatgcctgtaatcccagccactggggaggttgaggcgcaagaatcgcttgaacccggaaggcagaggttgcagtgagccaagattgccccactgcactccagcctgggcgactgagcgagactcttatatctcaaaaaaaaaaaaaaaaaaaagtcaagaaactgaaattcccatttaagttctcaaatcagtgatctgtcaaaataggccttgtaactgaaataccttacaaagcagttctaactaatgcaatgtgttttttaaaaatttttaatgaaccttacattgtgaacataattgcaacatgttttaagacaaacagtatttaatccttgaagacctgtcttgtatgtctctcaattttgtcagaatttttattattgtttttcacatatgtgaaataagcagttttttcagggtacatagggtatctttgttttacagatttttaaagatgaggttttgaaaagccctcagaggtttttgttaaaagactatcttgcttaataaatgacagcttgttacagattcacacattacaagtaggacagtataacaggagattggtgtgtgaatgctacaaaacagtcagcaaaaggaatcatgtttgcttgtgaaacttcagaggtaccctgaaagtcatttcctaaagctagtgcgtgtgaatcttttccttgaattgtgcagaataattggattgaggcacatattttgaggagtagcaagtggaatggtataatgactacagagaaaattatcttgaaatatagcaaggaagagaaacaagttttctttctccactttattgttggactaattgggtcaatttgctgtgacatatcaaagatctctttgtgccaggccaagactggctactgagttctcaaagcgttttaatatatagattacgtatgagtgcctattttttcctcctcctttcattttttatcttaatacccattttacttctgaaataattcatctgttttgctttatgaccagctttaatttcaattgaggaataataacaaccctagagattcataggaaagagcattgaaatacattttttgcataaagatacctaaaaccatctacccagcttagggttgaactgaatttctgtgaaataaatttgttttaaatactaattattttaaaactacttaattcttaaaaacaatgtcatcagtttcaaaactttcactttgggaggatattccttaaaaggcatacatagatggtaaagtataaaatatttctgacagaattattcagtattattcaacatttactttcatgtttgttattgtaccacaaagatagtgtcattgttgggttaaaatgttggctgtttttgttaatatacttaaaactgtaaccagtgaataacacctgtagtattttttattatagattatattttatttcaataaactttgatatttagaccaaa

SEQ ID NO: 3693 - DNA, 4279 bp, Homo sapiens
aacgttaaatttagatgttttacctctaaatgaggtgaaattgcaggttccctctggctggcggtggggaggagacgcagggcagctttggccagcagtgagcggacagacttagcgggagtagactctgcttcctccagccacaccttggggacggaggcccaggacagtccccagtgtctgggagcatctggcttcctctccctgcacacaccagccgggtctgaacggcatcagttctaagtgccaggccagagagaggcagcgagggacacggagtagaagaggctgtcctgtctgccaccaaaggtgaccaccatgtcggtgaggttgcggttcctgtcccctggggacacaggggccgtgggggtcgtgggccggagcgcctccttcgcaggcttcagcagtgcacagagccggaggatcgcaaagtccatcaacaggaactccgtgagatcgcgaatgcctgcaaaatcctccaagatgtacggcacgctgcggaaggggtcggtctgtgcagacccgaagccccagcaggtgaagaagatcttcgaagcattgaaaagaggcctcaaggagtatctgtgtgtgcagcaggctgagctggaccacctgtctggacgccacaaagacaccaggaggaattccaggctggctttctattatgacctggacaagcaaacgcgctgtgtggaaaggcacattcggaagatggagtttcacatcagcaaggtggatgagctgtacgaggactactgcatccagtgccgcctgcgcgacggcgcctccagcatgcagcgggccttcgcccggtgccccccgagccgcgcagcccgagagagcctgcaggagctgggccgcagcctgcacgagtgcgccgaggacatgtggctcatcgagggggccctggaggttcacctgggcgagttccacatcaggatgaaaggcttggtgggctacgcacgcctctgtcccggagaccactatgaggtgctcatgcgtctgggccgccagcgttggaagctcaagggtcggatcgagtcagatgacagccagacctgggacgaagaggagaaggccttcatccccacgctgcatgagaacctggacatcaaggtgacggagttgcggggcctgggctcgctggctgtgggtgcagtgacgtgtgacatcgccgacttcttcacgacgcggccgcaggtcatcgtggtggacatcacggagttgggtaccatcaagctgcagctggaggtgcagtggaacccgtttgatactgagagcttcctggtgtcacccagccccacgggcaagttttctatgggcagcaggaagggctccttgtacaactggacacccccgagcacccccagcttccgggagagatactacctgtctgtcctacagcagccaacacagcaggccttgctgctgggtggcccaagggccacctccatcctcagctacctgtctgacagcgacctccggggtcccagcctaagaagccagagtcaggagctgcctgagatggactccttcagctctgaggacccccgagacacggagaccagcacgtcggcgtccacctcagatgtgggcttcctgcccttgaccttcggtccccacgcctccattgaagaggaggctcgggaggaccccctgcccccaggtctcctgccagagatggcccacctctctggaggcccgtttgcagagcagcctggctggaggaacttaggaggggagagccccagcctgccacagggctccctgttccacagcggcacagcctcgagtagccagaacggccacgaggaaggggcaaccggggacagagaggacgggcctggcgtggccctcgaggggcctctgcaggaggtcctggagttgctgaggcccacggactccacccagccccagctccgggagctggagtaccaggtcctcggcttccgggaccggctgaagccctgcagagcacggcaggagcacacctcggccgagagcctgatggagtgcatcctggagagcttcgccttcctcaatgccgacttcgccctggatgagctgtccctgtttgggggctcccagggtctccgaaaggaccggcccctgcccccaccgtcatcactgaaagcgtcatccagggaactcacagccggtgccccagagctggacgtgctgctgatggtacacctccaagtctgcaaagctctgctgcagaaactggcctcccctaatttatcaaggctggtccaggaatgcctcctggaagaagtggcacagcaaaagcacgttctggagacactttctgtccttgactttgagaaggtcggcaaggcaacatccattgaagagatcatcccacaggcctcgcggacgaaggggtgcctgaagctgtggagagggtgcacagggcctggcagggtcctgtcctgccctgccacgacgctgctgaaccagctcaagaaaaccttccagcacagagtcagagggaagtacccaggacagctggaaatagcgtgccgcaggctcctggagcaggtggtcagctgtggtgggctgctccccggagctgggctcccagaagaacagatcattacctggttccagtttcacagctacctgcagaggcagagcgtctctgacctggagaagcacttcacccagctcaccaaggaagtgacactcatcgaggagcttcactgtgcgggacaggccaaggtggtccggaagctgcaggggaagcggctgggccagctccagcctctgccccagaccttaagagcctgggcgctgctccagctggacggcactccgagggtgtgcagggcggccagcgctcgcctggctggtgcagtcaggaacagaagcttccgggaaaaggctttgctgttctacaccaacgccctggcagagaacgacgcaaggctccagcaggccgcatgcctagcgctcaaacacctcaagggcattgaaagcatcgaccagactgccagcctgtgccagtctgacctggaggccgtgcgggcggcagcccgggaaaccacactgtcgttcggtgaaaaaggacggttagcttttgagaagatggacaagctctgctcagaacaaagagaagtcttttgccaggaggcagatgttgaaatcacaatattttaaaaaatcctggctgatgagcacaaatctcacatcgttttttttgctgctgcccagcctggacatagcctgcactctgggtaatggtgctgtgcactcctccaggagtgtgagctgcccagagctctacctgagactccggccattgacccagccccagggcatgggctggtcttttgtacagaggcagaaaaaagcaaggcaaaggtacagcattccaggggctgcacggcctcaacagagcgctcaacttctggctgagggtctgtgtgaccttccccgagatgcagagctgagccaaactaggtggccacctacaaaagggccaaggccaggcaagttgaggccctaaataaaaggctccaaggcaagtgtgtagaactccaggcctcgctgccggtcagctgctcggcacttctgcgtcaagaggcactggggatgcagcaggctggcaggtggctggccctgctaatgcaagactgctcaggccatttcagcagcagccaggtgtcaccttggtgagctggggaaggtgggaaggcacaaagccagggtttctacaaccacactctcagcccgactgacttgctgcgagtgctggtggagctcacagacggcggctggtggatggtggactgtgaacctcactttccctatgttcagcagcacaaagggaagaagccaccacatcagcccaggagccctgagcagcacaggcagtagggccactcactttggccatccgcacccaaatgcaatcaatcaacccagcttcggaagctaccctaggatctcgtcaataaactgctaagaagccatcaactggcctaaagaaagagttcactgaagaacgcaattgctttaaagaaagaaaaattagtttcctatttaagtcttaaaaaaaagcaaaccatgtcctgagatgtctgtgttaatagtgcagagagaacctagggtttgaggttgctgtagcaatggcattggagaactttaacttgaacattctcatcgatacttcctggacatattttgtgtttttaacttacttagtatttatttgccttgttcatatgttcaattttctgaaatttcaattaaactattggtgtttcactttttaccc

SEQ ID NO: 3694 - DNA, 4377 bp, Homo sapiens
cactgacaagcaatcggccgcgtccagagcagcaggcggcatccggggggagcggggccggctggggggccccaggagggcttcctggaaccccagctccatggccgcctgcaccctgacacaggccagataagagtcccggctgcattatcagagcccggcagggcaccggcctccctgcaccagaaggaagactcggggcgcagcaggtcctcaaggcgatcttcccagagagcgggaccagcggctggtggccagtgtggatggaatttgcagagccctagctcgagtccgggagtcccgggccagatgggagcagacgcttgctggcggcaatagggaaagtgaggcagctgcaaggagggcggcgggactgcactcgagtgtccagacctgctcgatggtgaccaccatgtcggtgaggttgcggttcctgtcccctggggacacaggggccgtgggggtcgtgggccggagcgcctccttcgcaggcttcagcagtgcacagagccggaggatcgcaaagtccatcaacaggaactccgtgagatcgcgaatgcctgcaaaatcctccaagatgtacggcacgctgcggaaggggtcggtctgtgcagacccgaagccccagcaggtgaagaagatcttcgaagcattgaaaagaggcctcaaggagtatctgtgtgtgcagcaggctgagctggaccacctgtctggacgccacaaagacaccaggaggaattccaggctggctttctattatgacctggacaagcaaacgcgctgtgtggaaaggcacattcggaagatggagtttcacatcagcaaggtggatgagctgtacgaggactactgcatccagtgccgcctgcgcgacggcgcctccagcatgcagcgggccttcgcccggtgccccccgagccgcgcagcccgagagagcctgcaggagctgggccgcagcctgcacgagtgcgccgaggacatgtggctcatcgagggggccctggaggttcacctgggcgagttccacatcaggatgaaaggcttggtgggctacgcacgcctctgtcccggagaccactatgaggtgctcatgcgtctgggccgccagcgttggaagctcaagggtcggatcgagtcagatgacagccagacctgggacgaagaggagaaggccttcatccccacgctgcatgagaacctggacatcaaggtgacggagttgcggggcctgggctcgctggctgtgggtgcagtgacgtgtgacatcgccgacttcttcacgacgcggccgcaggtcatcgtggtggacatcacggagttgggtaccatcaagctgcagctggaggtgcagtggaacccgtttgatactgagagcttcctggtgtcacccagccccacgggcaagttttctatgggcagcaggaagggctccttgtacaactggacacccccgagcacccccagcttccgggagagatactacctgtctgtcctacagcagccaacacagcaggccttgctgctgggtggcccaagggccacctccatcctcagctacctgtctgacagcgacctccggggtcccagcctaagaagccagagtcaggagctgcctgagatggactccttcagctctgaggacccccgagacacggagaccagcacgtcggcgtccacctcagatgtgggcttcctgcccttgaccttcggtccccacgcctccattgaagaggaggctcgggaggaccccctgcccccaggtctcctgccagagatggcccacctctctggaggcccgtttgcagagcagcctggctggaggaacttaggaggggagagccccagcctgccacagggctccctgttccacagcggcacagcctcgagtagccagaacggccacgaggaaggggcaaccggggacagagaggacgggcctggcgtggccctcgaggggcctctgcaggaggtcctggagttgctgaggcccacggactccacccagccccagctccgggagctggagtaccaggtcctcggcttccgggaccggctgaagccctgcagagcacggcaggagcacacctcggccgagagcctgatggagtgcatcctggagagcttcgccttcctcaatgccgacttcgccctggatgagctgtccctgtttgggggctcccagggtctccgaaaggaccggcccctgcccccaccgtcatcactgaaagcgtcatccagggaactcacagccggtgccccagagctggacgtgctgctgatggtacacctccaagtctgcaaagctctgctgcagaaactggcctcccctaatttatcaaggctggtccaggaatgcctcctggaagaagtggcacagcaaaagcacgttctggagacactttctgtccttgactttgagaaggtcggcaaggcaacatccattgaagagatcatcccacaggcctcgcggacgaaggggtgcctgaagctgtggagagggtgcacagggcctggcagggtcctgtcctgccctgccacgacgctgctgaaccagctcaagaaaaccttccagcacagagtcagagggaagtacccaggacagctggaaatagcgtgccgcaggctcctggagcaggtggtcagctgtggtgggctgctccccggagctgggctcccagaagaacagatcattacctggttccagtttcacagctacctgcagaggcagagcgtctctgacctggagaagcacttcacccagctcaccaaggaagtgacactcatcgaggagcttcactgtgcgggacaggccaaggtggtccggaagctgcaggggaagcggctgggccagctccagcctctgccccagaccttaagagcctgggcgctgctccagctggacggcactccgagggtgtgcagggcggccagcgctcgcctggctggtgcagtcaggaacagaagcttccgggaaaaggctttgctgttctacaccaacgccctggcagagaacgacgcaaggctccagcaggccgcatgcctagcgctcaaacacctcaagggcattgaaagcatcgaccagactgccagcctgtgccagtctgacctggaggccgtgcgggcggcagcccgggaaaccacactgtcgttcggtgaaaaaggacggttagcttttgagaagatggacaagctctgctcagaacaaagagaagtcttttgccaggaggcagatgttgaaatcacaatattttaaaaaatcctggctgatgagcacaaatctcacatcgttttttttgctgctgcccagcctggacatagcctgcactctgggtaatggtgctgtgcactcctccaggagtgtgagctgcccagagctctacctgagactccggccattgacccagccccagggcatgggctggtcttttgtacagaggcagaaaaaagcaaggcaaaggtacagcattccaggggctgcacggcctcaacagagcgctcaacttctggctgagggtctgtgtgaccttccccgagatgcagagctgagccaaactaggtggccacctacaaaagggccaaggccaggcaagttgaggccctaaataaaaggctccaaggcaagtgtgtagaactccaggcctcgctgccggtcagctgctcggcacttctgcgtcaagaggcactggggatgcagcaggctggcaggtggctggccctgctaatgcaagactgctcaggccatttcagcagcagccaggtgtcaccttggtgagctggggaaggtgggaaggcacaaagccagggtttctacaaccacactctcagcccgactgacttgctgcgagtgctggtggagctcacagacggcggctggtggatggtggactgtgaacctcactttccctatgttcagcagcacaaagggaagaagccaccacatcagcccaggagccctgagcagcacaggcagtagggccactcactttggccatccgcacccaaatgcaatcaatcaacccagcttcggaagctaccctaggatctcgtcaataaactgctaagaagccatcaactggcctaaagaaagagttcactgaagaacgcaattgctttaaagaaagaaaaattagtttcctatttaagtcttaaaaaaaagcaaaccatgtcctgagatgtctgtgttaatagtgcagagagaacctagggtttgaggttgctgtagcaatggcattggagaactttaacttgaacattctcatcgatacttcctggacatattttgtgtttttaacttacttagtatttatttgccttgttcatatgttcaattttctgaaatttcaattaaactattggtgtttcactttttacccaaaa

SEQ ID NO: 3695 - DNA, 3536 bp, Homo sapiens
atcagagcccggcagggcaccggcctccctgcaccagaaggaagactcggggcgcagcaggtcctcaaggcgatcttcccagagagcgggaccagcggctggtggccagtgtggatggaatttgcagagccctagctcgagtccgggagtcccgggccagatgggagcagacgcttgctggcggcaatagggaaagtgaggcagctgcaaggagggcggcgggactgcactcgagtgtccagacctgctcgatggtgaccaccatgtcggtgaggttgcggttcctgtcccctggggacacaggggccgtgggggtcgtgggccggagcgcctccttcgcaggcttcagcagtgcacagagccggaggatcgcaaagtccatcaacaggaactccgtgagatcgcgaatgcctgcaaaatcctccaagatgtacggcacgctgcggaaggggtcggtctgtgcagacccgaagccccagcaggtgaagaagatcttcgaagcattgaaaagaggcctcaaggagtatctgtgtgtgcagcaggctgagctggaccacctgtctggacgccacaaagacaccaggaggaattccaggctggctttctattatgacctggacaagcaaacgcgctgtgtggaaaggcacattcggaagatggagtttcacatcagcaaggtggatgagctgtacgaggactactgcatccagtgccgcctgcgcgacggcgcctccagcatgcagcgggccttcgcccggtgccccccgagccgcgcagcccgagagagcctgcaggagctgggccgcagcctgcacgagtgcgccgaggacatgtggctcatcgagggggccctggaggttcacctgggcgagttccacatcaggatgaaaggcttggtgggctacgcacgcctctgtcccggagaccactatgaggtgctcatgcgtctgggccgccagcgttggaagctcaagggtcggatcgagtcagatgacagccagacctgggacgaagaggagaaggccttcatccccacgctgcatgagaacctggacatcaaggtgacggagttgcggggcctgggctcgctggctgtgggtgcagtgacgtgtgacatcgccgacttcttcacgacgcggccgcaggtcatcgtggtggacatcacggagttgggtaccatcaagctgcagctggaggtgcagtggaacccgtttgatactgagagcttcctggtgtcacccagccccacgggcaagttttctatgggcagcaggaagggctccttgtacaactggacacccccgagcacccccagcttccgggagagatactacctgtctgtcctacagcagccaacacagcaggccttgctgctgggtggcccaagggccacctccatcctcagctacctgtctgacagcgacctccggggtcccagcctaagaagccagagtcaggagctgcctgagatggactccttcagctctgaggacccccgagacacggagaccagcacgtcggcgtccacctcagatgtgggcttcctgcccttgaccttcggtccccacgcctccattgaagaggaggctcgggaggaccccctgcccccaggtctcctgccagagatggcccacctctctggaggcccgtttgcagagcagcctggctggaggaacttaggaggggagagccccagcctgccacagggctccctgttccacagcggcacagcctcgagtagccagaacggccacgaggaaggggcaaccggggacagagaggacgggcctggcgtggccctcgaggggcctctgcaggaggtcctggagttgctgaggcccacggactccacccagccccagctccgggagctggagtaccaggtcctcggcttccgggaccggctgaagccctgcagagcacggcaggagcacacctcggccgagagcctgatggagtgcatcctggagagcttcgccttcctcaatgccgacttcgccctggatgagctgtccctgtttgggggctcccagggtctccgaaaggaccggcccctgcccccaccgtcatcactgaaagcgtcatccagggaactcacagccggtgccccagagctggacgtgctgctgatggtacacctccaagtctgcaaagctctgctgcagaaactggcctcccctaatttatcaaggctggtccaggaatgcctcctggaagaagtggcacagcaaaagcacgttctggagacactttctgtccttgactttgagaaggtcggcaaggcaacatccattgaagagatcatcccacaggcctcgcggacgaaggggtgcctgaagctgtggagagggtgcacagggcctggcagggtcctgtcctgccctgccacgacgctgctgaaccagctcaagaaaaccttccagcacagagtcagagggaagtacccaggacagctggaaatagcgtgccgcaggctcctggagcaggtggtcagctgtggtgggctgctccccggagctgggctcccagaagaacagatcattacctggttccagtttcacagctacctgcagaggcagagcgtctctgacctggagaagcacttcacccagctcaccaaggaagtgacactcatcgaggagcttcactgtgcgggacaggccaaggtggtccggaagctgcaggggaagcggctgggccagctccagcctctgccccagaccttaagagcctgggcgctgctccagctggacggcactccgagggtgtgcagggcggccagcgctcgcctggctggtgcagtcaggaacagaagcttccgggaaaaggctttgctgttctacaccaacgccctggcagagaacgacgcaaggctccagcaggccgcatgcctagcgctcaaacacctcaagggcattgaaagcatcgaccagactgccagcctgtgccagtctgacctggaggccgtgcgggcggcagcccgggaaaccacactgtcgttcggtgaaaaaggacggttagcttttgagaagatggacaagctctgctcagaacaaagagaagtcttttgccaggaggcagatgttgaaatcacaatattttaaaaaatcctggctgatgagcacaaatctcacatcgttttttttgctgctgcccagcctggacatagcctgcactctgggtaatggtgctgtgcactcctccaggagtgtgagctgcccagagctctacctgagactccggccattgacccagccccagggcatgggctggtcttttgtacagaggcagaaaaaagcaaggcaaaggtacagcattccaggggctgcacggcctcaacagagcgctcaacttctggctgagggtctgtgtgaccttccccgagatgcagagctgagccaaactaggtggccacctacaaaagggccaaggccaggcaagttgaggccctaaataaaaggctccaaggcaagtgtgtagaactccaggcctcgctgccggtcagctgctcggcacttctgcgtcaagaggcactg

SEQ ID NO: 3696 - DNA, 1754 bp, Homo sapiens
actaagtggttagttgcctgctgagtagacataaacacctgctaaagaaatgtgaaaagagtggaaacgtgctatttggaggttattttcctagtcgacatccaggagatctccagagatctatttcagccccacctgttgatttcatcatgaaaaggaggaagctcaaactgaagtgagttaaaaacttcatctcctagagaggactgtggctcggcctgagttgagtttttttatgtttatgtgcaagcgcaatgaagaagaacaccagcaagactaccatgaggatcaataagcaagatgctctctgcaccccacactcccatgatccgagagatcttcaaaatatgttggatggaggagagtatgccccttttgtatctcctcccatgttagagagcaattttatccaggtcaacagaagaggtgaatccatttaccttcataaccgagccaactgggtgaccgtaggcatctgtttttccagctccacccacaagatccccaatgtgatgctactggcccatctgacacctggtgcccaaaaagatacagaaaccctgtttaaaagtctcctgacatctcctcctgcagagaaactagtgctcaccaggtttctccctctgcagtttgtgactctttctgtgcatgatgcggagaacatgagcctgaaagtaaagctggtgagtggtcgagcctactacttacagctctgcacctctgcatataaacaggacaccttgttttctcaatgggtggccctcatctccctcttgaatcaggagaaagccaaagtttccaaagtgtcggaggtttcaagtctctcaggaattacgaatagcacagacatcacaggctccatggatgtgacggatgtcaccacgttcacagccatcctgaccccgtacatgtatgcaggtacaggccctgaacatgtcagggacagcatagatttcccagaattcacagacatcaccgacatcacagatgtcacagatcttccagaaaatgaggtcccagaggtcccggatgtaagaattgtcacagaagtcatagaagtcagagaagccacggaagtcacagacagctctgatattacaaactgctcgggagtcacagtggtgtttgaaaacaatgacttaatcagggccaagcaagaggagaaggaaaaattgaaaaacattctgaagcctgggtgtttacaagatacaaaaagtaagagtgagttgaaagaatcctcaaaacatgtcaccatctcaaacataacactgacttttgaaggtaaaagatattttcaaactaccttgaccccagtagaaagtgaggcaaatacatccaaggagatgaaggataagacctctgaagaaaagatgcctgattttcagagcacagctctcaaggctgaagaatccaggagcttgagaactgaatcaaacacttcagttctctcccctcatatcaaatctccttctaatttcctcaaacttgtgcctcatctgtctgcccctttctcaagggaatgaatgtgaggaaagaaaagtaaaacagaaaaagacaaagttgatggaaaaacatgtaagacaaactaaagacatttgaattaaatgaactgacttctccacctttttttaaaatcagatacaaactactaaactaaaaagcaaacacagctcagggaaagacaatcagtgcaagaggaaaaccaagcagtgtcttctacgtggcagaaataaagcctatgactaatcattacg

SEQ ID NO: 3697 - DNA, 2332 bp, Homo sapiens
aaatatggctgcacagggggtttaggcagagagggtcgtcacttcctgtcactaggactacagtttgtagtctctctcagggagagagactacaaactgtaattaaaaaaatcagaggtggaggtcagggggttaggtccagaagaaaacctctctggagcccaccctgcatctctacgtcttggaagagtctggagtccaggcaccctacagcaccccccacagcaatcatccgtgctcccacccccaccccggcctctgggaggctctgaggcaacagtgggggcctgtggggtggggtgggattgagagaccagctgcagagacatctttgtgacccaggagcaccactggtccctcatctgccaccgaggccaaggaagacccagagacctgcctcaccagtgctgccgttgtgctgaaagacaaccatgaatgctgattttctgctgccgtattatacggcccagagtggctccagcatgagcatgttcaacaccaccatggggaaactgcagcgacaactgtacaagggggagtacgatatattcaagtatgcaccgatatttgagagcgactttatccagatcaccaaaaggggagaagtgattgatgtgcacaaccgtgtccgtatggtgaccatgggcattgcacgtaccagccccatcctcccactcccagatgtcatgctactggcacgaccggccaccggctgcgaagagtatgctggacatggccaggccaccaagagaaaaaaacgcaaggcagcaaagaacttagagctcaccaggcttctgcccctgaggtttgtacggatctctgttcaagaccatgagaaacaacagctgcgcctgaagttcgccactggcagatcttgctatctgcaattgtgtcccgctcttgacacacgggatgacctctttgcctattgggaaaaactaatttacctcttgcggccacccatggagagtaacagcagtacctgtggcattccagctgaagacatgatgtggatgcctgtgtttcaggaagacaggaggagcctgggagccgtgaaccttcaaggaaagggggatcaggaccaggtcagcatccaaagcctccacatggtctctgaggtgtgtggggccacctctgctgcttatgctggaggggagggactccaaaatgactttaacaaacccactaatgtgctcaatgcatccatccccaaaacatctacagaacttgctgaggagccagcaacaggggggattaaagaggcagcagcagcaggggcagctgcaggggcagcaacaggcaccgtagcaggtgccttgagtgtggcagcagccaattctgcccctggacaggtgagcgcagccatagctggggcggccaccatcggtgcaggaggaaacaaaggcaacatggcccttgcaggcactgccagcatggctccaaacagcacgaaggtggctgtggcaggggctgcaggcaagtcctcagagcatgtttccagcgcatccatgagcctttcccgagagggcagtgtgagcctggccattgcaggagtagtactgaccagcaggacagctgcagaagcagacatggatgcagcagcgggacctcccgtctccacccggcagagcaagagcagcctgagtggacagcatggaagggagcgaacccaggccagcgctgaaggctgcaaggaggggagggaaagaagggaaaaggacagggctctcggaaggagttcccatcgccgcaggacaggtgaaagccgccacaaaacaaggggagacaagattgcccaaaagtcctccagcaggtcctcattcagccacagagccaatagagatgacaaaaaggagaaaggctgtggcaacccggggagcagcaggcacagggactcgcataaaggtgtcagccacacgcccatctcaaaggagtccaggacctctcacaaatctgggaggagcttatggaccaccagttccggttccagcaagggacttggcagggtcagctctttcctgaggaacgtcagagccaaccttactacaaaagtagtgggcacaccacatggcagagatgtgaacgtcatggctaagatggcggagaggagcaccaacgtggccatcgccgagacagcagagggtggccaggggctggagacggttggttctatgacaccggacatcatggagacagtgacctttgaagcccattaaataagacccagagctggaagctgcaaaggagcccagagctcatgggagtgtccctggaaagcctattccagcgttctttactgccgtttaaataaagaatcatacatctgaaagtg

SEQ ID NO: 3698 - DNA, 1571 bp, Homo sapiens
aaatatggctgcacagggggtttaggcagagagggtcgtcacttcctgtcactaggactacagtttgtagtctctctcagggagagagactacaaactgtaattaaaaaaatcagaggtggaggtcagggggttaggtccagaagaaaacctctctggagcccaccctgcatctctacgtcttggaagagtctggagtccaggcaccctacagcaccccccacagcaatcatccgtgctcccacccccaccccggcctctgggaggctctgaggcaacagtgggggcctgtggggtggggtgggattgagagaccagctgcagagacatctttgtgacccaggagcaccacatggtctctgaggtgtgtggggccacctctgctgcttatgctggaggggagggactccaaaatgactttaacaaacccactaatgtgctcaatgcatccatccccaaaacatctacagaacttgctgaggagccagcaacaggggggattaaagaggcagcagcagcaggggcagctgcaggggcagcaacaggcaccgtagcaggtgccttgagtgtggcagcagccaattctgcccctggacaggtgagcgcagccatagctggggcggccaccatcggtgcaggaggaaacaaaggcaacatggcccttgcaggcactgccagcatggctccaaacagcacgaaggtggctgtggcaggggctgcaggcaagtcctcagagcatgtttccagcgcatccatgagcctttcccgagagggcagtgtgagcctggccattgcaggagtagtactgaccagcaggacagctgcagaagcagacatggatgcagcagcgggacctcccgtctccacccggcagagcaagagcagcctgagtggacagcatggaagggagcgaacccaggccagcgctgaaggctgcaaggaggggagggaaagaagggaaaaggacagggctctcggaaggagttcccatcgccgcaggacaggtgaaagccgccacaaaacaaggggagacaagattgcccaaaagtcctccagcaggtcctcattcagccacagagccaatagagatgacaaaaaggagaaaggctgtggcaacccggggagcagcaggcacagggactcgcataaaggtgtcagccacacgcccatctcaaaggagtccaggacctctcacaaatctgggaggagcttatggaccaccagttccggttccagcaagggacttggcagggtcagctctttcctgaggaacgtcagagccaaccttactacaaaagtagtgggcacaccacatggcagagatgtgaacgtcatggctaagatggcggagaggagcaccaacgtggccatcgccgagacagcagagggtggccaggggctggagacggttggttctatgacaccggacatcatggagacagtgacctttgaagcccattaaataagacccagagctggaagctgcaaaggagcccagagctcatgggagtgtccctggaaagcctattccagcgttctttactgccgtttaaataaagaatcatacatctg

SEQ ID NO: 3699 - DNA, 1796 bp, Homo sapiens
agcagtggatggttcaggttgggaagaagagcagtgggattgccagttaaggttgtggaatcaaagagcaaaggctgttgtgaagtggaatatcaggctcaaatggaggtccctcccgaatgagcactgacacctgtgtgcccggacatccacgagggccccaacacctgtgctcctgacagctccatgcactaagcagggcacagtctggatccaggggactgactgtctctggcattgagcggttggtaatcaataccccaccctccctgttctcagtcacttggggacaaaaaagaaagcctgcagaacacgactgctggcccacctgccagagtagccaaggaaacaggatgcccgctaaagcatgttaaggaaggtgtggagcagctgctgggaactgtcttgatttaaaggaagacatggaggactgctgtatgctaccgtattacacggcccaaagcagccccgcaatgggcatgtttaacacctccatggggaagctgcagcggcaactgtacaaaggcgagtatactatattcaggtatgcacccatgtttgagagcgactttatccagatcagcaaaagaggagaagtgattgacgtgcacaaccgtgcccgaatggtaacaatgggcatcgttcgcaccagcccctgcctcacactacctgatgtcatgctgctggcccgaccagctgctgtctgtgacaatgccaggtgtggtcctgccacccagaaaagagaaagtccgcctgcagagatcttagaactaaccaggctgcttcccttgatgtttgtgaaaataaccatccacaacagcgtaaaaaaacagctccacctgaagcttgccacgggccgctctttttatcttcagctgtgtcctccatcggatgcaagtgaagacctttttgttcactgggaaaaccttgtttacatcctgagaccaccagtggaggcttacagtgataccagggctatcctagctgggaacacattggactcatctgtgttggaggaagtgcagaggagcccagtgggatatgccatgaagttttgtgaagagaaggagcaattcagaatcagtagacttcacatgaatgctgaaatgtttgggtccacctattgtgattatacaatagagatatgaatccaacatacctcccacatatactacgttcaagagttcacacacccctgcagtcataaaacctatagtgcctgatgaaggggcagggtagcaacagcagtagtgatgacagtaagcaccaccacaggtaccatggatgtggctgcaaccaagtctgcagactcaggagagaaacacagcactggcaaaagcagccttcagaggtccaggaggaagtatagccagcatggctattagtgggtgcttccatgtcttaatcttgttatagcaagggctgcatgcacattcttgtcctaaaagggtacttcaagcatatcagtaagtgctactggcctctccctagagagcagtatgaatgtggtggctacaggagcagagagatactgagaaggctgttgcattgacagtatctctctgctactcaaaggctgactctctgctactcagcattgggagtcagttatctcaactctgcaggatgaggccacatgcgtgaatgggatggaagccagagggtctctacctagctggattgactctgcagtaataacctcaaagcccagtactacacatggtgcagaggtggacatctcacctaagactgtggaggggaacaatgtgattcaccataataaaatccatcaactc

SEQ ID NO: 3700 - DNA, 1223 bp, Homo sapiens
gcctccttccgtctgtaactcacctaaagacccaagacctgcgacatccgtagaccgcgcccgctatgcacagctaaagagcactcacccctcgcgcaccagtcccggcccggcagccgctgccccgggctcgactgggcgctgctaccgccatcagcaagagcaggagcagccgggttgccccagcgctggctgccgccatctcggcttcttcccaccagcgaagggacggctgtgagccaagagccgcggagcacgccgggaggaacaggccgcatcctgacgcccgtgcgcctgcgctgggccccggcacctgcgcactggcacccgtccgcacctggggcctgacgtcagcaggatggggccgcccctttggcctgatctccaggagccgccccctccagggacgtcatcacaaatcaggagcccgctcttgtgtgacgtcataaagcccgctccgcatcatgacgtcacagtgcgcgtagtcccgccccctcgctttctccctctgctcctccgtccgctcccgtcggacggggacattgcaatgaggcgggatcgcggccctaagccggccctgggtggagctggcgaggtggaaccaggtgggatggcagcctctcccacgggccgtcccagacggctccaacgctacctccagagcggcgaattcgaccagtttcgggacttccccatctttgagagcaacttcgtacaggtgactcggttgggagaagttgccaacgaggtcaccatgggggtggcagcctccagtccagccctggagctcccggacctattgcttctggccggccctgccaaggagaacggacacctgcaactcttcgggctgttccccttgaagttcgtccagctctttgtccacgacaaaagccggtgtcagctcgaggtcaagttgaacaccagccgcaccttctacttgcagctgcgggccccactcaagacccgagaccgagagttcggccagtgggtgcggctgctctaccgcctgcgcttcctctctgcttctgctgtgcccttcacgcaggagtaagagccccaaggcgtggaagccagacttgaccccaagacctctgaactctggggactctgagtcttccagcatccttcaaggtcaccgaatgaccagagatcaaagtaccttgcctcagggccgggcagatgagatattaaagttaataaaggtcagtccattaagaacc

SEQ ID NO: 3701 - DNA, 1271 bp, Homo sapiens
gcctccttccgtctgtaactcacctaaagacccaagacctgcgacatccgtagaccgcgcccgctatgcacagctaaagagcactcacccctcgcgcaccagtcccggcccggcagccgctgccccgggctcgactgggcgctgctaccgccatcagcaagagcaggagcagccgggttgccccagcgctggctgccgccatctcggcttcttcccaccagcgaagggacggctgtgagccaagagccgcggagcacgccgggaggaacaggccgcatcctgacgcccgtgcgcctgcgctgggccccggcacctgcgcactggcacccgtccgcacctggggcctgacgtcagcaggatggggccgcccctttggcctgatctccaggagccgccccctccagggacgtcatcacaaatcaggagcccgctcttgtgtgacgtcataaagcccgctccgcatcatgacgtcacagtgcgcgtagtcccgccccctcgctttctccctctgctcctccgtccgctcccgtcggacggggacattgcaatgaggcgggatcgcggccctaagccggccctgggtggagctggcgaggtggaaccaggtgggatggcagcctctcccacgggccgtcccagacggctccaacgctacctccagagcggcgaattcgaccagtttcgggacttccccatctttgagagcaacttcgtacagttctgccccgacatctatcctgccccgacctctgacctctggccccaggtgactcggttgggagaagttgccaacgaggtcaccatgggggtggcagcctccagtccagccctggagctcccggacctattgcttctggccggccctgccaaggagaacggacacctgcaactcttcgggctgttccccttgaagttcgtccagctctttgtccacgacaaaagccggtgtcagctcgaggtcaagttgaacaccagccgcaccttctacttgcagctgcgggccccactcaagacccgagaccgagagttcggccagtgggtgcggctgctctaccgcctgcgcttcctctctgcttctgctgtgcccttcacgcaggagtaagagccccaaggcgtggaagccagacttgaccccaagacctctgaactctggggactctgagtcttccagcatccttcaaggtcaccgaatgaccagagatcaaagtaccttgcctcagggccgggcagatgagatattaaagttaataaaggtcagtccattaagaacc

SEQ ID NO: 3702 - DNA, 3182 bp, Homo sapiens
gctgtccaccctggcagggccatggcggaggcccgagtctcccagcctggggcatctccacgctctgtaacgctgagctccaggcacccgtgaagccccacgggtcaaggctggtgggccggggctgggaggcctgcacgcctgggttctgggtccctaaaccagtacccatccaccacagccaccatgatctggcttcgaaacaggaggtgccttgagccgctccagggcaccccgaagtgggtccctgttctgggggagctgcaaaagaccctccagaagggcgagtacctgcccctccgtccgctgcccatgttcgagagtaactttgttcaggtgacccatcaagggggcccagtgttcgtgaatcacagaaccaaccggctggccatgggcgtggccgcctccctgccaggcctggtgttgcctgacatcttgctgatcggccagcccgccgaggacagggactgctccggcctcgtgctgaccaggatgatccccctggacctcgtccacctctgcgtccatgacctctctgcctggcgcctgaagctgcgcctggtctcgggccgccagtactacctggccctggacgcccctgacaacgaggtgggcttcctgttccactgctgggtccgcctcatcaacctgcttcaggagccggctcccacctggacccccaggaccacgcgcacggcccccctggatatgccgctggccgaagcgcctgcctccacctggcacctgcaggaccagcccatcagcagacatgcagtcagggttgctgagcgcaactttccgcataagacggtggctgctcagagacagaggaaggccaaggcgctcaagcgcagtttcaagtctcaggccgtgggcgactctgtgcccctcatctggtcgcagctggagcatgctgacgtcaggaagaaacctgcagaaaagaagtcccactcagacccccgccccgacagaactcacacccaaatccgcttgcctgagaagaccagcatcaccacctggaccatcttcagcatcatttccagcaccgccaaccagacacagtcctctccaaaggcctgcacatctgcatctgatgaagccacaggccagggacatgtggttgagagcccttcacactgtgtctcagctgacagccctgatggcttctttctgggctcctgcagctccctggacccgtgcctgtggcatcaggacacggaagacctcatggactctgggggcagcactttgtcgtctgctgcctccggtctggctccctatcccccggctgcctgcctctccacaccctactcttccatccccaggggcagggaaaaggccgggcctatgggctcccaccaggggccggggccaccaccctgccagaaggccccatctggccttgtcacatcttgtaaggcaccgttccttgttgaccagtcccagaagctcccagctgtacctgcttcatcgtggaaacccccacctggattggctcctccccagaaggccccagctgcgtcagctcctccccggaaggccccagctgtacctgctccatcccagaaggccccagccgtacctgctccatcccagaaggccccagccatacctgctccatcccggaaggcctcagctgcgtcagcttctccccgaaaggcctcagccgtacctgccccaccccagaagaccccacccccatctcagaaggccccatctgtacctaccattccccagaaggctgtgtcccccactgctccaaagaagaaatctctactcctccctgccccatcccagaaggctctgccaacctcacctaccgaataccagatggcgctgagcccgcctgcctcacgggggaagctccctggcgattttgacgtgttgccaacaggaattcctggaagagccgtgctggagagaagccagtctggagggaaaccggagccggtggtgacggtgcgcacccaggagacagacgtggtggagatgacgactcaggccaagtccccggagtcgcccttcaccgtgaccaagaaggagtccaaggacatcctgattagccaaaccaaggaggtgaccctggaggccttcaggggccaggggaagttggaggactgggcccactgggcgaagcttgaagagaggtccccggacctgcctggcgtgagatccaaggagttggagcagcggaagagatgggtcaaggccaaggaactggccgtcgagggcccctcccaggagcacagcaggcccttctctgtggaagcgctcaccctcaccaagctcatgatcacggccaactccaaagagcagccctcgaaatccgctttggtctcacttccctcctggctcttggcgactccgcaggcgtcggccacgtcaatgatggcttcagtgccctcccgccccggccagctgtccttactggaggggaagccagtggtggtcagagagcagccagagtcgcacacctgggtgaaggagggcaagcggccatggggcgagatgaaggagcagccatggggcgagatgaaggagccaccctgggaccccaaggggccacccaaggtgccctttcgctccaagcccacctctgccagtctgaagagggaaggaatctcccaggcgcctatccccctgaccgcctcaccgtgggaggacttacggccatcgcccctctcggagaccctcatctcaaagatggaggccacagccagggcgtcccagcagcccaagagggtgtcgcaggagcccatgaggatgccagcccagcaccccctggccactgtggggtcgtcttcagaaattcttttgcccatgctcttagaacttgaaactgtgaggaacacggccaccaaggcagaggagatacaggaggaatcgggcgtcttgaaccttctgcccagcctgcagcactcccagcactccgagtggccggatgcgggggcttaacctcagttggaaactgtccagaggagcccagcgctgccaggccccgagggttctgtgcgcaccgactgtaggaagcggaatgttgaaagccgcttggggggatttgccccctctggtagataccagaactatggatatgcctttatatattggggggcgggggggggcgggggcgagcccgtggagccgcccaacttcgcagagattaaagcttgagcctgagactc

SEQ ID NO: 3703 - DNA, 1598 bp, Homo sapiens
ggagacagagatcccaggacaaatgtgcagcaggcccctgagcatgtgtagaaatgttgtcatcatttccacatagaaagacttggaggaaatcaaagaagacagtaaaagtcacaagatcctatccaaccttcccttccctgaatgcctgggaagaattcaggggcctcttgcctgtggatggagagccgaaccctggagcgggcctaggtgtggaggagggactgctctgccgggtggttcattctccagaattcaacctgtttcttgactccgtggtgtttgaaagcaacttcatccaggtcaaaaggggcaggaattggagagacgtctacaaagcttccaacaccatggccctgggggtgacctcctcggtaccctgcctgcccctccccaacatcctactcatggccagtgtcaaatggcaccaggggcagaaccagacatggaacagaccatccatagcccccaacatcttcctgaagaggattctcccattgaggtttgtggagctccaggtatgtgaccactatcaacgcatcctgcagttgaggacagtcactgagaagatttattacctaaagctccatcctgaccatcctgagactgtcttccacttctggatccgactggttcaaattctgcaaaaggggctgtccatcaccaccaaagaccctaggattcttgtcacgcactgcctggtacccaagaactgcagcagcccctcaggagattcgaagttagtacagaagaaactccaagcctcccagcccagcgagagtctcattcagctaatgaccaagggggagagtgaagccctgtctcagatttttgccgacttacaccagcagaaccagttgagtttcaggagcagcagaaaggtggagaccaacaagaacagctcagggaaagattcttcccgtgaagacagcatcccttgcacctgtgacctacgttggagggcttcattcacgtacggagagtgggaaagagagaacccctccggcctgcagcccctctcactactcagcactctggcagcctccaccgggccacagctggccccacccataggaaattctatttgagccacccttccgcactggggagaatctatgcaagcctcgtcaacaccactttgcagcattcagctgctgagggattatcgggatggagagtaggagaaaactgcaaccaaggaagaatagagtcatctcacggtgacagcagagcctttccagctgtacataaccacgtcctcgccactgcacctcggcatatgccacctccatgccactgccagagctggcctagcaagatgtgctctcagaatggccgggcccaagagatgaaggaaaggagtgaaagggaagtaggaccagagaagtggaaggaagcaaaatggaggtgatgagaaaggtggtgggagaaagtcagcagatgagagacacaaagagaagtggtaataggaaacggaagagacttggtagacgagataaggaggacaagagaagggacacacccctgagagatgctcaccaagcttctatttatctaatttaaaacttgaaagtaaagccataaacaaaaaaaagaaa

SEQ ID NO: 3704 - DNA, 1105 bp, Homo sapiens
aggaaatgctggggaggtgggggcagatcacatcaacatcctggcattgggctgggtcggcgtggagccccagaaatgttcccaagcccattcttaccaagaaccaatgagtaaaatcaggggcctcccacctgaggtcagggaaccaggccctggagtggaacttggggtggaaaatggccttctttgtcaactgattcattctccagaattcaatttgttctccaactcggtggtgtttgaaagcaactttatccaggtcactaagcccgggaactggagagatgtctgtgaagggtctgccaccgtgatcctcggggtcacctcctcggtgccctccctgccactccccaatgtcctcctgatggccaatgttacctggccccagggtccatttaccacctggagcacacctggtgacgccccagtcatcaacctcagcaggcttctccccctgaagtacgtggagctacgaatctacgaccggctccagcgcatcctgagggttaggacagtgaccgaaaagatctactatctgaagctccacgaaaaacacccagagattgtgtttcaattctgggtccgcttggtgaaaattctgcagaaaggcctgtccatcaccaccaaagacccgagaatcaaattcactcactgcctggtgcccaagatgcccaccaactccacagaaacaacacctgaaaacagcctcctgtcatccccccagcccagcgagcccctcgtgctgctggcggctgagcagaccagtggcagtttctcacagctctcaggaaagccccagctcacagcagacaggaacaatgacactgccattgaaatagacaactgcagcagctacaagataccctctccagtggcatctccaatcaatttgaatatacccatgagagctgccttgagccacagcctctgggaacaagaggactggaatgagcaccttctacaagttcatatagccagttacctaggagagcacttcttgggagcctgacacctaggcaaaacatgctcttccttgcatacgtgtacttgctaccacctcttataatgctccttttccactgtgagccaagtgaccttgggagag

SEQ ID NO: 3705 - DNA, 1582 bp, Homo sapiens
ggaaatgctggggaggtgggggcagatcacatcaacatcctggcattgggctgggtcggcgtggagccccagaaatgttcccaagcccattcttaccaagaaccaatgagtaaaatcaggggcctcccacctgaggtcagggaaccaggccctggagtggaacttggggtggaaaatggccttctttgtcaactgattcattctccagaattcaatttgttctccaactcggtggtgtttgaaagcaactttatccaggtcactaagcccgggaactggagagatgtctgtgaagggtctgccaccgtgatcctcggggtcacctcctcggtgccctccctgccactccccaatgtcctcctgatggccaatgttacctggccccagggtccatttaccacctggagcacacctggtgacgccccagtcatcaacctcagcaggcttctccccctgaagtacgtggagctacgaatctacgaccggctccagcgcatcctgagggttaggacagtgaccgaaaagatctactatctgaagctccacgaaaaacacccagagattgtgtttcaattctgggtccgcttggtgaaaattctgcagaaaggcctgtccatcaccaccaaagacccgagaatcaaattcactcactgcctggtgcccaagatgcccaccaactccacagaaacaacacctgaaaacagcctcctgtcatccccccagcccagcgagcccctcgtgctgctggcggctgagcagaccagtggcagtttctcacagctctcaggaaagccccagctcacagcagacaggaacaatgacactgccattgaaatagacaactgcagcagctacaagataccctctccagtggcatctccaatcaatttgaatatacccatgagagctgccttgagccacagcctctgggaacaagaggactggaatgagcaccttctacaagttcatatagccagttacctaggagagcacttcttgggagcctgacacctaggcaaaacatgctcttccttgcatacgtgtacttgctaccacctcttataatgctccttttccactgtgagccaagtgaccttgggagaggtaagatggtgtttccaacaaggtgcttctctacttccaccaataaacttccaagctgtacaggaagcatgactggggaggcctcaggaaacttacaatcaaggcagaaggcaaaagagaagcagacctgtcctacgagtctggagcaggagaaagaaagaagtgggaggtgctatgcacttttaaacaaccaaatctcgtgagaactcactatcatgagaacagcaaggaggaaatccacccccatgatccaatcacctcccaccaggcacctcctccaacactggggattaaattcaacatgagatttgggcagggagacagatccaaatcatatatcagtctgctcagttgaaaccacacaatagccaagcaaagccaagaaagccagtccaaggctggcttggaaagggcctctgaggagaaatcaactttcaaaggggcagggggaaatagaggttgagctactgcaagccca

SEQ ID NO: 3706 - DNA, 1529 bp, Homo sapiens
aggaaatgctggggaggtgggggcagatcacatcaacatcctggcattgggctgggtcggcgtggagccccagaaatgttcccaagcccattcttaccaagaaccaatgagtaaaatcaggggcctcccacctgaggtcagggaaccaggccctggagtggaacttggggtggaaaatggccttctttgtcaactgattcattctccagaattcaatttgttctccaactcggtggtgtttgaaagcaactttatccaggtcactaagcccgggaactggagagatgtctgtgaagggtctgccaccgtgatcctcggggtcacctcctcggtgccctccctgccactccccaatgtcctcctgatggccaatgttacctggccccagggtccatttaccacctggagcacacctggtgacgccccagtcatcaacctcagcaggcttctccccctgaagtacgtggagctacgaatctacgaccggctccagcgcatcctgagggttaggacagtgaccgaaaagatctactatctgaagctccacgaaaaacacccagagattgtgtttcaattctgggtccgcttggtgaaaattctgcagaaaggcctgtccatcaccaccaaagacccgagaatcaaattcactcactgcctggtgcccaagatgcccaccaactccacagaaacaacacctgaaaacagcctcctgtcatccccccagcccagcgagcccctcgtgctgctggcggctgagcagaccagtggcagtttctcacagctctcaggaaagccccagctcacagcagacaggaacaatgacactgccattgaaatagacaactgcagcagctacaagataccctctccagtggcatctccaatcaatttgaatatacccatgagagctgccttgagccacagcctctgggaacaagaggactggaatgagcaccttctacaagttcatatagccagttacctaggagagcacttcttgggagcctgacacctaggcaaaacatgctcttccttgcatacgtgtacttgctaccacctcttataatgctccttttccactgtgagccaagtgaccttgggagaggctgtacaggaagcatgactggggaggcctcaggaaacttacaatcaaggcagaaggcaaaagagaagcagacctgtcctacgagtctggagcaggagaaagaaagaagtgggaggtgctatgcacttttaaacaaccaaatctcgtgagaactcactatcatgagaacagcaaggaggaaatccacccccatgatccaatcacctcccaccaggcacctcctccaacactggggattaaattcaacatgagatttgggcagggagacagatccaaatcatatatcagtctgctcagttgaaaccacacaatagccaagcaaagccaagaaagccagtccaaggctggcttggaaagggcctctgaggagaaatcaactttcaaaggggcagggggaaatagaggttgagctactgcaagccca

SEQ ID NO: 3707 - DNA, 2147 bp, Homo sapiens
aggaaatgctggggaggtgggggcagatcacatcaacatcctggcattgggctgggtcggcgtggagccccagaaatgttcccaagcccattcttaccaagaaccaatgagtaaaatcaggggcctcccacctgaggtcagggaaccaggccctggagtggaacttggggtggaaaatggccttctttgtcaactgattcattctccagaattcaatttgttctccaactcggtggtgtttgaaagcaactttatccagacccatgtacctgaggctgatttccaggtcactaagcccgggaactggagagatgtctgtgaagggtctgccaccgtgatcctcggggtcacctcctcggtgccctccctgccactccccaatgtcctcctgatggccaatgttacctggccccagggtccatttaccacctggagcacacctggtgacgccccagtcatcaacctcagcaggcttctccccctgaagtacgtggagctacgaatctacgaccggctccagcgcatcctgagggttaggacagtgaccgaaaagatctactatctgaagctccacgaaaaacacccagagattgtgtttcaattctgggtccgcttggtgaaaattctgcagaaaggcctgtccatcaccaccaaagacccgagaatcaaattcactcactgcctggtgcccaagatgcccaccaactccacagaaacaacacctgaaaacagcctcctgtcatccccccagcccagcgagcccctcgtgctgctggcggctgagcagaccagtggcagtttctcacagctctcaggaaagccccagctcacagcagacaggaacaatgacactgccattgaaatagacaactgcagcagctacaagataccctctccagtggcatctccaatcaatttgaatatacccatgagagctgccttgagccacagcctctgggaacaagaggactggaatgagcaccttctacaagttcatatagccagttacctaggagagcacttcttgggagcctgacacctaggcaaaacatgctcttccttgcatacgtgtacttgctaccacctcttataatgctccttttccactgtgagccaagtgaccttgggagaggtaagatggtgtttccaacaaggtgcttctctacttccaccaataaacttccaagtgagtccctaatttttgcaggttgggctatagggaggctccagtttgggaaaggactgactgagaacaggagcagtttttggaaaaataggtgggaaaagttactgtctgtgtgtacagagaactacctgagactgggtaattttatttatttatttatttatttatttatttattttggagatagagtcttgctctgtctccaggctggagtacagtggtgcgatcatggctcactgcaacctccacctcctgggttcaagcaattctccagcctcagcctcccaagtagctgggactacaggcacacactacacctggctaagtttttatattttagtagagatggggtttcaccacgttgcccaggctggtctccagctcctgagctcaggccatccagtcacattggcctctcaaagggttaggattacaggcgtgagccaccaggcccagcctcgagtctgggtaatttataaagaaaagaggtttaattggctcatggttccccaggctgtacaggaagcatgactggggaggcctcaggaaacttacaatcaaggcagaaggcaaaagagaagcagacctgtcctacgagtctggagcaggagaaagaaagaagtgggaggtgctatgcacttttaaacaaccaaatctcgtgagaactcactatcatgagaacagcaaggaggaaatccacccccatgatccaatcacctcccaccaggcacctcctccaacactggggattaaattcaacatgagatttgggcagggagacagatccaaatcatatatcagtctgctcagttgaaaccacacaatagccaagcaaagccaagaaagccagtccaaggctggcttggaaagggcctctgaggagaaatcaactttcaaaggggcagggggaaatagaggttgagctactgcaagcccaaaataaaagaaatcctgagaagga

SEQ ID NO: 3708 - DNA, 1774 bp, Homo sapiens
ggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaactaatttccttcccaatattaggacttagaaaagctctaggtcccgcaatttgaattttagcctaggggaatcaaaatagtaggagcattactcttgtttcctttttcaaaatcccacacctcatccttcctgcgacgccatgtctaccaacatttgtagtttcaaggacagcgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctactttggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtgaagttgtgcttttcctctacttctacttcctctccccgacctttttctgcccagtgtaggtgtattcttaaattcagacaggggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaactaaagcgatttgcttaagccattgtacattataaagagctgttttgttttgctttgctttgctttgttttgtttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatga

SEQ ID NO: 3709 - DNA, 2398 bp, Homo sapiens
ggcaggaaaagcggaagagggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcgagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagggacgcttagcccgagatccgacagcagggaaccggagcgctccgggggaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaactaatttccttcccaatattaggacttagaaaagctctaggtcccgcaatttgaattttagcctaggggaatcaaaatagtaggagcattactcttgtttcctttttcaaaatcccacacctcatccttcctgcgacgccatgtctaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctactttggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtgaagttgtgcttttcctctacttctacttcctctccccgacctttttctgcccagtgtaggtgtattcttaaattcagacaggggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaactaaagcgatttgcttaagccattgtacattataaagagctgttttgttttgctttgctttgctttgttttgtttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtatagaa

SEQ ID NO: 3710 - DNA, 676 bp, Homo sapiens
ctaggctgggacccgggctgtccgccagggctgggagacactggaggaggccggccgatgattacgcgcgatgccaacgacgactgccctacggtggaccgcggctgcccgtgtgcggaggaaagggagaggcggctgggtgccggctgcgctgcggtccgtgagccaggacggagtcccaggctgtacagtgatgggcggagagactcgcagtcctgagaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacggacacttctggatgtttcacagccaggcagtttatgatattaacagactagactccacaggtgtaaacgtcctactttggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctc

SEQ ID NO: 3711 - DNA, 1773 bp, Homo sapiens
ggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaaactaatttccttcccaatattaggacttagaaaagctctaggtcccgcaacttgaattttagcctaggggaatcaaaatagtaggagcattactcttgtttcctttttcaaaatcccacacctcatccttcctgcgacgccatgtctaccaacatttgtagtttcaaggacagcgcagtggacttcactggaagatgctatttcaccaaaatctgcaaatgtaaactgaaggacatcgcatgtttaaaatgtgggaacattgtaggttatcatgtgattgttccatgtagttcctgtcttccttcctgcaacaacggacacttctggatgtttcacagccaggcagtttatgatattaacagactagactccacaggtgtaaacatcctactttggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaactgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaactaaagcgatttgcttaagccattgtacattataaagagctgttttgttttgctttgctttgctttgttttgtttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatga

SEQ ID NO: 3712 - DNA, 2374 bp, Homo sapiens
gagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcaagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagggatgcttagcccgagatccgacagcagggaaccggagcgctccgggggaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttgccacgctcccctgttcctactcaataaatacttcttctactccgccaccgggaaaacagaaaaaaaaaactaatttccttcccaatattaggacttagaaaagctctaggtcccgcaacttgaattttagcctaggggaatcaaaatagtaggagcattactcttgtttcctttttcaaaatcccacacctcatccttcctgcgacgccatgtctaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttccttcctgcaacaacggacacttctggatgtttcacagccaggcagtttatgatattaacagactagactccacaggtgtaaacatcctactttggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaactgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaactaaagcgatttgcttaagccattgtacattataaagagctgttttgttttgctttgctttgctttgttttgtttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtata

SEQ ID NO: 3713 - DNA, 882 bp, Homo sapiens
gggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcaagcacgctgagggccgggggttgccaggagaggggcccgcggacccgcagagcggaggaagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttccttcctgcaacaacggacacttctggatgtttcacagccaggcagtttatgatattaacagactagactccacaggtgtaaacatcctactttggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttccgtctctaattagttacctcagtttgattgaagccagtggagttgtgcttttcctctacttctacttcct

SEQ ID NO: 3714 - DNA, 740 bp, Homo sapiens
agaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcaagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtggtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttccttcctgcaacaacggacacttctggatgtttcacagccaggcagtttatgatattaacagactagactccacaggtgtaaacatcctactttggggcaacttgccagagatagaagagagtacagatgaagatgtgttaaatatctcagcagaggagtgtattagat

SEQ ID NO: 3715 - DNA, 1243 bp, Homo sapiens
tgggaacattgtagtttatcatgtgattgttccatgtagttcctgtcttctttcctgcaacaacagacacttctggatgtttcacagccaggcagtttatgatattaacagactagactccacaggtgtaaacgtcctacttcggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttctgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaaactaaagcgatttgcttaagccattgtacattataaagagctgttttgttttgctttgctttgctttgttttgttttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatga

SEQ ID NO: 3716 - DNA, 2393 bp, Homo sapiens
ggcaggaaaagcggaagagggagcgaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcgagcacgctgagggccgggggttgccaggagaggggcccgcggacccgcagagcggaggaaggtccgggagaaaaggggcgggacggaggagaatccgggatcgcctggcagaaaaagagaagggagtttctgaatcctgggaagaggaggcgtgggtagggacgcttagcccgagatccgacagcagggaaccggagcgctccgggggaggggcttaatgctggggaagggatgtcttaaaagaggagaagctttaaattagacgatcggagaaggctgagggaattgctatgaaggggcgggagctgaagtgtagaggactcctttagacagcagaaagggaaagccgttgagaagttcccttcaaactccacctgcctcctctccaattcaaactccactcccttctccaaaagttaaaaggaaagccaagtttaccacgctcccctgttcctactcaataaatacttcttctactccgccaccgggaaaacagaaaaaaaaactaatttccttcccaatattaggacttagaaaagctctaggtcccgcaatttgaattttagcctaggggaatcaaaatagtaggagcattactcttgtttcctttttcaaaatcccacacctcatccttcctgcgacgccatgtccaccaacatttgtagtttcaaggacaggtgcgtgtccatcctgtgttgcaaattctgtaaacaagtgctcagctctaggggaatgaaggctgttttgctggctgatactgaaatagaccttttctctacagacatccctcctaccaacgcagtggacttcactggaagatgctatttcaccaaaatctgcaaatgtaaactgaaggacatcgcatgtttaaaatgtgggaacattgtaggttatcatgtgattgttccatgtagttcctgtcttctttcctgcaacaacagacacttctggatgtttcacagccaggcagtttatgatattaacagactagactccacaggtgtaaacgtcctacttcggggcaacttgccagagatagaagagagtacagatgaagatgtgttaaatatctcagcagaggagtgtattagataaatggaattatgatatatatgatatacaaacttttttctatttaaaaatatattaatggatcaactttaaaattgttagttgccagtgatcttttttggaaaacaaaaatggggcatttgttgatttatttattttctgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtggtctgtcctaaatcttaaatagaaaaaaaaactaaagcgatttgcttaagccattgtacattataaagagctgttttgttttgctttgctttgctttgttttgtttttttaaagctgcattcagagctacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatagtacttaaagtat

SEQ ID NO: 3717 - DNA, 768 bp, Homo sapiens
ggaatgaagccatggtgggccagggactgggcgttacccagcagggggcagtgtgtgtgtcctggggagaccaatgcctgcctggatgcagagagggcttgtagagagtgcccgagaggcctggaggagacttgggacctgctttcacaactgcagagcctcctggggacacaccttgacaaaggtgactttggtcagctctctggtccagaacccccaggtgaggtgggcaaaagagcacctgatggagcctcccggtcctctcttgagcctatggaagatgctgctcccattatctacctgttagcttccccagatcctcgaatcaagcatcctcaggatctggcctccaccccatcaccaggcccaatgaccacctcagtctcctccctaagtgcctcccagccaccagaaccttcccttctcctagaacgcccctcacccaagccacctgcacttttcctcacccaccacacacccctgatcctctggcctgctctcctcctcctccaaaagacttcactgctcctcccctgtgggactccactctgataactccatttcactgtgactcagtggcacttccactgggcaccgtccctcaaagcttgtctccacatgaggatttggcggcttctgtcccagccatctcaggccttggcagctcaaacagtcaagtttctgccttctcctggtggcaggagactaccagaacctggtgcatcttcaattcatcagtctagcaagatcatctttcccgccacccac

SEQ ID NO: 3718 - DNA, 1050 bp, Homo sapiens
cggtgagcgcggcccgggccggacatggcggcgctctacgcctgcaccaagtgccaccagcgcttccccttcgaggcgctgtctcaggggcagcagctgtgcaaggaatgtcggattgcacaccctgttgtgaagtgcacctactgcaggactgagtaccagcaggagaggctagagtgcaatggcacgatctcggctcactgcaacctccacctcccaggttcaagcgattctcctgcctcatcctcccgagtagctgggattacaggcattaaaaccaatacaatatgcaagaaatgtgctcagaacgtgcagttgtatggaacgcccaaaccttgtcagtattgcaacataattgcagcatttattgggaataaatgccagcgctgcacaaattcagaaaagaagtatggaccaccctattcttgtgaacagtgcaagcagcagtgtgcatttgacaggaaagatgatagaaagaaggtagatgggaaattgctgtgctggctgtgcacactttcatacaaacgggtccttcagaagaccaaagagcagaggaaacacctgagtagctcttctcgtgctggccaccaggagaaggagcagtatagtcgcctgagtggtggtggccattataacagccagaaaacactttctacatcttcaattcaaaatgaaatcccaaagaaaaagtccaagtttgagtcaatcacaactaatggagacagcttctccccagacctggctctggactcaccaggcactgaccactttgtcatcattgcccaactgaaggaagaagtggctaccctgaagaagatgttgcatcaaaaggatcaaatgattttagagaaagagaagaagattacagagttgaaggctgattttcagtaccaggaatcgcagatgagagccaaaatgaaccagatggagaaaacccacaaagaagtcacagaacaactgcaggccaaaaaccgagagctcctgaagcaggcagctgctttgtccaagagcaagaagtcagagaagtcaggagctataacctctccatga

SEQ ID NO: 3719 - DNA, 992 bp, Homo sapiens
agataaatcggcgggccgggccggcgggtcggtgagcgcggcccgggccggacatggcggcgctctacgcctgcaccaagtgccaccagcgcttccccttcgaggcgctgtctcaggggcagcagctgtgcaaggaatgtcggattgcacaccctgttgtgaagtgcacctactgcaggactgagtaccagcaggagaggctagagtgcaatggcacgatctcggctcactgcaacctccacctcccaggttcaagcgattctcctgcctcatcctcccgagtagctgggattacaggcattaaaaccaatacaatatgcaagaaatgtgctcagaacgtgcagttgtatggaacgcccaaaccttgtcagtattgcaacataattgcagcatttattgggaataaatgccagcgctgcacaaattcagaaaagaagtatggaccaccctattcttgtgaacagtgcaagcagcagtgtgcatttgacaggaaagatgatagaaagaaggtagatgggaaattgctgtgctggctgtgcacactttcatacaaacgggtccttcagaagaccaaagagcagaggaaacacctgagtagctcttctcgtgctggccaccaggagaaggagcagtatagtcgcctgagtggtggtggccattataacagcttctccccagacctggctctggactcaccaggcactgaccactttgtcatcattgcccaactgaaggaagaagtggctaccctgaagaagatgttgcatcaaaaggatcaaatgattttagagaaagagaagaagattacagagttgaaggctgattttcagtaccaggaatcgcagatgagagccaaaatgaaccagatggagaaaacccacaaagaagtcacagaacaactgcaggccaaaaaccgagagctcctgaagcaggcagctgctttgtccaagagcaagaagtcagagaagtcaggagctataacctctccatga

SEQ ID NO: 3720 - DNA, 2273 bp, Homo sapiens
agataaatcggcgggccgggccggcgggtcggtgagcgcggcccgggccggacatggcggcgctctacgcctgcaccaagtgccaccagcgcttccccttcgaggcgctgtctcaggggcagcagctgtgcaaggaatgtcggattgcacaccctgttgtgaagtgcacctactgcaggactgagtaccagcaggagagtaaaaccaatacaatatgcaagaaatgtgctcagaacgtgcagttgtatggaacgcccaaaccttgtcagtattgcaacataattgcagcatttattgggaataaatgccagcgctgcacaaattcagaaaagaagtatggaccaccctattcttgtgaacagtgcaagcagcagtgtgcatttgacaggaaagatgatagaaagaaggtagatgggaaattgctgtgctggctgtgcacactttcatacaaacgggtccttcagaagaccaaagagcagaggaaacacctgagtagctcttctcgtgctggccaccaggagaaggagcagtatagtcgcctgagtggtggtggccattataacagcttctccccagacctggctctggactcaccaggcactgaccactttgtcatcattgcccaactgaaggaagaagtggctaccctgaagaagatgttgcatcaaaaggatcaaatgattttagagaaagagaagaagattacagagttgaaggctgattttcagtaccaggaatcgcagatgagagccaaaatgaaccagatggagaaaacccacaaagaagtcacagaacaactgcaggccaaaaaccgagagctcctgaagcaggcagctgctttgtccaagagcaagaagtcagagaagtcaggagctataacctctccatgacagacctcaaggaggctccctagcaacagcaaatggagttgtccagggttagggttggagacctggctgttctgtgggaattgcaagctttcttaagaaatctctattttattacagttatccttctttgtgcgattgcagtgggctgaatggaaacacctggtttgtgctgtgttagactgcatgcttgagtgtttgggatttcaagctcgctctctttctctcactattaggacttttctttttcttcttcctcttctctctattttggttctattctttttttttcttttttctttttttttttttttttttttttgtggtggtcactgctcagtgtaatgtgcagaatgatttgttttttgtttttttttttttttttggtccttcattgcatcctgccatacccatgagcaaacagtttggcattaattatatatcactgccaccctctgaactttgaaaactgccatcttcagacttggtataatggaagaggctttctctctccaataaaccttttgcttcagggtatactcttcggtttttttccagatgtattatgtatgaactttgtactatgtatagccagagttttatttattttttaaaaaagaaactttttcttgataaaggaataatggtggtctagctagttcttgtaaaagtgatgcctcttgaaaaaaaaacagtcctattcactagcttttagtaaaagaatcagatcttttctttcttgttaccttggagtcttaaaaactgattgctaaggtgaaacaattcaatgcataagtatggagctaagtgccttttggaggatttcttggaagagcatttatggagatacttaagggaggtagcaaagatttgaaccgtctgtctttttaagtaagggcagaaagcaaggttgtccaggttgtactggacacttctctccccacccctttcctgattgttttatgtgattgattttaaattctcacactgccacttctttaaaaaataaaatcctttatttgcttatatcagttgtcatactgggctgctgtcagagaatgtttttttacatgaatgaacagattaaaaatggaataatatggtcgggtgcggtggctcacgcctgtaataccagcaatttgggaggccaaggcgggtggatcatttgaggttaggagtttgagaccatcctggccaacatggtaaaaccccatctgtactaaaaaaatacaaaaattagccgggcctggtggcatgcacctgtaatcccagctacccaggaggctgaggcaggagaactgctcgaatcccgggaggcagaggttgcaatgagctgaaatcgcaacactgcactgcagcctgggcaatggagtgagactccgtctc

SEQ ID NO: 3721 - DNA, 2049 bp, Homo sapiens
gccgcagccagcagcctgcagccgccgccgggttgtgcctcagactgtcagataaatcggcgggccgggccggcgggtcggtgagcgcggcccgggccggacatggcggcgctctacgcctgcaccaagtgccaccagcgcttccccttcgaggcgctgtctcaggggcagcagctgtgcaaggaatgtcggattgcacaccctgttgtgaagtgcacctactgcaggactgagtaccagcaggagagtaaaaccaatacaatatgcaagaaatgtgctcagaacgtgcagttgtatggaacgcccaaaccttgtcagtattgcaacataattgcagcatttattgggaataaatgccagcgctgcacaaattcagaaaagaagtatggaccaccctattcttgtgaacagtgcaagcagcagtgtgcatttgacaggaaagatgatagaaagaaggtagatgggaaattgctgtgctggctgtgcacactttcatacaaacgggtccttcagaagaccaaagagcagaggaaacacctgagtagctcttctcgtgctggccaccaggagaaggagcagtatagtcgcctgagtggtggtggccattataacagccagaaaacactttctacatcttcaattcaaaatgaaatcccaaagaaaaagtccaagtttgagtcaatcacaactaatggagacagcttctccccagacctggctctggactcaccaggcactgaccactttgtcatcattgcccaactgaaggaagaagtggctaccctgaagaagatgttgcatcaaaaggatcaaatgattttagagaaagagaagaagattacagagttgaaggctgattttcagtaccaggaatcgcagatgagagccaaaatgaaccagatggagaaaacccacaaagaagtcacagaacaactgcaggccaaaaaccgagagctcctgaagcaggcagctgctttgtccaagagcaagaagtcagagaagtcaggagctataacctctccatgacagacctcaaggaggctccctagcaacagcaaatggagttgtccagggttagggttggagacctggctgttctgtgggaattgcaagctttcttaagaaatctctattttattacagttatccttctttgtgcgattgcagtgggctgaatggaaacacctggtttgtgctgtgttagactgcatgcttgagtgtttgggatttcaagctcgctctctttctctcactattaggacttttctttttcttcttcctcttctctctattttggttctattctttttttttcttttttctttttttttttttttttttttttgtggtggtcactgctcagtgtaatgtgcagaatgatttgttttttgtttttttttttttttttggtccttcattgcatcctgccatacccatgagcaaacagtttggcattaattatatatcactgccaccctctgaactttgaaaactgccatcttcagacttggtataatggaagaggctttctctctccaataaaccttttgcttcagggtatactcttcggtttttttccagatgtattatgtatgaactttgtactatgtatagccagagttttatttattttttaaaaaagaaactttttcttgataaaggaataatggtggtctagctagttcttgtaaaagtgatgcctcttgaaaaaaaaacagtcctattcactagcttttagtaaaagaatcagatcttttctttcttgttaccttggagtcttaaaaactgattgctaaggtgaaacaattcaatgcataagtatggagctaagtgccttttggaggatttcttggaagagcatttatggagatacttaagggaggtagcaaagatttgaaccgtctgtctttttaagtaagggcagaaagcaaggttgtccaggttgtactggacacttctctccccacccctttcctgattgttttatgtgattgattttaaattctcacactgccacttctttaaaaaataaaatcctttatttgctta

SEQ ID NO: 3722 - DNA, 1661 bp, Homo sapiens
gcagccgccgccgggttgtgcctcagactgtcagataaatcggcgggccgggccggcgggtcggtgagcgcggcccgggccggacatggcggcgctctacgcctgcaccaagtgccaccagcgcttccccttcgaggcgctgtctcaggggcagcagctgtgcaaggaatgtcggattgcacaccctgttgtgaagtgcacctactgcaggactgagtaccagcaggagagtaaaaccaatacaatatgcaagaaatgtgctcagaacgtgcagttgtatggaacggtagatgggaaattgctgtgctggctgtgcacactttcatacaaacgggtccttcagaagaccaaagagcagaggaaacacctgagtagctcttctcgtgctggccaccaggagaaggagcagtatagtcgcctgagtggtggtggccattataacagcttctccccagacctggctctggactcaccaggcactgaccactttgtcatcattgcccaactgaaggaagaagtggctaccctgaagaagatgttgcatcaaaaggatcaaatgattttagagaaagagaagaagattacagagttgaaggctgattttcagtaccaggaatcgcagatgagagccaaaatgaaccagatggagaaaacccacaaagaagtcacagaacaactgcaggccaaaaaccgagagctcctgaagcaggcagctgctttgtccaagagcaagaagtcagagaagtcaggagctataacctctccatgacagacctcaaggaggctccctagcaacagcaaatggagttgtccagggttagggttggagacctggctgttctgtgggaattgcaagctttcttaagaaatctctattttattacagttatccttctttgtgcgattgcagtgggctgaatggaaacacctggtttgtgctgtgttagactgcatgcttgagtgtttgggatttcaagctcgctctctttctctcactattaggacttttctttttcttcttcctcttctctctattttggttctattctttttttttcttttttctttttttttttttttttttttttgtggtggtcactgctcagtgtaatgtgcagaatgatttgttttttgtttttttttttttttttggtccttcattgcatcctgccatacccatgagcaaacagtttggcattaattatatatcactgccaccctctgaactttgaaaactgccatcttcagacttggtataatggaagaggctttctctctccaataaaccttttgcttcagggtatactcttcggtttttttccagatgtattatgtatgaactttgtactatgtatagccagagttttatttattttttaaaaaagaaactttttcttgataaaggaataatggtggtctagctagttcttgtaaaagtgatgcctcttgaaaaaaaaacagtcctattcactagcttttagtaaaagaatcagatcttttctttcttgttaccttggagtcttaaaaactgattgctaaggtgaaacaattcaatgcataagtatggagctaagtgccttttggaggatttcttggaagagcatttatggagatacttaagggaggtagcaaagatttgaaccgtctgtctttttaagtaa

SEQ ID NO: 3723 - DNA, 3952 bp, Homo sapiens
gaaggaagcggatccacggccgcacagctaaacagcaaccccctacccgcttcgtctccctccgccgctatcggggcctaagcgggagcggctggcacggcgtcactgggtgggctggggcggaagtggaggcggagggagacggtggcgtcgtccgcggggccctgggctctcgcggcgaggccctggtgggcgcgaggcagggggagggggaggaggaggagcccgcggcccgggcggcggcggctctcgggttctccgtagggccccgcctcggagcgggcggcggcggaggaggagactgaggagcaggatggcggcctcggccctgtacgcctgcaccaagtgtacccagcgttatcctttcgaggagctctcccagggccagcagctctgcaaggaatgtcggattgcacatcctattgtaaaatgtacttactgcagatcagaatttcaacaagagagcaaaactaacacaatttgtaagaagtgtgctcaaaatgtgaagcaatttgggacgcccaagccttgtcagtactgtaacataattgcagcatttattggtaccaagtgtcagcgttgcacaaattcagaaaaaaagtatggaccacctcagacctgtgaacagtgcaaacagcaatgtgcttttgatcggaaggaggaaggaagaagaaaggttgatggaaagttattatgctggctctgtactttatcgtacaaaagagttttacagaagacgaaagaacaaaggaagagcctgggatcttcacattcaaattcatcttcttcatctcttactgagaaagaccagcatcatccaaaacatcatcaccaccatcatcaccatcaccatcgtcacagcagtagccatcacaaaatcagcaatctaagtccagaagaagagcagggactgtggaaacagagccataaatcctctgcaacaattcagaatgaaactccaaagaaaaagcccaaattggaatctaagccatctaatggagatagtagctctataaatcagtcagcagatagtgggggaacagacaattttgtccttataagtcaattgaaagaagaagtgatgtcacttaagcgtctcttacagcagagagaccagaccattttagaaaaagataaaaagttaactgaactaaaggcagactttcagtaccaagagtcaaatttgagaacaaaaatgaacagtatggaaaaagcccacaaagaaactgtggaacaacttcaggccaaaaacagagaactactcaaacaggtcgcagcattatcaaagggtaaaaaatttgacaaaagtggaagcatactaacatctccttgagaaagtcatttgtttagcatttcttcttacaatgtaaatttggggaaaaaaaattctgtgaagcccttaaattctgtgtagtagaaaaatatttttgcacaccaaatgaattggtgtgtttcctgttcacttttgtaattgatatacagcattttttaagttgtaaaacattcaaataaaacttcaactggtttgaagtaactttttaattatttgatatccaggaacttttttgccagcaatagtattaaacagttgtaaaggagtgcatgagtagtgctctttatgaaacgcaacatgcaataatagagtaggtatggtttcagaagtcagagcagcagggtttttttgttttgtttttgttttacactatgctaatttcagacaaacagttttcaatttagaaatacaaaaacttttaaactcgaaaaatggcgaacactggttttttgggaattgtgtttttactttgcatcaagatgaatttaggagaaaatcacggtgcttttattaaatgaacttcagatatatgtaaatttgttttttaaagttacatcattaacattagtaacctagcattttcattattggtataggaattaatgtttattgtacagtatctaaggtaaaatgtgtttctgttttgtaaaaactactgtagatttttacttacaagtgcctttttgccacctaatgtttttatttataggaatgctgatcttttgtacatacattttgttttaaaatcatgtttaataaatgtttgtatataaatgcatatgtacagaagcctatttcaaaaggaaatcaaagttgctagtaaaatgtttgagattacatttagaactaactgataatgcatatagattgtagaaaattttgtgatttgtttctgtgtgataagggaagctgttggtctttgaattcatttaattatgtcaaaatagttccccaaagatttaattttaagttgcttcttaaagagtaattttattttttatgtcatgtggcttcatattagtattgtgtgagttacatgttttgctttatattttataaaattttttaaaaattttaatgtttctgcaatgatccatgtatctgctttccctatgtgtggttatctaagttaatatttatgtacaatgtaatttgtaaatttaaagcaaatctgaaaaaaattaaatgatctttttaatccaatctgtgataatctttgaataaattggaatctactataagattcaggcattataagtaaattgtcctaaagtctttaaaattgtctataaaaggttaaggtagggtgggataggttatatgaagttattgactatattctgatccagcggttttcagcctgaaatagaatttatctcctagttattatcagttcagagttttagtttgattttaaagtattgctagatacactgtatagagtgagttgcttctcttaataatttatgggcaaagataaatttgcttcatgtaaaactgttactaaatttataagttttaaaggttttgttttatacaagcattgattgtgaatgtcatatcaaagattggctttcttaagaacacatgattgaaacaatttttttttaacatgacgtgtttcaatagactgttctcatagttcattataaagtgaataccaaataattctttgtccattttgaaagcataatatagggtaattttcaagtgatacaaaaagattcagttagaatcttgtaaactaaaccagtttatttttatgggatcttcatgtaataattttcttaaatttagtactctcaaccatgatagataatgccttaacatggattttaacgtttgcaggatttgctaaattcataagatagttattacctttctttgaaatttgtaatgttttatattcttgtttcatagccatttgtcagtccacagtggtcattatggttttactttttgatagttcttacaccttgttggagaaactacaaaagaaagttgtcctcgtccttccccttagctaacatcaaaattaaaaagttgaatattaatattagctaacattaaaatggaaggtaattcagttttagtgttagctaacattaacagtctaataatttagctttgtaaattccaaggctaaaaccctttcatgggcttcacagtatttagtcctaattaaatacccttctttattccatgaccttattttataacttaaatttttttgcaattgtataaattagtaattcagtcccagtcctggatctctgtagtgttttgacataataaactgatattctttaaatgtggacctgtaaggagatactatggtgtggtgtattgtgcttttagcctgttttccactattaattagcatttaccagtaagggtcattttgactcaagttatttatgtattaatagcctgtgaatattgcagtcctttttagattatattggtctaaatatgcattctgcagtgaacctgttaagctgttcacatgtatagactattgaaatactgtacttgtacacatctgactgttgacattttgtacttttttctagatccaatatttcacaataaaaaacttgtcaaaggctttgtattagt

SEQ ID NO: 3724 - DNA, 3659 bp, Homo sapiens
cttccaagcactggaaacaaacattggagaccaagtgaggcgtcactcaacagccgtagtaatcagggaaatgacaagttacatactgatatcctttgttttgctgattggagttgggtgcattgaaaaagatcagtcgtgcccagtgtttgggggaaggaagcgtcttcacctgttgtttgtgggaggacagttgaggcaggtgaggatgctgagagggtctccagaagcttccactgactgctgttggctgcaccaggcaacagggtctggctctgtcacccaggctggagtgcaatggtatgatctcggctcactgcaacctctgcctcccaggttcaagcgattctcctgcctcagcctcccgagtagctgggattacaggtccagctgggagctccccgacctccaggagggcaagatccaagccatcagcgactcggatggggtgaactacccctggtacggcaacaccacagagacctgcaccatcgtgggccccaccaagagggactccaagttcatcatcagcatgaatgacaacttttaccccagcgtcacatgggccgtgcccgtcagcgagagcaacgtggccaagctcaccaatatctaccgggaccagagcttcaccacctggctggtggccaccaacacctccaccaacgacatgatcatcctgcagacgctgcactggcgcatgcagctcagcatcgaggtgaaccccaaccggcccctgggccagcgcgcccggctgcgggagcccatcgcccaggaccagcccaaaatcctgagcaagaatgagcccatcccgcccagcgccctggtcaagcccaatgccaacgatgcccaggtcctcatgtggcggcccaagtacgggcagccgctggtggtgatcccgcccaagcaccggtgacagccaggaccacccgctaggttagactcacaaataataataccgctgaaaacaaaactcagactcactcttcagtcattcagcaagatacaaccattctaccctctccagcgggcggatctcactgtgctgatgcccccgggaaggcctccccggctctcggcacctgcttcctttcagggagaggggagatctaagcaggacagacagaccccacgtgcgccctcagggtgacctctggtctccttgcctctcctttttctcagtttcagtcgctcacttgtaacagattccctgaaacactgctttttccgttttttaaaaaaactcctcttttgggggctcaggggcaggaggagggggagctgattaggagggaagctccagcccccgatcaaagagacagatccacactgctgccgatttgtggcgctggccggccttccccccaggtccctccgccctctgtcatgcggccttatgtagacttgctttgccaaacttttgccttaagctgaattgaaaggaagaaaaccaatcggagaaagaaagcaggatctcttttctaccggacttttcctcttctgccagaggtggagggagggttggggtcgcccgcgagagtctcttgagcccttcttcccggttgtcttgggagaagggtgaggatgggcatttagacccgaaaccagctgctcactctttctttttggcagaaataaaaccacaggtagattctgcctgaacagccccttctctccctccacccccaggtcgtatccctgcacctgcggagaggggctgtgagctctggcggggggtggctccaccagtcgcctggcctcttctcccctctcttcccagcagccttaacttcccttgggcggctctaggaggagagaggcaggctcctgtgagcccagggaattttcaccctctcagtcctcaggacccacccccagttgagtccctggcccttcctccaggtgtgtggctttttccttctccatccacactggtcccaaatgcctgggggccggccacctggaccgccgacacacagcctcaatgttagtctcaaaggtaaggaaggcattcacgtcccttcttgcagggcattttaagacttgaatcgggtgggccccggcccctgtggctggctggcccctggtgtactgtaaaagggccaagacagggctcgttctcaggggcgcccctcccaggccctcagggcagcgggacggtgcagtcaggctctgggtgccacagtgatggaggtggaaggcacccaagctctagggaagtcttgggaggcagtcggccgagcccctgcttcctgtcctcaaataagtgaatccaggccaagggctgggagggctgggtgggcttatcgtcgagagggttcagagccactctggaggctgggctggcacagtggagagcaacaggtgaggacagacgtctggaagcccatccctgggacctgccctccctcggtcccaggtcactggagctccagggcttacttagtcctgacccattgtgccagggttctgagcagtgtcggccttgtggccacttgcaggggctattaggggacatcccgctgaagccacgctccttccagcttgccaaacccacagctacccgcccgggacccacactcagcctaataattatcaagcacagaaaaccgtccatttagaaaaataatccatttctgctgcagatgagccacttgtaagagtctccgtgacagcgtgggacggtgtgggaaccaaagtccctgccctgctcctttgtccacgggctattgcgtttattcaaggggtgcttaatgaccgtttagccactgccgtcggtctccgggcccagctcgtgccaggaggctgtcctgggacacactgggctggagctgccggctggcacggtgctcagggggcccctgatgggggccaggacctccccgcagaaactgcaggttctcttgtgaggatggaggccgtgccaccccgaaaggcagtagccttaggggaacagtgggtcccagctgcatgtctgaggatgggtggggacagggctgggactcagctttcattcactggagacttctccactcaggtctttgttgcactaaagcagggacaggaccctgggggttcaggaagcgggtctcaggccgctggtttattcctggaggtggggctggagaccagaatggaaaggggcttcctgagctgctagggggtgaaggacccccgaacccgcatttcttgagtgagagcaaacactcgaggcaggagccagcacccctcccactgcatgcccggcccccagcccaccttgccccctgacccaccttcacccgtgccccttctttctgcccttcctcaccgaagaagggctaggaacaccctggagaggctgcaggtccggccacggacgctcagctgagccccggtctgctccttcagcctccttgctcatgttggagcacaggccccaggcttcctgccagggccccgattcttcttatgtcctccagccccgccctggcgtggacatccactcactccttccagcaataagaaccgtccttggtcgtggagagtactgtgaaacaaaccaatgcacttaccaggaggcacaagactcttgaagaagatgtacaatgaacctttttttttttacaaaaaacaaaaagcaaatattcataaagagaaataaaatgtaattttaaagtagg

SEQ ID NO: 3725 - DNA, 3966 bp, Homo sapiens
cttccttatttatgagtctgccggcgctcgcctgcttcctccgaagacttcagggagagtctgcgagctgccgtccccgcgtgtgaggcacagaagggctggatgtcagaaccgcataattattcattaaactacaaactttttttaacccaaagaatatcggtgatttttgtccactgcgaggagaagaagagagagcccagggctcatgaaatgcagcagaatccttatttataaacaggccgcggtagtgatatatgcaaccccagtctactcagtgagttttctatcctatggatatcggtcttgagagttgagattggagagcagcgccgtctgtactgggtcctgcagcctctgtcctttcaatgcctggttttttctgtgactgctggccttccctggagatcagagcgctcctgtatgccatgggctgtattcagagcatcggaggcaaagccagagtcttccgggaagggatcacggtgattgatgtgaaagcctccatcgaccccgtccccactagcatcgatgagtcctccagcgtggtgctccgctaccggacaccccacttccgggcctcggcccaggtggtcatgccgcccatccccaagaaggagacttgggtagttggctggatccaggcgtgcagccacatggagttctacaaccagtacggcgagcagggcatgtccagctgggagctccccgacctccaggagggcaagatccaagccatcagcgactcggatggggtgaactacccctggtacggcaacaccacagagacctgcaccatcgtgggccccaccaagagggactccaagttcatcatcagcatgaatgacaacttttaccccagcgtcacatgggccgtgcccgtcagcgagagcaacgtggccaagctcaccaatatctaccgggaccagagcttcaccacctggctggtggccaccaacacctccaccaacgacatgatcatcctgcagacgctgcactggcgcatgcagctcagcatcgaggtgaaccccaaccggcccctgggccagcgcgcccggctgcgggagcccatcgcccaggaccagcccaaaatcctgagcaagaatgagcccatcccgcccagcgccctggtcaagcccaatgccaacgatgcccaggtcctcatgtggcggcccaagtacgggcagccgctggtggtgatcccgcccaagcaccggtgacagccaggaccacccgctaggttagactcacaaataataataccgctgaaaacaaaactcagactcactcttcagtcattcagcaagatacaaccattctaccctctccagcgggcggatctcactgtgctgatgcccccgggaaggcctccccggctctcggcacctgcttcctttcagggagaggggagatctaagcaggacagacagaccccacgtgcgccctcagggtgacctctggtctccttgcctctcctttttctcagtttcagtcgctcacttgtaacagattccctgaaacactgctttttccgttttttaaaaaaactcctcttttgggggctcaggggcaggaggagggggagctgattaggagggaagctccagcccccgatcaaagagacagatccacactgctgccgatttgtggcgctggccggccttccccccaggtccctccgccctctgtcatgcggccttatgtagacttgctttgccaaacttttgccttaagctgaattgaaaggaagaaaaccaatcggagaaagaaagcaggatctcttttctaccggacttttcctcttctgccagaggtggagggagggttggggtcgcccgcgagagtctcttgagcccttcttcccggttgtcttgggagaagggtgaggatgggcatttagacccgaaaccagctgctcactctttctttttggcagaaataaaaccacaggtagattctgcctgaacagccccttctctccctccacccccaggtcgtatccctgcacctgcggagaggggctgtgagctctggcggggggtggctccaccagtcgcctggcctcttctcccctctcttcccagcagccttaacttcccttgggcggctctaggaggagagaggcaggctcctgtgagcccagggaattttcaccctctcagtcctcaggacccacccccagttgagtccctggcccttcctccaggtgtgtggctttttccttctccatccacactggtcccaaatgcctgggggccggccacctggaccgccgacacacagcctcaatgttagtctcaaaggtaaggaaggcattcacgtcccttcttgcagggcattttaagacttgaatcgggtgggccccggcccctgtggctggctggcccctggtgtactgtaaaagggccaagacagggctcgttctcaggggcgcccctcccaggccctcagggcagcgggacggtgcagtcaggctctgggtgccacagtgatggaggtggaaggcacccaagctctagggaagtcttgggaggcagtcggccgagcccctgcttcctgtcctcaaataagtgaatccaggccaagggctgggagggctgggtgggcttatcgtcgagagggttcagagccactctggaggctgggctggcacagtggagagcaacaggtgaggacagacgtctggaagcccatccctgggacctgccctccctcggtcccaggtcactggagctccagggcttacttagtcctgacccattgtgccagggttctgagcagtgtcggccttgtggccacttgcaggggctattaggggacatcccgctgaagccacgctccttccagcttgccaaacccacagctacccgcccgggacccacactcagcctaataattatcaagcacagaaaaccgtccatttagaaaaataatccatttctgctgcagatgagccacttgtaagagtctccgtgacagcgtgggacggtgtgggaaccaaagtccctgccctgctcctttgtccacgggctattgcgtttattcaaggggtgcttaatgaccgtttagccactgccgtcggtctccgggcccagctcgtgccaggaggctgtcctgggacacactgggctggagctgccggctggcacggtgctcagggggcccctgatgggggccaggacctccccgcagaaactgcaggttctcttgtgaggatggaggccgtgccaccccgaaaggcagtagccttaggggaacagtgggtcccagctgcatgtctgaggatgggtggggacagggctgggactcagctttcattcactggagacttctccactcaggtctttgttgcactaaagcagggacaggaccctgggggttcaggaagcgggtctcaggccgctggtttattcctggaggtggggctggagaccagaatggaaaggggcttcctgagctgctagggggtgaaggacccccgaacccgcatttcttgagtgagagcaaacactcgaggcaggagccagcacccctcccactgcatgcccggcccccagcccaccttgccccctgacccaccttcacccgtgccccttctttctgcccttcctcaccgaagaagggctaggaacaccctggagaggctgcaggtccggccacggacgctcagctgagccccggtctgctccttcagcctccttgctcatgttggagcacaggccccaggcttcctgccagggccccgattcttcttatgtcctccagccccgccctggcgtggacatccactcactccttccagcaataagaaccgtccttggtcgtggagagtactgtgaaacaaaccaatgcacttaccaggaggcacaagactcttgaagaagatgtacaatgaacctttttttttttacaaaaaacaaaaagcaaatattcataaagagaaataaaatgtaattttaaagtagg

SEQ ID NO: 3726 - DNA, 792 bp, Homo sapiens
ggccaagggattgctgcagccctcatccaccttccaagcactggaaacaaacattggagaccaaggtctccagaagcttccactgactgctgttggctgcaccaggcaacagggtctggctctgtcacccaggctggagtgcaatggtatgatctcggctcactgcaacctctgcctcccaggttcaagcgattctcctgcctcagcctcccgagtagctgggattacaggtccagctgggagctccccgacctccaggagggcaagatccaagccatcagcgactcggatggggtgaactacccctggtacggcaacaccacagagacctgcaccatcgtgggccccaccaagagggactccaagttcatcatcagcatgaatgacaacttttaccccagcgtcacatgggccgtgcccgtcagcgagagcaacgtggccaagctcaccaatatctaccgggaccagagcttcaccacctggctggtggccaccaacacctccaccaacgacatgatcatcctgcagacgctgcactggcgcatgcagctcagcatcgaggtgaaccccaaccggcccctgggccagcgcgcccggctgcgggagcccatcgcccaggaccagcccaaaatcctgagcaagaatgagcccatcccgcccagcgccctggtcaagcccaatgccaacgatgcccaggtcctcatgtggcggcccaagtacgggcagccgctggtggtgatcccgcccaagcaccggtgacagccaggaccacccgctaggttagactcacaa

SEQ ID NO: 3727 - DNA, 1597 bp, Homo sapiens
gtcctgtgctgctccagccgttggggctctccaccccgggccacagcctcctggcgccccccgggccgaggcagccgggccgaggagtgtcggtgtggtccggctacggggcggggccggcggcggctgctgctgctgccgccgcggaggcagacagaccgggcgctgccaccgccgccctcccccggctccatgccgccgccgctgccgcctcctcctctccggcgaggggcggggggctccggcccggggtgggcaccattcctcgcagcgccgctcccctccctgccctccgcccgggcgctggagccggcgagggcacccgccgcctcctaggagtgcaccctccgcgcgccctgccggagcgagggggcgggcgtgggcggacgtcggggcagcggggaccccgcgcggctgcaagaggagggggcttccccaaggatgcccggcggctccccgctcctaggtgcgagctgagtctgaccgggagcgagcggcgcgtcgccatgccggcgtgacgggcgcccccggctgcccgcgcgggcccccgcgctgccccacgccgcgccgtgccggcaccgggctgcaggatgggctgtatccaaagcatcacctgcaaggcgcggatccggcgcgagaacatcgtggtgtacgatgtgtgcgccaccatcgaccagtgccccacgcgcatcgaggagacctcgcccatcgtcctgcgctacaagaccccctacttcaaagcctccgcccgcgtggtcatgccccccatcccccgccacgagacctgggtggtgggctggattcaggcgtgcaatcagatggagttcttcaacacctacagcgacctgggcatgtcaagctgggaactgcctgacttgagggaagggagagtaaaagccatcagtgactcagatggggtgagctacccttggtacgggaacaccacagaaactgtgaccctggttggccccaccaacaagatctccaggttctccgtcagcatgaatgacaacttctaccccagtgtgacatgggcagtgcctgtgagtgacagcaatgtgccactgctcacaagaatcaagagagaccaaagtttcacgacctggctggtggccatgaacaccaccacaaaggagaagatcattctgcagaccatcaagtggaggatgagggtggacattgaagtggaccctcttcagctcttggggcagcgggcccggctggtgggcaggactcagcaggagcagccccggatcctgagccggatggaacccatcccccctaatgcactagtgaaacccaatgccaatgatgcccaggtcctcatgtggaggcccaagcgggggccacctctggttgtgatccctcctaagtagaagcagactggcctgactgtgtgtggatcacacgcctctgagacatgcagtgagggtgccaggggtggcaggagccaaacagagtttctgagccaaagcagacctctcggtttgccagcctttgcagccacttttgaagagtagggctgctccttgggtggtagaaccataatccttaggaaaaatcccttcctcttaggaataaagaaatcactgatttg

SEQ ID NO: 3728 - DNA, 1475 bp, Homo sapiens
cggctgctgctgctgccgccgcggaggcagacagaccgggcgctgccaccgccgccctcccccggctccatgccgccgccgctgccgcctcctcctctccggcgaggggcggggggctccggcccggggtgggcaccattcctcgcagcgccgctcccctccctgccctccgcccgggcgctggagccggcgagggcacccgccgcctcctaggagtgcaccctccgcgcgccctgccggagcgagggggcgggcgtgggcggacgtcggggcagcggggaccccgcgcggctgcaagaggagggggcttccccaaggatgcccggcggctccccgctcctaggtgcgagctgagtctgaccgggagcgagcggcgcgtcgccatgccggcgtgacgggcgcccccggctgcccgcgcgggcccccgcgctgccccacgccgcgccgtgccggcaccgggctgcaggatgggctgtatccaaagcatcacctgcaaggcgcggatccggcgcgagaacatcgtggtgtacgatgtgtgcgccaccatcgaccagtgccccacgcgcatcgaggagacctcgcccatcgtcctgcgctacaagaccccctacttcaaagcctccgcccgcgtggtcatgccccccatcccccgccacgagacctgggtggtgggctggattcaggcgtgcaatcagatggagttcttcaacacctacagcgacctgggcatgtcaagctgggaactgcctgacttgagggaagggagagtaaaagccatcagtgactcagatggggtgagctacccttggtacgggaacaccacagaaactgtgaccctggttggccccaccaacaagatctccaggttctccgtcagcatgaatgacaacttctaccccagtgtgacatgggcagtgcctgtgagtgacagcaatgtgccactgctcacaagaatcaagagagaccaaagtttcacgacctggctggtggccatgaacaccaccacaaaggagaagatcattctgcagaccatcaagtggaggatgagggtggacattgaagtggaccctcttcagctcttggggcagcgggcccggctggtgggcaggactcagcaggagcagccccggatcctgagccggatggaacccatcccccctaatgcactagtgaaacccaatgccaatgatgcccaggtcctcatgtggaggcccaagcgggggccacctctggttgtgatccctcctaagtagaagcagactggcctgactgtgtgtggatcacacgcctctgagacatgcagtgagggtgccaggggtggcaggagccaaacagagtttctgagccaaagcagacctctcggtttgccagcctttgcagccacttttgaagagtagggctgctccttgggtggtagaaccataatccttaggaaaaatcccttcctcttaggaataaagaaatcactgatttga

SEQ ID NO: 3729 - DNA, 3465 bp, Homo sapiens
gcggcgcgggcccgcagccgggcgccctgctcagccagcgccagcggccgccgcacccagccgcgccggcgaggacatgggcagccgcggcgcgcccaccccccgcgccgatgtgaattattaaaaagaaaatggcccaacggagcactgtatttccttctcgtgtcaccaaggaaaggtataatatatggaaaatatgcatctaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaaagggggaggtgaccgcttggccaggcttttcttggaggagcatatcagaaacataactgccatagtgaagcaacttaatcgggatatcgaggtactccaggagcagattcgtgcccgggacaacattagctatggaactaattctgccttaaagaccctggagatgcgccagctctccggtttgggagatcttcgaggaagagtggcaagatgtgatgccagcatagctagactttctgcagagcacaaaacgacctatgaggggctccagcacttgaacaaagaacagcaggctgccaaacttatcttggaaacgaaaatcaaagatgcagagggacagatttctcagcttttgaacagagtggacttgtcaatatcagagcagagcaccaaactgaagatgtctcacagagacagtaaccaccagcttcagcttttggacactaaatttaaaggtacagttgaggaactcagtaaccagatattatctgcacggagttggttgcaacaggaacaagaacggatagaaaaagagcttttacagaaaattgatcagctttccttgattgttaaggaaaacagtggagccagtgaaagggatatggagaagaagctcagccagatgtcagccaggcttgacaaaatagaagagggtcaaaagaagacttttgatggtcagagaacaaggcaagaagaggagaagatgcacgggcgaatcaccaagctggagttacagatgaaccagaacatcaaggaaatgaaagcagaagttaatgctgggtttacagccgtctatgaaagcataggatccctcaggcaagttctcgaggccaagatgaagctggacagggaccagctacagaagcaaatccagctgatgcagaagccagagacccccatgtgaagggagctgggacaaggtcctaaaagacagttttgccagtggggctaggagccggatacctctgtagccaggccatcgctgcattcaggattgttccatccatggcgtgcatgtgccaagaaatgtgtttttatgggtctaaatgtttaccttgagtcttgaaaatactcttttgttaaaagtatgaaatacagtttttaccagtttatttcacttctctaaattcaatggaaatcccccgccctggattttgaaaggcttttatcttcttcattttacgaatggaaagacgacaatttttcttcaatgcttgatgcactaatgaagactgtttactattttgaaaaatgtcatggggatttttttttaattaagaaactaatgaatcatcacaggaatgtgttgctcctcaccctaaattaagagaatgtcccagtagattagacttcaacctttgagtccaatttggattttattatcgttgtctatgcacttcttatattggttatcttcttgtaaatcttctgtcttttgtaaggggaaaggatttaacatttagaataaaccccaccatttatgtaatggaaatagtttaaaaattgctaactgccatgtggattgcaaattaaatggaaacttatttagataacgtaaggctcaatatctgcgttgaccacctagatattacaggttttaatatttaaaactatttttgaattatccacaacctgtatagtgatagccatatatttaataatggaatggtggttaacagtctatttactgcacaattaattgttcactaatcaaatagaatgtggtaatttttcagactttatgatctgtttccaaaattggcacaaagtgctagggtttatatacacttatcgtaactgtatttttgtgccttggttttatcatgtcaatgcactgtactctgtaaaagttttgcagacaaaatagaaagtatgataatccgtcagaagtatgatgtaaaactggaatcctctgtattttttaaatgttctaaaaattttatcgctgttaaggtattaatcattcagtattactaatggaatagaaattcatacttttgtatggacaacaattcaaattgatattgcatttatagcactgtaagaaactttcatcttgagcaactttgtagatgatgggtgttttattttcaatcgccatatttgatcagtcattgaaaattggccccagtgctgtttgttcatctctgtatgtaaaaactgacagtgagacacaacgttctgaactgtgagggtgtcccaggaaaaagaaaaacaggaatactttaacaattaaaaagaaaaaaatgttttttgtttgccaaggactcaggaaaataaaaagcattttctatttttaggacaaatcacaaatgaagtgtctaactggctattactgtttacccatataaaatatgctgctaaagtacatattttgctgtcaatggcttgacaattttttttttcaaatttggacatgagaggttatatagggactatattatccaacacatattttcttattttgccacaaatttccacttaacaaataaaaaaaggcgaatgctgttttgcaatcagaaagtgaatttcttttgtggtagcgtacacgtggttcatgtggttctccacgtttaagcacaaaccacagcacaggaagccacaccccctccagcatctctgtcttgtggggtctttgaggagaaggaatcagaacatcgacacctgggaagagggaggcggggaacaccagctggactctggccaaggagtgatgtaagcaggtgacacttggctgtcagctgagcttctcaggtgcttctgacattgccagccccttgagatgagccaccgcaggtgtgctcaccttggctacatgttgaaatcatccagaggagttgggaaatctactgatgccccgctgtgcctcccagaccgattaagtcagaacctctgggaggtgggtcgcaggcatcagtgcgtgcccgaggcctccgcgtgtttgggtgtgcagccgaggtggtgagctgtcgagccacagtgcagttctcttctcaccaaagctcaaatgagaatcagcttccatgttctttcctttaccagaaatttgcaataaaaagaaaaataaaattttca

SEQ ID NO: 3730 - DNA, 528 bp, Homo sapiens
agccagcgccagcggccgccgcacccagccgcgccggcgaggacatgggcagccgcggcgcgcccaccccccgcgccgctgaacccaccttctctcccgagcaccagagcctgagtgaacaacttgccgcagaagagccttctctagtgtcctccaccgtctcaccagagtagggatgctcttccgcttctccttagtgctgcctccaaaccaatgcaccatcaccaaccaagtctcctctcggaagatgtgaattattaaaaagaaaatggcccaacggagcactgtatttccttctcgtgtcaccaaggaaaggtataatatatggaaaatatgcatctaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaaa

SEQ ID NO: 3731 - DNA, 573 bp, Homo sapiens
agggcgagacggcggcgacttagcaggcggggcgcatgctgcggagggcaagagtccactcgtactcgccggtcgccgccggcccagatccagaacatttctgccttcaactccagcaaggatctgaaggtccaggaccttaggaaagctgcctgcagagaggtggagagatgtgaattattaaaaagaaaatggcccaacggagcactgtatttccttctcgtgtcaccaaggaaaggtataatatatggaaaatatgcatctaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaaagggggaggtgaccgcttggccaggcttttcttggaggagcatatcagaaacataactgccatagtgaagcaacttaatcgggatatcgaggtactccaggagcagattcgtgcccgggacaa

SEQ ID NO: 3732 - DNA, 572 bp, Homo sapiens
gctcagccagcgccagcggccgccgcacccagccgcgccggcgaggacatgggcagccgcggcgcgcccaccccccgcgccggtaaaatcaaaacccaatcgtggcaggcagcagcaaattaactgaacccaccttctctcccgagcaccagagcctgagtgaacaacttgccgcagaagagccttctctagtgtcctccaccgtctcaccagagtagggatgctcttccgcttctccttagtgctgcctccaaaccaatgcaccatcaccaaccaagtctcctctcggaagatgtgaattattaaaaagaaaatggcccaacggagcactgtatttccttctcgtgtcaccaaggaaaggtataatatatggaaaatatgcatctaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaa

SEQ ID NO: 3733 - DNA, 557 bp, Homo sapiens
gcattttcgcgggggctgcatgctagcgaaccaaccgacgcccggagggactgtttgggggagctggggtggtgcacggattgccaggggtaaaggcgagtcagccgacccactactcagagtgagtgaccttggatgtgaattattaaaaagaaaatggcccaacggagcactgtatttccttctcgtgtcaccaaggaaaggtataatatatggaaaatatgcatctaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaaagggggaggtgaccgcttggccaggcttttcttggaggagcatatcagaaacataactgccatagtgaagcaacttaatcgggatatcgaggtactccaggagcagattcgtgcccgggacaacattagctatggaactaat

SEQ ID NO: 3734 - DNA, 573 bp, Homo sapiens
atcagactcaaatgcctgctcctcaagtgcttttcctgatggcccagttcaaactgatcctgccttctgcccagtggcactgaccagcccctccattcttgcacggtggcttgctagtgttatttccctgcataatgggagttcctgcagcgcaggggctgtgtcttgttcagcactgtagaggctcaatgaatatttgttgactggactaaattatttgatgaaatcattaagcaagtgcacagaataaccgtggagctgtctgctagcacgtggtgtgcgatggtggatgtgagacccatgccttacccgaagagtcagatgtgaattattaaaaagaaaatggcccaacggagcactgtatttccttctcgtgtcaccaaggaaaggtataatatatggaaaatatgcatctaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattg

SEQ ID NO: 3735 - DNA, 656 bp, Homo sapiens
agtttccaaagatctctggatcctgtagtcctcctcccgcgccagccaccgaagaacgctgcggacccagctcgctcctggtagcaagacccgaactatccagaacatttctgccttcaactccagcaaggatctgaaggtccaggaccttaggaaagctgcctgcagagaggtggagagatgtgaattattaaaaagaaaatggcccaacggagcactgtatttccttctcgtgtcaccaaggaaaggtataatatatggaaaatatgcatctaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaaagggggaggtgaccgcttggccaggcttttcttggaggagcatatcagaaacataactgccatagtgaagcaacttaatcgggatatcgaggtactccaggagcagattcgtgcccgggacaacattagctatggaactaattctgccttaaagaccctggagatgcgccagctctccggtttgggagatcttcga

SEQ ID NO: 3736 - DNA, 581 bp, Homo sapiens
agatttccgggtggcgagctgctgagcttactgggaacttcagtcttcctccctgaaggtgtctgcgtttgctgactggttgtcaccccctgccccacttcagaacgcgtttgtgaagaagacattctctctggatgaagcaactacagaagtgcagatgtgaattattaaaaagaaaatggcccaacggagcactgtatttccttctcgtgtcaccaaggaaaggtataatatatggaaaatatgcatctaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaaagggggaggtgaccgcttggccaggcttttcttggaggagcatatcagaaacataactgccatagtgaagcaacttaatcgggatatcgaggtactccaggagcagattcgtgcccgggacaacattagctatggaactaattc

SEQ ID NO: 3737 - DNA, 1560 bp, Homo sapiens
gtcacccttgggaagaggccccagaaacaggaagaccttagttaggatgcaattacaattccttggtacattggcttcctcagaaaaaagaaaaaaatcacagagattgtttttcaaaaatatcaaatctacaaaaaataaagctggaaaagcaagcatcatgagttcagatacaaatgtaaacaaaagtgcctctccaactgcgactgcagaggaacagccagttgaacctgatggcccccttcctggctcagacaataaccaagaaaagaaagtaagattatctccagccaaaatgtcaaccaagaattctacagatctagttgaatatgttgacaagagtcatgcttttctccccatcattccaaacacccagagaggtcagctagaagacagactgaacaaccaggcgcgtaccatagctttccttcttgaacaagccttccgcatcaaggaggacatctctgcttgcctgcaggggacccatggctttcgaaaagaggaatcgctcgccaggaagttactggaaagccacatccagaccatcaccagcatcgtcaaaaaactcagccaaaatattgagattttagaagaccaaataagagctcgagatcaggcggccacaggaactaactttgcagtacacgagataaacatcaaacacctacaaggagttggagatcttcgaggaagagtagccagatgtgattcaagcattgtgaagctttctggagacattcacttattcaggcaagagcaccggcaaattgagaaagccattcaagaattcgtgcccgccctggaaactctttccaagaacttggacatgaaggtgatgcagctcttaggaaagatagaaactgccagtcctgagcaaacctcgaatttaaagatggtccagggggattatcgccacgaaatgaaccttttggaattcaaatttcattcactttcaagtaatctgtacgaagaagttgagaataataaaaaatggacagaaaaccaatttctcaaatatagaaaagaccacctgggccatataaatgaatgtctgaaggtcctacaggagaaactggaaaagtctgaaaataaaatggaagaaaaactgctgcagctttcaagcaaagtagagaatttcattaacacacagaaacaggaaacacaactaagtaaagtaaagcatatggaaaataaattgtccaaaaagatggaacaaatggaaaagcagatctggggtgaattagagacaatgcagaatgaatatcaatcaggatttaaatcaattcatgactctctcagctccctccaacaaatacagaaaacaaagatggatttagagaaatataaagtacagaaagacctaaagaaattacagcgcaagatagtggaactccaggaagtataaaccttttcagtcatcttctttttcatcagccaatggagtgatttgttggaaaaagttctgaagaagaaagttactatctctgggatgtttactgcttctaatgtctccttttaaggagacgaatgtaccagaaaaataataaagcaaagaagctt

SEQ ID NO: 3738 - DNA, 1858 bp, Homo sapiens
attgctcaggacagcggtaaatcacttcttggaggtgccctgcacgccggtcctgggagcaggcggcctcccgggggtgcgggagccccactcctccgtggtgtgttccatttgcttcccacatctggaggagctgacgtgccagcctcccccagcaccacccagggacgggaggcatgagccggtcaaggcacctgggcaaaatccggaagcgtctggaagatgtcaagagccagtgggtccggccagccagggctgactttagtgacaacgagagtgcccggctggccacggacgccctcttggatgggggttctgaagcctactggcgggtgctcagccaggaaggcgaggtggacttcttgtcctcggtggaggcccagtacatccaggcccaggccagggagcccccgtgtcccccagacaccctgggaggggcggaagcaggccctaagggactggactccagctccctacagtccggcacctacttccctgtggcctcagagggcagcgagccggccctactgcacagctgggcctcagctgagaagccctacctgaaggaaaaatccagcgccactgtgtacttccagaccgtcaagcacaacaacatcagagacctcgtccgccgctgcatcacccggactagccaggtcctggtcatcctgatggatgtgttcacggatgtggagatcttctgtgacattctagaggcagccaacaagcgtggggtgttcgtttgtgtgctcctggaccagggaggtgtgaagctcttccaggagatgtgtgacaaagtccagatctctgacagtcacctcaagaacatttccatccggagtgtggaaggagagatatactgtgccaagtcaggcaggaaattcgctggccaaatccgggagaagttcatcatctcggactggagatttgtcctgtctggatcttacagcttcacctggctctgcggacacgtgcaccggaacatcctctccaagttcacaggccaggcggtggagctgtttgacgaggagttccgccacctctacgcctcctccaagcctgtgatgggcctgaagtccccgcggctggtcgcccccgtcccgcccggagcagccccggccaatggccgccttagcagcagcagtggctccgccagtgaccgcacgtcctccaaccccttcagcggccgctcggcaggcagccaccccgttcctgaaagtaaacaaaacaaaacaaaaacaaaaaaacaaacaacactttggttcctgatggctttctgaacccagccctgaccttgttgtttcacagctgacggctgagatgaggttagaatgactgggcccggctgaacattccaaattggatttcaccatctgctgagaaagtttaaggaaggcaaagcttgccaggtcacagaagctcccaagcccagctttccaaaggcctcagcctgtgcctgtgtcgagctcagtcctgggagataggggagaacctgcaggcaggaacaagcccccctactcctgaccaccctccatcagcagtctcccctccgtggtcgtctttgttgacaaaggtgcagtttctcctctcctgggcacctgtaacatgtgatgcgctgcctgctgggaggttaggtcggggctgccccggcgagtggagcatgagcagaaccgccgagggtcacttctgggcagaagctttgagagcctgggtccaggttgccacatagaagcagctctccagttgaaaccctcctctgccagcctggggtcctaagcgatgagcagaatcccccactcccaccccaccaacccacaatggatatgtagtgagcaagaaataaacctttgttgtttaa

SEQ ID NO: 3739 - DNA, 2925 bp, Homo sapiens
ggaaagccggctcaccttcgcctccccctgcggctgggaggagaggaaatatcccatggctgactgtgccaaggaggtgtctgagccagccctcccggcccgagggcagggcaggtggccctgagagataagccaatcccgcagctgcagatgaggagttctgagaagcattgctcaggacagcggtaaatcacttcttggaggtgccctgcacgccggtcctgggagcaggcggcctcccgggggtgcgggagccccactcctccgtggtgtgttccatttgcttcccacatctggaggagctgacgtgccagcctcccccagcaccacccagggacgggaggcatgagccggtcaaggcacctgggcaaaatccggaagcgtctggaagatgtcaagagccagtgggtccggccagccagggctgactttagtgacaacgagagtgcccggctggccacggacgccctcttggatgggggttctgaagcctactggcgggtgctcagccaggaaggcgaggtggacttcttgtcctcggtggaggcccagtacatccaggcccaggccagggagcccccgtgtcccccagacaccctgggaggggcggaagcaggccctaagggactggactccagctccctacagtccggcacctacttccctgtggcctcagagggcagcgagccggccctactgcacagctgggcctcagctgagaagccctacctgaaggaaaaatccagcgccactgtgtacttccagaccgtcaagcacaacaacatcagagacctcgtccgccgctgcatcacccggactagccaggtcctggtcatcctgatggatgtgttcacggatgtggagatcttctgtgacattctagaggcagccaacaagcgtggggtgttcgtttgtgtgctcctggaccagggaggtgtgaagctcttccaggagatgtgtgacaaagtccagatctctgacagtcacctcaagaacatttccatccggagtgtggaaggagagatatactgtgccaagtcaggcaggaaattcgctggccaaatccgggagaagttcatcatctcggactggagatttgtcctgtctggatcttacagcttcacctggctctgcggacacgtgcaccggaacatcctctccaagttcacaggccaggcggtggagctgtttgacgaggagttccgccacctctacgcctcctccaagcctgtgatgggcctgaagtccccgcggctggtcgcccccgtcccgcccggagcagccccggccaatggccgccttagcagcagcagtggctccgccagtgaccgcacgtcctccaaccccttcagcggccgctcggcaggcagccaccccggtacccgaagtgtgtccgcgtcttcagggccctgtagccccgcggccccacacccgcctccaccgccccggttccagccccaccaaggcccttggggagccccgagtccccaggcccacctctccccgcggccccacgacggcccgcccgccgctgtctacagcaacctgggggcctacaggcccacgcggctgcagctggagcagctgggcctggtgccgaggctgactccaacctggaggcccttcctgcaggcctcccctcacttctgaaggtcccatcccctgctgccctccgcaggcccagggctgggcactccctgagacccaaagacccacctcaacgacgagtggcgttgagccacttccctttgaaaagacactcaaaatcactgccatggttcaatgttcccaggccccaggccatccacttgccggcccccaccagttcttgggttccccgctctagtttgacctgtgcagcacattccagaaggttccagggaggttgtggggcagctagaggacaaaatcatgaaaacagagtccctgtcttccagagatcatccggggctttaatattaatggcccccaaaactccgtaagaagcaggaaatgcagcccaagttttacaaatgggtaaacagaggcactgagagatagatggtagtttggtacttctggttcccagtgcccaggaatggtccactcccaagaaattcaggaaagaaagactgaggagaaggtgtgggaacattctggatgtttcgggagagttggggaaactcctcctcttaggaaaggctaatactagggtatccttgggcccaatgaattaggggtgaggccccagaacccgttatctatgagttgtatgggggagccatctgaagctgtagccaccagggatgcagctagctgaggagtttggggtgttgggttggacaaggcaggttagtagactcagattcttgcttcaaagagccttgggctggcctggaggtccctggagtctagactggacctaggagcttgagttgtcaggggccaggactggccccactgcagtgcccaggccagtcttgagcagcagggagggctcagctgtccccagatccaggtgcctctgaccagcctggtcacctcctgaggaataaatgctgaacctcacaagccccatcattcatttcttctcaattcacagtgcccctctttgtttctggggtggaactaggtcctgagggcacagcctagctgagtgcaaagaaatataggatgcttagaaagcatacaggaggggccaggcgtggtggctcatgcctgtaatcccagaactttgggatgccaaggtggttggattacctgagatcaggtggattacctggtctcgagaccagcctgaccaatatggtgaaaccccgtctctactaaaaatacaaaaattaggctgagacaggagaattgcttgaacccaggaagcagaggttgcaatgagctgagattgcatcactgcactccagcatgggcaacaaagcaagactccgtcac

SEQ ID NO: 3740 - DNA, 5393 bp, Homo sapiens
gatgacttggagaacagtcacttcctctttctgggctacagttttctcatcagtaactgaagagcttgcagtaccttcaacattccttcaggtgaggacttctctttgatcactgctatggtttgaatgtgtctcctaaagttcatgtgttggaagcttgatccccagtgcaaaagtgttgggaggtggggcctaatgagaagtaattaggccatgagtattctgccctcatgtattcatgagattaatgtcattatcatgggagcgggtttgttaaaatgagttcggccccttccttctctctctttcttctgccatacagtatgggatgcacagtgcagaaggtcttaccagatactggcaccatgcttttggacttctcagcccccagaaccatgagccaaataaatttctgttcattataaatcacccagtctgtggcatcctgttagagcagcataaatggactaagataatccctataaagagtggcaacagaacagttcccagctcactggcagaatcctatgatcaactagtaatgtctgccagggaaggaggatgagtggcactaacatgtacggtgtgtttgctcactgttctacaggattcaactagaatctctgggtctgtgtgaagaccaagagctgggaacagaagcagggctctagagggaaaagtttctttcggattccttttttttgttttgttttaaagagctgctctgtgagaagacaaggagaaaatggtccctacaggatactcacctctgtctcagggagacactcaagcatttattcaaccaagaaagagaattagttccaggtgaaaggagaaccccagaatacccacctacttttaaaattctcccctatgcatattcaggaaccaatcagaggatctgtaatgcgctgtgagtagaaagggaaggggaatgggaaagaaaaaagtgaagcttggaatggtggaaagtacatgggctctgccatttaccagctaagtgatcttgggcaagtaacttgacctttctgagcctcggtttcctctttggtgaaatgaggactaataatccatttctccctcagtacagacagccagcatgcagtgagcactcagcgatggccaagtatgggagaagccatgctggaatgaacatgtgggaccattttgtgcagtttctcagcgccaacactgactggtcccctgggctcgtgggccgccggcagcctcggctcgttctccagacagtgttccaagaagccacttccagcgaggaagcgttggcctgagaactggaacctctgcggtctctgcaaacacgacaatgacaaacacttgagagggcatgggagaaaggagctccttcatagggcagggaggggtgggcacttgggtgtgaccaaggagaggaggcgcgcctggtcaacagctctccctggcccgtgtccagctccctcctcacacagagaggggggcgcatctcagggatggcatctttcccccccacagggaaattcttatctttgaaacagcatgggaatcgaggcacccaggaggggagcagaggcaggcaggcctccttcaggcccatcctccagctgggctggtggtgccagggaggctccctgcttggtaacaaaggcctgagggagagttgcgaaacccagcaggaaagccggctcaccttcgcctccccctgcggctgggaggagaggaaatatcccatggctgactgtgccaaggaggtgtctgagccagccctcccggcccgagggcagggcaggtggccctgagagataagccaatcccgcagctgcagatgaggagttctgagaagcattgctcaggacagcggtaaatcacttcttggaggtgccctgcacgccggtcctgggagcaggcggcctcccgggggtgcgggagccccactcctccgtggtgtgttccatttgcttcccacatctggaggagctgacgtgccagcctcccccagcaccacccagggacgggaggcatgagccggtcaaggcacctgggcaaaatccggaagcgtctggaagatgtcaagagccagtgggtccggccagccagggctgactttagtgacaacgagagtgcccggctggccacggacgccctcttggatgggggttctgaagcctactggcgggtgctcagccaggaaggcgaggtggacttcttgtcctcggtggaggcccagtacatccaggcccaggccagggagcccccgtgtcccccagacaccctgggaggggcggaagcaggccctaagggactggactccagctccctacagtccggcacctacttccctgtggcctcagagggcagcgagccggccctactgcacagctgggcctcagctgagaagccctacctgaaggaaaaatccagcgccactgtgtacttccagaccgtcaagcacaacaacatcagagacctcgtccgccgctgcatcacccggactagccaggtcctggtcatcctgatggatgtgttcacggatgtggagatcttctgtgacattctagaggcagccaacaagcgtggggtgttcgtttgtgtgctcctggaccagggaggtgtgaagctcttccaggagatgtgtgacaaagtccagatctctgacagtcacctcaagaacatttccatccggagtgtggaaggagagatatactgtgccaagtcaggcaggaaattcgctggccaaatccgggagaagttcatcatctcggactggagatttgtcctgtctggatcttacagcttcacctggctctgcggacacgtgcaccggaacatcctctccaagttcacaggccaggcggtggagctgtttgacgaggagttccgccacctctacgcctcctccaagcctgtgatgggcctgaagtccccgcggctggtcgcccccgtcccgcccggagcagccccggccaatggccgccttagcagcagcagtggctccgccagtgaccgcacgtcctccaaccccttcagcggccgctcggcaggcagccaccccggtacccgaagtgtgtccgcgtcttcagggccctgtagccccgcggccccacacccgcctccaccgccccggttccagccccaccaaggcccttggggagccccgagtccccaggcccacctctccccgcggccccacgacggcccgcccgccgctgtctacagcaacctgggggcctacaggcccacgcggctgcagctggagcagctgggcctggtgccgaggctgactccaacctggaggcccttcctgcaggcctcccctcacttctgaaggtcccatcccctgctgccctccgcaggcccagggctgggcactccctgagacccaaagacccacctcaacgacgagtggcgttgagccacttccctttgaaaagacactcaaaatcactgccatggttcaatgttcccaggccccaggccatccacttgccggcccccaccagttcttgggttccccgctctagtttgacctgtgcagcacattccagaaggttccagggaggttgtggggcagctagaggacaaaatcatgaaaacagagtccctgtcttccagagatcatccggggctttaatattaatggcccccaaaactccgtaagaagcaggaaatgcagcccaagttttacaaatgggtaaacagaggcactgagagatagatggtagtttggtacttctggttcccagtgcccaggaatggtccactcccaagaaattcaggaaagaaagactgaggagaaggtgtgggaacattctggatgtttcgggagagttggggaaactcctcctcttaggaaaggctaatactagggtatccttgggcccaatgaattaggggtgaggccccagaacccgttatctatgagttgtatgggggagccatctgaagctgtagccaccagggatgcagctagctgaggagtttggggtgttgggttggacaaggcaggttagtagactcagattcttgcttcaaagagccttgggctggcctggaggtccctggagtctagactggacctaggagcttgagttgtcaggggccaggactggccccactgcagtgcccaggccagtcttgagcagcagggagggctcagctgtccccagatccaggtgcctctgaccagcctggtcacctcctgaggaataaatgctgaacctcacaagccccatcattcatttcttctcaattcacagtgcccctctttgtttctggggtggaactaggtcctgagggcacagcctagctgagtgcaaagaaatataggatgcttagaaagcatacaggaggggccaggcgtggtggctcatgcctgtaatcccagaactttgggatgccaaggtggttggattacctgagatcaggtggattacctggtctcgagaccagcctgaccaatatggtgaaaccccgtctctactaaaaatacaaaaattaggctgagacaggagaattgcttgaacccaggaagcagaggttgcaatgagctgagattgcatcactgcactccagcatgggcaacaaagcaagactccgtcacagaaaaaaaaaaaaaaaagagagagagcatagaggagggttggccagccctgtggtgggtgggatgtcagagacacttcccagataaagtaagagttaaccctgcacctcaggtgtgatagtggggtcagtggtatgtgatccaggctggggagccagaggggagcaggtgccaactccacatccttctcctgtttctaggccctctcctcccttgtcggtttttggcggggaagctcagccttcgctgtggagggacgagagcacagagctcttcctcctggtggcctctgacccctgacggcctgtggcatcctccctagtcccctctgcccatccatccctctgttccaattctccactgctcccagcatgatctggggcatcttggcttctggtttcttttattattattattattattaattattgtattcctgtccttcacttttttcctccttagttcctgaaagtaaacaaaacaaaacaaaaacaaaaaaacaaacaacactttggttcctgatggctttctgaacccagccctgaccttgttgtttcacagctgacggctgagatgaggttagaatgactgggcccggctgaacattccaaattggatttcaccatctgctgagaaagtttaaggaaggcaaagcttgccaggtcacagaagctcccaagcccagctttccaaaggcctcagcctgtgcctgtgtcgagctcagtcctgggagataggggagaacctgcaggcaggaacaagcccccctactcctgaccaccctccatcagcagtctcc

SEQ ID NO: 3741 - DNA, 1600 bp, Homo sapiens
attgctcaggacagcggtaaatcacttcttggaggtgccctgcacgccggtcctgggagcaggcggcctcccgggggtgcgggagccccactcctccgtggtgtgttccatttgcttcccacatctggaggagctgacgtgccagcctcccccagcaccacccagggacgggaggcatgagccggtcaaggcacctgggcaaaatccggaagcgtctggaagatgtcaagagccagtgggtccggccagccagggctgactttagtgacaacgagagtgcccggctggccacggacgccctcttggatgggggttctgaagcctactggcgggtgctcagccaggaaggcgaggtggacttcttgtcctcggtggaggcccagtacatccaggcccaggccagggagcccccgtgtcccccagacaccctgggaggggcggaagcaggccctaagggactggactccagctccctacagtccggcacctacttccctgtggcctcagagggcagcgagccggccctactgcacagctgggcctcagctgagaagccctacctgaaggaaaaatccagcgccactgtgtacttccagaccgtcaagcacaacaacatcagagacctcgtccgccgctgcatcacccggactagccagaacatttccatccggagtgtggaaggagagatatactgtgccaagtcaggcaggaaattcgctggccaaatccgggagaagttcatcatctcggactggagatttgtcctgtctggatcttacagcttcacctggctctgcggacacgtgcaccggaacatcctctccaagttcacaggccaggcggtggagctgtttgacgaggagttccgccacctctacgcctcctccaagcctgtgatgggcctgaagtccccgcggctggtcgcccccgtcccgcccggagcagccccggccaatggccgccttagcagcagcagtggctccgccagtgaccgcacgtcctccaaccccttcagcggccgctcggcaggcagccaccccggtacccgaactgacggctgagatgaggttagaatgactgggcccggctgaacattccaaattggatttcaccatctgctgagaaagtttaaggaaggcaaagcttgccaggtcacagaagctcccaagcccagctttccaaaggcctcagcctgtgcctgtgtcgagctcagtcctgggagataggggagaacctgcaggcaggaacaagcccccctactcctgaccaccctccatcagcagtctcccctccgtggtcgtctttgttgacaaaggtgcagtttctcctctcctgggcacctgtaacatgtgatgcgctgcctgctgggaggttaggtcggggctgccccggcgagtggagcatgagcagaaccgccgagggtcacttctgggcagaagctttgagagcctgggtccaggttgccacatagaagcagctctccagttgaaaccctcctctgccagcctggggtcctaagcgatgagcagaatcccccactcccaccccaccaacccacaatggatatgtagtgagcaagaaataaacctttgttgtttaa

SEQ ID NO: 3742 - DNA, 2006 bp, Homo sapiens
tcagcgatggccaagtatgggagaagccatgctggaatgaacatgtgggaccattttgtgcagtttctcagcgccaacactgactggtcccctgggctcgtgggccgccggcagcctcggctcgttctccagacagtgttccaagaagccacttccagcgaggaagcgttggcctgagaactggaacctctgcggtctctgcaaacacgacaatgacaaacacttgagagggcatgggagaaaggagctccttcatagggcagggaggggtgggcacttgggtgtgaccaaggagaggaggcgcgcctggtcaacagctctccctggcccgtgtccagctccctcctcacacagagaggggggcgcatctcagggatggcatctttcccccccacagggaaattcttatctttgaaacagcatgggaatcgaggcacccaggaggggagcagaggcaggcaggcctccttcaggcccatcctccagctgggctggtggtgccagggaggctccctgcttggtaacaaaggcctgagggagagttgcgaaacccagcaggaaagccggctcaccttcgcctccccctgcggctgggaggagaggaaatatcccatggctgactgtgccaaggaggtgtctgagccagccctcccggcccgagggcagggcaggtggccctgagagataagccaatcccgcagctgcagatgaggagttctgagaagcattgctcaggacagcggtaaatcacttcttggaggtgccctgcacgccggtcctgggagcaggcggcctcccgggggtgcgggagccccactcctccgtggtgtgttccatttgcttcccacatctggaggagctgacgtgccagcctcccccagcaccacccagggacgggaggcatgagccggtcaaggcacctgggcaaaatccggaagcgtctggaagatgtcaagagccagtgggtccggccagccagggctgactttagtgacaacgagagtgcccggctggccacggacgccctcttggatgggggttctgaagcctactggcgggtgctcagccaggaaggcgaggtggacttcttgtcctcggtggaggcccagtacatccaggcccaggccagggagcccccgtgtcccccagacaccctgggaggggcggaagcaggccctaagggactggactccagctccctacagtccggcacctacttccctgtggcctcagagggcagcgagccggccctactgcacagctgggcctcagctgagaagccctacctgaaggaaaaatccagcgccactgtgtacttccagaccgtcaagcacaacaacatcagagacctcgtccgccgctgcatcacccggactagccaggtcctggtcatcctgatggatgtgttcacggatgtggagatcttctgtgacattctagaggcagccaacaagcgtggggtgttcgtttgtgtgctcctggaccagggaggtgtgaagctcttccaggagatgtgtgacaaagtccagatctctgacagtcacctcaagaacatttccatccggagtgtggaaggagagatatactgtgccaagtcaggcaggaaattcgctggccaaatccgggagaagttcatcatctcggactggagatttgtcctgtctggatcttacagcttcacctggctctgcggacacgtgcaccggaacatcctctccaagttcacaggccaggcggtggagctgtttgacgaggagttccgccacctctacgcctcctccaagcctgtgatgggcctgaagtccccgcggctggtcgcccccgtcccgcccggagcagccccggccaatggccgccttagcagcagcagtggctccgccagtgaccgcacgtcctccaaccccttcagcggccgctcggcaggcagccaccccgttcctgaaagtaaacaaaacaaaacaaaaacaaaaaaacaaacaacactttggttcctgatggctttctga

SEQ ID NO: 3743 - DNA, 1787 bp, Homo sapiens
tcagcgatggccaagtatgggagaagccatgctggaatgaacatgtgggaccattttgtgcagtttctcagcgccaacactgactggtcccctgggctcgtgggccgccggcagcctcggctcgttctccagacagtgttccaagaagccacttccagcgaggaagcgttggcctgagaactggaacctctgcggtctctgcaaacacgacaatgacaaacacttgagagggcatgggagaaaggagctccttcatagggcagggaggggtgggcacttgggtgtgaccaaggagaggaggcgcgcctggtcaacagctctccctggcccgtgtccagctccctcctcacacagagaggggggcgcatctcagggatggcatctttcccccccacagggaaattcttatctttgaaacagcatgggaatcgaggcacccaggaggggagcagaggcaggcaggcctccttcaggcccatcctccagctgggctggtggtgccagggaggctccctgcttggtaacaaaggcctgagggagagttgcgaaacccagcaggaaagccggctcaccttcgcctccccctgcggctgggaggagaggaaatatcccatggctgactgtgccaaggaggtgtctgagccagccctcccggcccgagggcagggcaggtggccctgagagataagccaatcccgcagctgcagatgaggagttctgagaagcattgctcaggacagcggtaaatcacttcttggaggtgccctgcacgccggtcctgggagcaggcggcctcccgggggtgcgggagccccactcctccgtggtgtgttccatttgcttcccacatctggaggagctgacgtgccagcctcccccagcaccacccagggacgggaggcatgagccggtcaaggcacctgggcaaaatccggaagcgtctggaagatgtcaagagccagtgggtccggccagccagggctgactttagtgacaacgagagtgcccggctggccacggacgccctcttggatgggggttctgaagcctactggcgggtgctcagccaggaaggcgaggtggacttcttgtcctcggtggaggcccagtacatccaggcccaggccagggagcccccgtgtcccccagacaccctgggaggggcggaagcaggccctaagggactggactccagctccctacagtccggcacctacttccctgtggcctcagagggcagcgagccggccctactgcacagctgggcctcagctgagaagccctacctgaaggaaaaatccagcgccactgtgtacttccagaccgtcaagcacaacaacatcagagacctcgtccgccgctgcatcacccggactagccagaacatttccatccggagtgtggaaggagagatatactgtgccaagtcaggcaggaaattcgctggccaaatccgggagaagttcatcatctcggactggagatttgtcctgtctggatcttacagcttcacctggctctgcggacacgtgcaccggaacatcctctccaagttcacaggccaggcggtggagctgtttgacgaggagttccgccacctctacgcctcctccaagcctgtgatgggcctgaagtccccgcggctggtcgcccccgtcccgcccggagcagccccggccaatggccgccttagcagcagcagtggctccgccagtgaccgcacgtcctccaaccccttcagcggccgctcggcaggcagccaccccggtacccgaactgacggctga

SEQ ID NO: 3744 - DNA, 3167 bp, Homo sapiens
aaaccttcggcggccggcgctgtgcggcgggcgcggttgcgcgcggcttggggcaaatacttctcaccactgcatgaatggacatttgaaagtgccatagccaaacacttgcaagcatggagacctcatcaatgctttcctcattgaatgatgagtgtaaatctgacaactacattgagcctcactacaaggaatggtatcgagtagccattgatattctgattgaacacgggttagaagcataccaagaatttcttgtccaggaacgagtttcagactttcttgctgaggaagaaattaattatattttgaaaaatgtccagaaagttgcacaaagcacagcacatggtactgatgattcctgtgatgataccttatcttcagggacctactggcctgttgagtctgatgtggaagctccaaatcttgacttaggctggccatatgtgatgcccggactcttagggggcacccatatagatctcctttttcatccaccaagagcacatctacttacgataaaagaaactattcggaagatgataaaagaagcaagaaaggtcattgctttagtgatggatatatttacagatgtggacattttcaaagaaatcgttgaggcatcaactcgaggagtatctgtttacattctgcttgatgagtccaattttaatcattttctaaatatgactgagaaacaaggttgttcagttcagcgtctcaggaatattcgagtgcgaacagtaaaaggccaagattatctttcaaaaacaggggcaaaattccatggaaaaatggaacagaaatttttgttagttgactgccagaaagtgatgtacggttcttacagttatatgtggtcatttgagaaagctcacctcagcatggttcagataattacaggacaacttgttgagtcctttgatgaagaatttagaactctctatgccagatcctgtgtccctagttcatttgctcaggaagaatcagcaagggtgaagcatggaaaagccctctgggaaaatggcacttaccagcattcggtgtcttcattagcatctgtttccagccagagaaacctttttggtagacaagacaagattcataaactagattccagttacttcaaaaacagagggatatatactttaaatgaacatgacaaatataacataagaagtcacggatacaaacctcattttgttcctaactttaatggtccaaacgcaatacgtcagtttcaacccaatcagataaatgaaaattggaaaaggcatagttatgctggggaacagccagaaacagtgccatacctcctgcttaatagggctctgaatagaaccaataatccacctggtaattggaaaaagccatctgatagtctcagtgtggcgtcctcatcacgggaaggctatgtaagccaccacaacacacctgcccagagttttgccaatcggcttgcgcagagaaaaacaacaaatcttgcagacaggaattcaaatgttcggaggtcttttaatgggacagataaccatatccgctttttgcaacaacgaatgccaacccttgaacataccacaaagtcattcctacgtaactggagaattgaatcctacttaaatgatcattcagaagctacaccggactcaaatggatcagctttaggtgaccgatttgagggctatgataatcctgagaatttgaaggccaatgccctttatactcattctcggcttcgttcctctttagtatttaaacccactttacctgagcaaaaggaagttaacagttgtacaactggctcctcaaattcaactatcattggttctcagggaagtgagacacctaaagaggtcccagacacccctacgaatgtacagcatttgacagacaaacccttgccagaatcaatccccaagctcccattgcagtcagaggcaccaaaaatgcacaccttgcaggttcctgaaaaccactcagtagccttaaaccaaactacaaatggccatactgaatcaaataactatatatataaaaccttgggtgtaaataagcagacagaaaatctaaagaatcaacagactgagaatctacttaaaaggcgaagtttcccgttatttgacaactcaaaagccaacttagatcctggaaatagtaagcattatgtatatagtacacttaccaggaatcgagttagacaaccagaaaagcccaaagaagatttgctgaaaagttctaaaagcatgcacaatgtgactcataacttggaggaggatgaggaggaagttaccaagagaaactctccaagtggcactactaccaaatcagtttccattgctgctttacttgatgtgaataaagaggaatctaacaaagaacttgcttcaaagaaggaagttaagggttccccaagttttttgaaaaaggggtctcagaagttaaggtcattacttagccttaccccagataagaaagaaaatctatccaaaaataaagcacctgccttttatagattgtgtagtagctctgacacattagtttctgagggtgaagaaaatcaaaaaccaaagaaatcagacacaaaagttgattcatctcctagaagaaagcattcttcctcatcgaattctcaaggcagcatccacaagagtaaggaagatgtaacagttagcccatctcaagagataaatgctccaccagatgaaaataaaagaacaccttctccaggtccagttgaaagcaagttcttggaaagggcaggagatgcctctgccccaagatttaacactgaacagatccaataccgagattcaagggagattaatgcagttgttacccctgaaagaagacctacttcttctccaaggccaacgtccagtgagcttctacgatctcattcaactgatcggcgtgtttacagtcgttttgagccgttttgtaagattgagagctctattcagccaacaagcaacatgccaaataccagtataaatcgcccagaaataaaatctgcgactatgggcaacagttatggcaggtctagtccattgcttaattacaacactggtgtttatcgctcatatcaacccaatgagaacaagtttcgaggatttatgcaaaagtttggaaactttatacacaaaaataaatagctattaaaatgcaaa

SEQ ID NO: 3745 - DNA, 3145 bp, Homo sapiens
gcagaaggcggttctgctggtctcctcttcctgctgcagccagcccagcgtgcgggccatgggccctgccggcgggtgaggcagccgcgtggcaggcatgttcggaggcccggggcctggggtcctgggagcccagggcatggcgggacccctgcggggccgggtggaagagctgaagctgccgtggtggcgggagagctcaccgctggtgctgcggcacagcgaggcggctcggctggcggccgacgccctcctggagcggggtgaggctgcctacctgcgggtcatctccgaggagcgggagctgcccttcctgagcgccctggatgtggactacatgaccagccatgtgcgcgggggccctgagctcagcgaggctcaggggcaggaggcctccgggccagaccgcctcagcctgctctctgaagtcacctcagggacttacttccccatggcctctgacatagaccccccagacctggacctgggctggcccgaggtgccacaggccacaggcttcagccccacccaggctgtggtccacttccagagggacaaggccaagaacatcaaggacctgctgcgcttccttttcagccaggcccacacggtggtggctgtggtgatggacatattcactgacatggagcttctgtgtgacctcatggaggcctcaagccggcgtggtgtccctgtgtacctgctccttgcccaggagcacctgaggcacttcctggagatgtgctacaagatggacctcaatggggagcacctgccgaacatgcgtgtgcggagcacgtgtggggacacatactgcagcaaggctggccgccgcttcacggggcaggccctggagaagttcgtcctcattgactgtgagcaagtggtggcgggcagttacagcttcacctggctttgcagccaggcccacactagcatggtgctgcagctgaggggccgcatcgtggaagactttgaccgggagttccgctgtctgtacgctgagtcgcagcctgtggagggcttctgtggcggtgaggacccgctgtctccccgggcactgcgtcctccccctgtggccctagccttcaggcctgatgtcccaagccccacgtcgtccctgccctccagcaccagcctcagcagcatcaagcagtcaccgcttatgggtcgctcctcctacctcgctctaccaggaggtggtgattgcagtgatacgggtgtggtgtcctcgtccctgggtcctgcccgccgtgaggccagtggccagccctccctacatcgccaactgtcagaccctaaccacggctcccctcctgggctctatagggccaatctcggcaagctaggggcatacccatggtcccagtcctcccctgccctcaaccataatagtaccagccccttaaccttggcagtggggtcacctctgcttcctcgctcccggcccctcctccagttccatcggggtgccccagctctgtcccggttcccagagaatgggctcccaggaagccaagagcccagccccctgcggggtcgatgggtacctggcacaaccctggagacagtggaggagaaggagaagaaggcatctccaagtcagagccgtggccagctggatctccttgtccccttccccagagcccgagaagtgggagaccctgactctggggttacccccaactcaggcccccttcggcctggcgagcaggccccagaggacaggaggttgtccccaagccaggccgacagccagctggatctcctgtcccgagccctgggtactgggggtgcccctgagttgggttccctcagacctggtgatcgggccctggaggacaggaggctgtccctaaaccaaagccgtggccaatcagacctcctgatgcagtaccccaaggcccagggttccagagtgccccttgaaaccaactcctcagccagacctgccagacgggcaccagatgagcggcggcagaccctggggcacagccagctggacctcatcacaaagttcggcccattccgtggtgaggggcctgggcccaatggtctcccgatatcaagccctgctcgcacggctggagctgggtctggggatgagaaacggctaaccctgggccacagcaagctggacctcatcaccaagtatcatcagttgcacggggccaggcagggaactgagcctgggggtcccaagggtggccatctcaatggtggtaacagtgacctggtcagggatgagaaacggctgaccctgggtcacagcaaactggacctcatcactaagtacaacaagtccaagttcaagcagctccgaagccgctttgagtcctagccaaaggactggcatcgggggtgcactggcaagggcaggcccctcctctgtccaccgagactctggacttgctcaggtcccagactggggaagggaggtgtctagaaacccaggtcagacacactctctgggctcaagattcttgtgtacacacacacacacacacacacacacacacaccctaactagtatcttcttgaatctaggctgtgtttccagccctgtgctgggcctgtagagctgacaggtgggtcacactcagacctggggacagaggtgaaatgcacaagctgctggagaaggggtcagagccatatcaagttaaaggttaaccagttacagagggtgttagaaaacaaagggcagagagtcctggagaaggtggagtagtcagaaaactttcttagaggagatggaggtggcctttgagccaggccctgaaggatggggaggttttggacagagggaggagagagttagaaaaatttttggtagagagaatcaggtgaaagagatgccctaaagaggactgagtgggtctgaggtgaatgagtgaggaagagcagagtatgtggatacccggaaacacacacacacacacatcatcattatcatcatcatcattgtcgtcgtcatcatcttgctgagtcatcatcatcatcatcatcattgtcgtcgtcatcatcttgctgagtgtctcttgaagtacaggctgtgacaggttgtgggccattttcctgaactcaccacttacccgggatagtaaacatgatacacatcaataaaggcagactttattgtgaa

SEQ ID NO: 3746 - DNA, 2011 bp, Homo sapiens
cagagacagccagacccccggggacccagcctctcacagtcagtcctcccacccgagtgaccccgatggcggcctcccagctggcggcgctggaaggagtggactccggtcccagggtgcccggggccagccccggctttctatattccgagggccagcggctggcactggaggctctgttgagcaagggcgcggaggcgttccagacctgcgtgcagcgcgaggagctgtggcccttcctcagtgcggatgaggttcagggcttggcagcggcagctgaagactggacagtggccaagcaggagcccagcgggatggcagagggagccaccaccaccgatgtggacgcgggcagcctgagctactggcctgggcagtcggagcagccggcgcccgtcctgcggctgggctggccagtggactctgcgtggaaaggcatcacccgggcgcagctgtacacccagcctcctggagagggtcagccgcccctcaaggagctggtgcggctggagatccaggctgcccacaagctggtggccgtggtcatggacgtcttcactgacccagacctgcttttggacttggtggatgctgccacgcgccgctgggtacctgtctacctgctcctggaccgccagcagctgcctgccttcctggaactggcccagcagctgggggtgaacccctggaacacggagaacgtggatgtccgtgtcgtgcggggctgcagcttccagagccgctggcgacggcaggtgagcggcaccgtgcgggagaagtttgtgctgctggacggcgagagggtcatctcaggatcctacagcttcacgtggagtgacgcacgcctgcaccgaggcctggtgaccctgctgactggtgaaattgttgacgccttcagccttgagttccggacgctgtacgcggcctcctgcccgctcccacctgcgcccccccagaaaccctcggtcataggtggcctgcagcggggccgcagcccgcaccgcgtgtcccgccgccgctccgtggcccccgcgtcgcctccgccgcctgacggcccgctggcccaccgcctggccgcctgccgcgtctcccctgctaccccggggccggcactcagtgacattctaaggagtgtgcagcgcgcccggacccccagcggccccccggcccggcccagccgctccatgtgggacctaagccgcctgtcccagctgtctggctccagtgatggggacaacgagctcaagaaatcctggggctccaaggacactccagccaaggctctgatgaggcagcggggcactggaggaggcccctggggggaagtggactcccgacctccgtggggcggtgccctgcccctgccccccgcccaccgcctccgctatctgtccccagcccgaaggcggttcggtggggatgctacattcaaacttcaagagcccagaggcgtcaggccgtcagactgggccccccgggcaggacttggggggcaaccctgaacaggagcccaagccaaatctgctggcccacccaaggagcagtgccggacaactgtcggctcagagccctctgcctcaatgccctgccttggacaaggcttctggcctcggcgtctgtcaagcagaagggatgtttgtcacttgttctgcaacttgggccgggagtggtggctcatgcctgtaatccctgcactttgggaggctaaggtgggagggttgcttaaggccaggagttggagaccagcctgggcaacatagtgagaccccatctctacaattaaaaaaacaaattagttgggtgtggtggcgcacgcctgtggtcccagctacgcaggaggctgaggtgggaggatcccttgagctcaggaggtggaggcagcagtgagccaagatcatgcccttgcactccagcctgggcaacacagtgagaggccatctctttaaaaaaaaaaaaaaaagaaaaaagaaaaagaaaggctgatcgaggtggctcactcctgtaatcccag

SEQ ID NO: 3747 - DNA, 2071 bp, Homo sapiens
gaggcgccccgcccctcggcggctccaggtgcggctgtgggacctcggaccgcggcggggccggggccagggccggggccggggccggggcgccatggccgagtcccagctgaactgcctggacgaggcgcacgtgaacgagaaggtgaccgaggcgcaggccgccttctactactgcgagcggcggcgggccgcgctggaggcgctgctgggcggcggcgagcaggcctaccgcgagcggctcaaggaggagcagctgcgggacttcctctccagcccggagcgccaggccctgcgggccgcctggagcccctacgaggacgccgtccccgccgccaacgcccggggcaagagcaaggccaaggccaaggcccccgcgccggcgccggctgagtccggcgagtccctggcctactggcccgaccgttccgacaccgaggtgcctcctctggacctgggctggacggacactggtttctaccgcggcgtgagccgggtcacgctcttcacccacccgcccaaggacgagaaggcgccgcacctcaagcaggtggtcaggcagatgatccaacaggcccagaaggtcattgctgtggtcatggacctcttcactgatggtgatatctttcaagacattgtggatgctgcctgtaagcgccgggtcccagtgtacatcatcctggacgaggcaggagtgaagtatttcctggagatgtgtcaggacctgcagctcactgacttccggattcggaacatccgtgtccgctctgtgacaggcgtcggcttctacatgcccatggggaggatcaaggggaccctgtcatcaaggttcctgatggtggacggtgacaaagtggccactggatcttacaggttcacctggagttcctcccatgtggacagaaacctcctcctgctcctgacaggacagaacgtagagccctttgacacggagttccgggagctgtacgccatctccgaggaggtggacttgtaccggcagctgagcctggcgggcagggttggcctccattactcctccactgtggctcgaaagcttatcaaccccaagtacgccttggtgtcaggctgccgccacccgcctggggagatgatgcgctgggctgcccggcaacagcgggaggcgggcggcaacccggaggggcaggaggagggcgccagcggtggcgagtcggcctggcgcctggagagcttcctgaaagacctggttacggtggagcaggtgctgccccccgtggagcccatccccttgggagagctgagccagaaggatggcaggatggtctctcacatgcacagagacctgaagcccaaatcccgagaggcacccagccgaaacggcatgggagaagcggcccggggggaggccgcccccgccaggcgcttcagcagcaggctcttcagtcgccgagccaagaggcctgcggcgcccaatggcatggccagctctgtctccaccgagacctctgaagtggagtttctgacggggaagaggcccaacgagaattccagtgctgacatctcaggtaaaacaagtcccagttctgccaagcctagcaactgtgtgatttcctgagctgcgggatggtggtgggcaggacgtgtggatgcctgcctgccctgccctgtgctgtggagagcgcaggtcgcacactgcaccagtttgcacatcagacgccaactggccttctgccctgcagcctccgtcctggcctcagggacgctggatcccaaatgagagggtccgaagcatctcagtcacacgcctccaccggactgtcggtggctgggcaggggtcagtgccacggcctccttgtttacatgaagtggaagcttgaccagtgtctgctcgcctttgtgccccaccccctccgctgattgccagatggggtgagggcccattctttaaacctttatggggtggggtgtctggggcagctgcagtggcttctcctttcccaggcttcctggtgcttctggttccccacgccactccccacccaagagattggtggaataaaagggaagagggcagggccctgagcctgg

SEQ ID NO: 3748 - DNA, 2929 bp, Homo sapiens
gcccccgccgcccctccccgcgcggcccgccctccccgattgctcatgggcagagaagcagaggccgcggagaggcccccgagcgcgcggtgccccagctgggccggagctaggagctggaccttgcccacccacccccggcagcagtgcccgggcaggcggcgccatggccttctctcaggtgcagtgtctggacgacaaccatgtgaactggcgctccagcgagtccaagcctgagttcttctacagcgaggagcagcggctggcgctggaggccctggtggcccgcggccgggacgccttctacgaggtgctcaagcgggagaacatccgagacttcctctcggagctggagctcaagcgcatcctggagaccatcgaggtgtacgacccgggctctgaggaccctcggggcacgggcccctctcaggggcccgaggacaatggggtcggcgacggcgaggaagccagcggggcggatggggtccccatcgaggccgagccgctgccctccctggagtactggccccagaagtcggaccgctccatcccgcagctggacctgggctggcccgacaccatcgcctaccgcggcgtgacccgggctagcgtctacatgcagccccccatagacgggcaggcccacatcaaagaggtggtgcggaagatgatcagccaggcacagaaggtgatagctgtggtcatggacatgttcaccgacgtggacatcttcaaggacctgctggacgccggcttcaagaggaaagtggccgtgtacatcatcgtggatgagagtaacgtcaagtacttcctgcacatgtgtgagcgggcctgcatgcacctggggcacctcaagaatctcagagtgcggagcagcgggggaactgagttcttcacgcggtcggcaaccaagttcaagggtgccctggcccagaagttcatgtttgtggatggagaccgggctgtgtgcggctcctacagcttcacgtggtcggccgcgcggacggaccggaatgtgatctctgtgctgtctggccaggtggtggagatgtttgaccggcagttccaggagctgtacctcatgtcacacagtgtgagcctcaagggcatccctatggagaaggaaccggagccggagcctattgtgctgccctctgtggtccccctggtgcccgcgggcactgtggccaagaagctcgtcaaccccaagtacgcacttgtcaaggccaagagcgtcgacgagattgccaagatctcctctgagaagcaggaggccaagaagcccctggggctgaaaggcccagcgctggctgagcatccaggggaactccccgagctgctgccacccatccacccaggactgcttcacctggagagggccaacatgtttgagtacctgcccacgtgggtggagccagacccggagcctggcagcgacatcctgggctacatcaatatcatcgaccccaacatctggaacccccagcccagccagatgaaccgcatcaagatccgtgacacctcccaggccagcgcccagcaccagctgtggaagcagagccaggacagcaggccccgtccagagccttgccctcccccagagcccagtgccccccaggacggtgtcccagctgagaacggcctcccccagggggaccctgagccattgccccccgtgcccaagccccggacagtccctgtggcagatgtactagcccgggacagcagtgatattggctgggtcctggagctccccaaagaggaagctccccagaatgggacagaccataggctacccaggatggcaggcccaggccacgccccactccagcggcagctatctgtgacccaggatgaccccgagagcctcggggtggggctccccaatgggctggatggggtggaagaagaagatgatgacgactacgtaaccctcagtgaccaggacagccactcaggcagctccggccgtggccctggcccccgacggccctcagtggcttcctctgtgtcagaggagtacttcgaggtgagagagcactcagtccctctccggaggcgccactcagagcaagtggccaacgggccaaccccaccaccgcgccggcagctgagtgccccccatataacccgagggacctttgttggaccccagggtggctccccatgggcccagagtcggggaagagaagaagcagatgcgttgaagaggatgcaggcccagcgctccacagacaaggaggcacagggccagcagtttcatcatcacagggtccctgcctcagggactagggataaagacggcttcccaggaccccctaggtaccgctctgctgctgacagcgtccagagctctaccagaaacgctggcccagccatggctggcccccaccactggcaggccaagggaggtcaggtaccccgcctgcttccggatcccggcagcccaagactggcccaaaatgcccgccccatgaccgatggcagggccaccgaggagcatccgagtcccttcggaatcccatactccaaactgtctcagtcgaagcacctaaaggccaggacgggcggtagccagtgggcctcatcggattctaaacggagggctcaagccccccgggaccgcaaagacccctagcagcatgtcccagcctggagccacaccttctgaggccccagcccagactcatgacgcggagggcagacaggccgcctgggcctaccagagcccactgggacggcaggaaggtgggatgggcgggagacgttggcactcacctggtcggtgcaccagtaccaggtggccatgatggtcaggccaaaggtcatcccggtccacggcaggtcccctgtgtgggggtctcgaaacatgtgcatggcgtctgtacgtggcaggtggcaggtggtgttggcaatggtcctggaggga

SEQ ID NO: 3749 - DNA, 5069 bp, Homo sapiens
ggcagcagtgcccgggcaggcggcgccatggccttctctcaggtgcagtgtctggacgacaaccatgtgaactggcgctccagcgagtccaagcctgagttcttctacagcgaggagcagcggctggcgctggaggccctggtggcccgcggccgggacgccttctacgaggtgctcaagcgggagaacatccgagacttcctctcggagctggagctcaagcgcatcctggagaccatcgaggtgtacgacccgggctctgaggaccctcggggcacgggcccctctcaggggcccgaggacaatggggtcggcgacggcgaggaagccagcggggcggatggggtccccatcgaggccgagccgctgccctccctggagtactggccccagaagtcggaccgctccatcccgcagctggacctgggctggcccgacaccatcgcctaccgcggcgtgacccgggctagcgtctacatgcagccccccatagacgggcaggcccacatcaaagaggtggtgcggaagatgatcagccaggcacagaaggtgatagctgtggtcatggacatgttcaccgacgtggacatcttcaaggacctgctggacgccggcttcaagaggaaagtggccgtgtacatcatcgtggatgagagtaacgtcaagtacttcctgcacatgtgtgagcgggcctgcatgcacctggggcacctcaagaatctcagagtgcggagcagcgggggaactgagttcttcacgcggtcggcaaccaagttcaagggtgccctggcccagaagttcatgtttgtggatggagaccgggctgtgtgcggctcctacagcttcacgtggtcggccgcgcggacggaccggaatgtgatctctgtgctgtctggccaggtggtggagatgtttgaccggcagttccaggagctgtacctcatgtcacacagtgtgagcctcaagggcatccctatggagaaggaaccggagccggagcctattgtgctgccctctgtggtccccctggtgcccgcgggcactgtggccaagaagctcgtcaaccccaagtacgcacttgtcaaggccaagagcgtcgacgagattgccaagatctcctctgagaagcaggaggccaagaagcccctggggctgaaaggcccagcgctggctgagcatccaggggaactccccgagctgctgccacccatccacccaggactgcttcacctggagagggccaacatgtttgagtacctgcccacgtgggtggagccagacccggagcctggcagcgacatcctgggctacatcaatatcatcgaccccaacatctggaacccccagcccagccagatgaaccgcatcaagatccgtgacacctcccaggccagcgcccagcaccagctgtggaagcagagccaggacagcaggccccgtccagagccttgccctcccccagagcccagtgccccccaggacggtgtcccagctgagaacggcctcccccagggggaccctgagccattgccccccgtgcccaagccccggacagtccctgtggcagatgtactagcccgggacagcagtgatattggctgggtcctggagctccccaaagaggaagctccccagaatgggacagaccataggctacccaggatggcaggcccaggccacgccccactccagcggcagctatctgtgacccaggatgaccccgagagcctcggggtggggctccccaatgggctggatggggtggaagaagaagatgatgacgactacgtaaccctcagtgaccaggacagccactcaggcagctccggccgtggccctggcccccgacggccctcagtggcttcctctgtgtcagaggagtacttcgaggtgagagagcactcagtccctctccggaggcgccactcagagcaagtggccaacgggccaaccccaccaccgcgccggcagctgagtgccccccatataacccgagggacctttgttggaccccagggtggctccccatgggcccagagtcggggaagagaagaagcagatgcgttgaagaggatgcaggcccagcgctccacagacaaggaggcacagggccagcagtttcatcatcacagggtccctgcctcagggactagggataaagacggcttcccaggaccccctaggtaccgctctgctgctgacagcgtccagagctctaccagaaacgctggcccagccatggctggcccccaccactggcaggccaagggaggtcaggtaccccgcctgcttccggatcccggcagcccaagactggcccaaaatgcccgccccatgaccgatggcagggccaccgaggagcatccgagtcccttcggaatcccatactccaaactgtctcagtcgaagcacctaaaggccaggacgggcggtagccagtgggcctcatcggattctaaacggagggctcaagccccccgggaccgcaaagacccctagcagcatgtcccagcctggagccacaccttctgaggccccagcccagactcatgacgcggagggcagacaggccgcctgggcctaccagagcccactgggacggcaggaaggtgggatgggcgggagacgttggcactcacctggtcggtgcaccagtaccaggtggccatgatggtcaggccaaaggtcatcccggtccacggcaggtcccctgtgtgggggtctcgaaacatgtgcatggcgtctgtacgtggcaggtggcaggtggtgttggcaatggtcctggagggaatggcctgggcgtaggctgcctccagctgcccgtaaccaccgatctggtcaaaagctggaggggtcagggtggaacagggacagtttggtggttgcggggccctgactccctgggctcccccctgccttcatctcacaagaaacttcctgatgcatcaaacttgagttttttccacctcatctttcccagtgtttggaaaggtgtgagggtagagggttgtttttttttttaaggtgtatttgaatgactattttattcgtatttaaaataatactattaagtaagcattttgcacatgggcaccccagtgtcccgctggcccagcaggagtcactgttggcctctggacactcatcggccttgggcaagtggttctcagccaggtttccgattgtcgattcaaggaagcaaaagtaatttttcttgacatttgaggaccttcctgaggcttctaaagtgttcatcctgatcacctgaagggtgtgattttagcagagctgagagtggctggtggtgatgtggccccaccccctgaggcacagagaagagggagacaggtccagagagggatggggcctccaccaagaccatatagaccatctggcgggctcaagccggggctttttcctctccagtccaaaacacctcactgttcctgtctacctcggggtcagggcccggcatggccaagccctggcccatctgtgtctgtgtcactcccctcccttccagactgggcctggctgctgggatccctctcatgcggtgggtcccagggacactagagcccctggtctgagagggagaagcctggatgtaggaaaacccgtttccaccccaggccctactccctagccttttccaagtgggacatggaagaggcagcctgctgcctggatgctggtctccccagcatcactgttcccatggagctcaggtcaggctctgtattcagaccgagggtttgtgtgaggctcagagcaaatgaacaagtgccattcaagggttagaaactgctcagccacagggtcccagtgtctgagtctggaagagtctttagagatttgttcactctctgagggatcctcctggctctgcttacatacttccagggacggtgagctcacgctctctccgggcagccctgtgagtttcctatctgttccagactagtatcgccaatctctcccagctctcttctttcctccctggcctttgtcctgcaggaggtagcatcacctcttggcattttgtacatgcttttaaacaattggaggagctgcccaggcagttttatggcctcctggttgtgtgccttcacacccgcctacagccccacctcaccatcaagcgctgagccaatgcgggtgtggctggccctgagttcctgagtcagctccttgccagggccagagctggtaacagcggggcagcagggtgggtagcctctaccagccagggcagtccctgaggggccagcaggggggctgactgcctagtggctcaacctcctgaacccacccactcccagcgatgctacccagaaccccaacggcatgaatcctgcacagtgccgggcagtgccagactccaaagggctcgctgtggggacagccccgccatggccacagactctgtcctcacctttgattgtcaggatgacagcccccaccaccatgatgagcgtctgcagggcgtccgtgtagattacagcagccaggccccctgccagtggaagcaaggttgctggagggggccctggccccagggaggagggacacggggaggaacttctggggctcctgctggggccacttcctgggctgctccctcgggcctgtagggggaggtggccttctgacccctttacacgtcccctgggtggacctccctgctgcaggcaccatacctgcgatggtgtacagggctgtgatgccgagcgtgaggatggtggagaggtagaagttccagcccaggcagatgtgcacaaacagagcccccgcgtacaggtccagctgcggagggagagagccttgtgtgggactgttattcccagggctccagcaagccactccctgggtgacctcgggcaaggccctctctgggcctcggtggcctgtggataaggaggggagacccccactcgcctgcctgcctgcatcacggggccattgtgaggttgggggaagacctggccgtggagctacaagcttgtgcggatgtcaggggacattactgttgctaataaagtccaaagtggccaatgcctttcccaaaa

SEQ ID NO: 3750 - DNA, 6681 bp, Homo sapiens
agcggggcggccctgagtcaccggcgcgcccccgcccagcctcgcgccgccgccgcagccgccgcgtgtgcgccccgctccgccagcgcccgctcgattgctcatgggcagagaagcagaggccgcggagaggcccccgagcgcgcggtgccccagctgggccggagctaggagctggaccttgcccacccacccccggcagcagtgcccgggcaggcggcgccatggccttctctcaggtgcagtgtctggacgacaaccatgtgaactggcgctccagcgagtccaagcctgagttcttctacagcgaggagcagcggctggcgctggaggccctggtggcccgcggccgggacgccttctacgaggtgctcaagcgggagaacatccgagacttcctctcggagctggagctcaagcgcatcctggagaccatcgaggtgtacgacccgggctctgaggaccctcggggcacgggcccctctcaggggcccgaggacaatggggtcggcgacggcgaggaagccagcggggcggatggggtccccatcgaggccgagccgctgccctccctggagtactggccccagaagtcggaccgctccatcccgcagctggacctgggctggcccgacaccatcgcctaccgcggcgtgacccgggctagcgtctacatgcagccccccatagacgggcaggcccacatcaaagaggtggtgcggaagatgatcagccaggcacagaaggtgatagctgtggtcatggacatgttcaccgacgtggacatcttcaaggacctgctggacgccggcttcaagaggaaagtggccgtgtacatcatcgtggatgagagtaacgtcaagtacttcctgcacatgtgtgagcgggcctgcatgcacctggggcacctcaagaatctcagagtgcggagcagcgggggaactgagttcttcacgcggtcggcaaccaagttcaagggtgccctggcccagaagttcatgtttgtggatggagaccgggctgtgtgcggctcctacaggtgactctccagctttcagggaagttgtgcgagaggtacctctggctcccaactggcttctgcccttaatcctaaccctggttattccggttcattggtcccaaggctgctgaggtgtgcgcagggctggagcacatctgcccgcctgtctgtctctggaggcaggcagagaagggctttgtctgaggacgctgttgttccagcttggagatgtcaccggcctggaggtggggtgtggccaggccgtgccttcgcaagcctatgggggtcactctgagagccgtccttagggatggggccagctctgtgggcaccaccacatggggcatggggtgggcgctgcccatggttacatgggggttggtggcagcatagacgcatggcagcagcggccaccacatgcagaaccccccacagtgtccagggccttcctgagctgcttagtgaatcctgtaccagcctgagaggagcacagtgccctgtcatttgcagaggtgggaatgggcttggtgcaaccaacttgcttgacatccgactcagtctgaccccacagtatgcacctgctctctgcccccattcacttcttgatcccagggccctgtggccacagtctgaggcccagcggctatgggtgcacgggggctgggcggaggaagcagggtcatgtgcctgaccagcgccccctccctctgttgcagcttcacgtggtcggccgcgcggacggaccggaatgtgatctctgtgctgtctggccaggtggtggagatgtttgaccggcagttccaggagctgtacctcatgtcacacagtgtgagcctcaagggcatccctatggagaaggaaccggagccggagcctattgtgctgccctctgtggtccccctggtgcccgcgggcactgtggccaagaagctcgtcaaccccaagtacgcacttgtcaaggccaagagcgtcgacgagattgccaagatctcctctgagaagcaggaggccaagaagcccctggggctgaaaggcccagcgctggctgagcatccaggggaactccccgagctgctgccacccatccacccaggactgcttcacctggagagggccaacatgtttgagtacctgcccacgtgggtggagccagacccggagcctggcagcgacatcctgggctacatcaatatcatcgaccccaacatctggaacccccagcccagccagatgaaccgcatcaagatccgtgacacctcccaggccagcgcccagcaccagctgtggaagcagagccaggacagcaggccccgtccagagccttgccctcccccagagcccagtgccccccaggacggtgtcccagctgagaacggcctcccccagggggaccctgagccattgccccccgtgcccaagccccggacagtccctgtggcagatgtactagcccgggacagcagtgatattggctgggtcctggagctccccaaagaggaagctccccagaatgggacagaccataggctacccaggatggcaggcccaggccacgccccactccagcggcagctatctgtgacccaggatgaccccgagagcctcggggtggggctccccaatgggctggatggggtggaagaagaagatgatgacgactacgtaaccctcagtgaccaggacagccactcaggcagctccggccgtggccctggcccccgacggccctcagtggcttcctctgtgtcagaggagtacttcgaggtgagagagcactcagtccctctccggaggcgccactcagagcaagtggccaacgggccaaccccaccaccgcgccggcagctgagtgccccccatataacccgagggacctttgttggaccccagggtggctccccatgggcccagagtcggggaagagaagaagcagatgcgttgaagaggatgcaggcccagcgctccacagacaaggaggcacaggtgggtcagggtccctgcacaccaggggtcacgagtccctccctgccagccacccaagagctcgagctgttgtcttctgggctaccatgtccctgactctgatgacttcaattcccttgttacagatggggaaacttgatgaacaggcaggggtgggaaccggccagggccatatggaaggccatcattaatgctggggactcttggtcccagcatcctgaaaaggcaacctaagaaaatgcacgtttccccacctagaggtctccaaagcctgtggttagaggatcttgatggcacctgccagatgggtggcacagtccctagtttgcagatgaggaaaaggcggggcacagggacgttcatttacagccttgaggtcacacagcagtaagtgatacctgtccagaccttgtgccaagccacatccatgttaatccctttgattgtggccctgaggaccactctccccactccccaggttggggaacagttcacatctatcctttgcctcttcttctggtgacgtttgcaggacaaggtcccagaaccctgggtgccctgcagcctgggttcagtgcccggagcccgtcctacctgggaacaatgcgcggctgatcatgcccggcatgatgatcaggcccatggggagcatcttgaggtagctggccaggatggagcccgccttggcatggttcaggtcccgggctgacagtgatcgctgcacgatgacctgggggtggagtgcgagacggggtgagtccaagcctgagggacacttgtgtcaggattggtccttggtgggcctcagggaatgggcatgaggcacgatgatgtcccattagcctctgacctgcccaaaacagccacactcaaagccccaatactgtcagggtcccaccaggagagctcacttcagcaggccaagcagcgagagccgaggtacactcattcccagggactcagtcccctgacctgtcaataggggaggtgtggatcctgcccagcccaccacccctggcaattgtcagggctggaggagaccctgggtggggtggtatggggacatacacccctaccctcatctcctggaccctcatgacagcagctggcacatttatagtgccaggagcagacactggcgccaactgtgtttgcatggctggcagagttcaggtgctttaagacctggggttttgaaagcttgcagttcagtagcagagggaggctagaagctatctgaggacaccggcccttctgggagccttcagcaaatcctaaccaggcctttccagatttgcagaatgggaggagggagcggtaatttggacccataatgtctgagatctctcccagcactgatattacgattctacttcaaaagagttactttttttttgagtcggagtcttgctctgtcgcccaggctggagtgcagtggtgcgatctcggctcactgcaagctccgcctccgggttcacgccattctcctgcctcagcctcccaagtagctgggacaacaggcgcctgccaccacgcccggctaattttttgtatttttaaaatagagacgaggtttcaccttgttagccaggatggtcttgatctcctgacctcgtgatcgcccgcctcgacctcccaaagtgctgggattacaagcgtgagccaccgtgcccagcccaaaagagttactttttaaacagctttattgagatattcacagaccatataattcacccaaagtgtacactgttcccatggtttttagtacgttcacaaagttgtacgacctatgactctgaaacgtaactagttttcctttgcggttccacagtttaagtcaccagctgcaactcaggagcaggaagcctctatgattttttttttctttgagatggagtttcactcttgttgcccaggctggagtgcaatggcgcaatctcgggtcaccgcaacctctgccttccagggttcaagggattctcctgcctcagcctcccaagtagctgggattacaggcatgagccaccacgcccggctaatttttttttgtatttttagtagagatggggttttaccatgttggtcaggctggtcttgaactcccgacttcaggtgatctgcccgcctcggcctcccaaagtgctgggattacaggtgtgagccaccgcatccggctgcctccgtgattttaacttactttccaagcttgctagtttaacggacggctcccagcatttacccctaagctgtggatgtcacggaaacattaattacagaggctaggaatgcctgcgggctgcagcctccgaacgcagggcaagctgctgtccttcctgcttctctgccagcttgctgtgacttgggagaagcccttgcctcagtttgggcctcagttgccccatctggacaatgagagagttagacggtggttctgtctaggtgcttgggagagaagcatttccctaagaccctgaatgtctttttgccattggtgggatatttgcctctatattccaatctgtgctcatgtcagctggccctgggacaggtgctgtcaccccaagtagagaagctgaggctcagagtttccatgagctgtgaggcctgccagtccccctgaatagggcaggggctttccccacccctgactgtcagatagcaaggctgggcccccaactcagatgtcagcaggccactgctcacccccacctcccagcactggtgtctagtcccagccaggcgctcttccctgaggaagccggcactcactccctgagtggccatttcaccttgggctcctcatctgcaaaatgaggagagttgttgcaacgacttaagtgaggctgctagtgtagccggccaagcctgtccctggctcctcaagggcctccggtgaatgtgagttctctttctcagggaagatgatgagtgagttttggggtgtggccattggagtcagcacgctgcccacgaaagctgtggttgctgttatgactgaggtggctgctactgactaagggagggcacccggcctggagctgcggcatcagcaggtgacagagctggcaggaccctgggaggccttctggtctgtgcactgccctgtttcacagacagggacaccaaggcccagggaggggcaggggcatagcccagacgggagcccagaccagggctctgtccactggaccctttgcctctttgttactggttttgtttctggttagaaaaatgccacctacttgtcatggatgagccagaagatagtgaacggtccatgcctgtatcccagcactttgggaggccaagatgggtggattacttgaggtcaggagttcaagaccagcctggccaacatggtgaaaccccatttctactaaaaatacaaaaattggctgggcatggtggctcatgcctgtaatcccagcactttgggaggcctaggtgggcggatcacgaggtcaggagttcgagaccagccttgccaacatggtgaaaccccgtctctattaaaaatacaaaaattagccgggcatgatggtacacgcttgtaatcccaactacttaggaggctgaggcaggagaattgctcaaacccaggaggcggaggttgcagtgagctgagatcacaccactgcactccagcctgggtgacagaacaagactatgtctctggg

SEQ ID NO: 3751 - DNA, 6355 bp, Homo sapiens
ggctacttagagtcgtcggcgcggcggtgggaaagcagagccgagccgggactgtccagtgggagcaggcgccccggccagcgcagacctggaggcgcacgggcgccgcaccgcacgattcggctcggggtagagcggagccgcagccccacgcgcagcccaggacccactcgccaccgccgcttcctcagcacccatggggaccaggagactttaaaggagtttggggtttcgggagcagggaaatcacggatccccgctcctggccctcgcctcgccacctcattgatgggcaaccaactggaccgcatcacccacctcaactacagcgagttgcccacaggggacccgtcggggattgaaaaggacgaactgcgggtcggggttgcctacttcttctcggatgatgaggaagacctggacgaacgcgggcagcccgacaagtttggcgtgaaggcccccccgggttgcaccccctgcccggagagccccagccgccaccaccaccacctgctgcaccagctggtcctcaacgagactcagttttccgcctttcggggccaggaatgcatcttttccaaagtgagcggtggccctcagggcgccgacctaagcgtctacgcggtcaccgcgctgccagcgctctgcgaacccggcgacctgctggagctgctgtggctgcagcccgcgccggagccgcccgcgcccgccccgcactgggccgtctacgtgggcggcgggcagatcatccacctgcaccaaggcgagatccgccaggacagcctgtatgaggcgggcgcggccaacgtgggccgggtggtgaatagctggtaccgctaccgcccgctggtggccgagctggtggtgcagaacgcctgcggccacctgggcctcaagagcgaggagatctgctggacgaactcggagagcttcgccgcctggtgccgctttggcaagcgggagttcaaggcgggaggggaggtgccggcaggcacgcagcccccgcagcagcagtactatctcaaggtgcacctgggagagaacaaggtccacaccgccaggtttcacagcctggaagacctcatccgcgagaagcgccgtatcgacgccagcggccgcctgcgagtgctccaggagctcgccgacctcgtggacgacaaggagtagccgcctaggggctgccggcccctctgcctcccccgcacctcgctcccttcccttccccgcacccggacttcgcagtcagcggttctcaacctctgccccgccccgccacgcgcgtccgccgccggtggcccgggcccgggctgcacccccgcatccccaagccagcggcaggaagtctcaggaactgccccagggccgaaagggcgccgctgcgagcgcctggctgacagccacagcggtggtgacggtgctgggagaccccgcgtgcgctttccccttgagatgtaaaccgggaacggggaaggggctgaggggagaaaggacatggccttccccgcgagtccatggccagtgactgtggcccgactcgaaaacaaccctcttctcaaaagggaccatcaccgccccgagcgtgcgcacacagaccggtcggaggcgagaactggtctctacagggcacagttcagctcctctgtggatgcgtccccagatcgcaggatttccaagaaatcgagcctgtcccttgtgcacttgggaataattccccaagacagcacttcgggattccgggttatcctgaggctgcccgggacttttccagctctccagccccaggtctcctgacattgtgttccaggctgcgggctaagccagacagtgtttgcctccggttctttccaccgtgggaagcgaacgccacccccacccgcctttgcctgcgagtctccctcgctggcagaagggaagccggcccggtcccgggaggaagatggcgctgcgaattcggtgaggacagccggccccgcccccgacaaggagctcgctcgttcacctggtgtctgggaacttgaatgtgtgaagggcgcttattgttctgaacccttgattgctccctcctcgggctgcatttcaaaaatagtcatatttttaaaggagttggaggagagggagggggaggacatggcaccattccagaaaccagcattgttacaacaccatagccagtatatttagtttggcttttcctaacatagaaatcttcaaagctggggaagtggaaataaagttttaaaaatgagagagcagttttccaactatgtcaacaaagcctatcgtgttgatgtttttattgaccattttagcaacaggctaataaaatttcaaattgaaatttttattttcatggctttaatccatgatagtttaaatactgggggccattaagagtggatgtagctaagagcttagctaacattgccttttcactctatttttctcagatattgtaagcattctgtttttcaatattgtagttaattttttggctttcaacagcagccctagtaatggtggagttgttaattaatgtgtatattgtactgaatttctgtcagttaaggggttcactgctttggtggaaattggtggaaattgctagcaggttccacgatgtttatttttttctccatgttgtatatcattaccatttcacatacgcgtttctatttttcttcctctcctcctgatctccttaaaaatgaatctagagttggtggctttttccccctcctctttggccagttccacagttcagttcttcctgaaaacagggatgatgaacttgtaggatcaggacaaatgtgtgtttttcaaaaacttaaggctgggtgtgaaacaccttctgtggacaaggatttgtaaacttctctcctccctccagctgcggccccagcctaactgatagttacttgattcagtgtgctagacacttaaatagcatctatgtctctttcaagggaatttgtcaaataatgctgtttagctaattgttgcaagcaattgcatattaacagctgtgattttgttggacagcaagtattatggccaaagccagtttcttggcatttcaaaaataatgcaataaaaactagttgaggttagctgaggctggaaatgcctttttcatggtaaatgattcacttctatatttttctttctttttctttttttttctttggttttcatcctggattcatcccctgatcttaaatcaaaacgtcagatcaatgaactatgaactaaagtatttttcttaagcctattgagtgatttattttttaaaaaatgtttaaatgcatatgcttttctttcagcacaaacaacagcaaaaacttttgtaataactaacttacctttgcatgtatgaagaactgagtcatttatttccctaacttactcctctttcaagtaacaggtggcagatcataaaatgaattctttattgtatctacacactccacattctttactgtgtcctactactgtatcttggctccctgctgtattaaacaccatcttaagcacttgttcctgcaggactccttcttgacattttgtctcccccttcaaagtcactcaaagagtgggacttcatcaaaagaaatgaattagtctctatcacaccgaatactaagatttatttcctctgatggtacatagatttctctctcactaagagggtcactctcatagaggaatgtcttgtcagttttatacttgctgaggctagactgacaataaaaatgagctgggcagttaaattagcatttgttactatattggcctataaaggatcaggttgatgataatacctctaaaaatatgcaataataaaacaatagttatgaaagaaacttgaaaggtttgcaaggtttctcctatccctgttaaaattatcatttattatctctttgtcagtgttagtaaggtaacccatgacagaataatttgagtgatagttcatcatgcagaggatatgatcaagatattacctaatggttttatcctgaaaaaggtgtatacttttagggcactgttaacaatgcgagtgaaaccaagatggtgcaagttccctttgcagatggcgtgggcacacttgatttttattatgagtgaatgtaatctttctgtattttaccagagttacagcaattacctgaaaagtttcctaacattttaataatgttagggatttcgttttggttttagttgtcctcaagagacaacaggttcacagtaatttccatgatgttgggtgtggctaagctggggattggttctgttccccctgctcccgtgtagagaaaagctatatttatactgcattctttctcaactttcaggtaaaacaaactatgatttaaaaaaagaaaaaagaaaagacaggtacttttacttcaaagagtgctttgctacatttttatttaaaccaaaaatcaaataaaataaggaggggggctgggtatactttaaacaaaaccagtcctgaaatgctgttattctcaaagtacattccaaaaaaaaaaaaaaaaaaaaactatagaatttacgtatgttacatttttaagtatgagttaaattgatataaagtgttcctcaatatttaataatgtaagctgttgtcatgacagtattttttaaaaataataacgtatattatagttacgaaacacttgtgccagattagaacatcaagcacagaagcagctgtatgatttacctgtttttttgaaactttaatgtttaccttcccctatgtttaatttttctgtggtgaacacttttgttagaacatggcttttttatttttcttggaaaaatatgctattagtatttacaaaataattaattacctgaataagcagtatatactaaaagtcttcaaacattactttattgattacttatgttttgtggtgcgctttcaacatccctaagagttaaatgtcttagtcatctaatacatggaacagggtcaaacttcaatgaaattaatacttattgcacaatcataatatagcaacctaattttcttttatttataggcatatctttaaagctttcttctcttttttgaacaaatgaagagaatccagttagtttttgcctttcagaggtgatttgccacgtgcacaaagggtctgtaggtgaaaagacaggcttttgggtttcttgaaacatcaaaaactgaatttagagaatggttatctaacactcaagtcaatgttttttttgaaattactagctattggtataatatacatatatgtacatgtatacatatacatacacacatatgtacatttacacatatgtaagtatacactcatatacatatatacacatgtatatatacttgtgtacacatacatttttgcctatagctagcaattatttcattcagatacacacacacacacacacacacacaggctacttaaaatagagagtgacttgagatatacaaaaacaggaagaaaagccctggaggtcatatagctaatgtataactgcacagcaagcagctatgtctaaagctaacaataaaaagaaaatgtgggagttgtgcaattagttttattctcattttttggaagaatatgttcctggtttctctaactaaaaggaaaaaattcaaaggaaagttgtaaatattaggaagtaactgaaaaataagaagcaagataaagtggggaggctatgagatcatataatgagctaataaacttttcaacaggggacacctgttctcccttctaactgaagacactaaagagaagctaagatcctatctttcaatcatttagtaattcataaaatcccattatttcataactcaaagtttacctttgaggttgtatgtttacctcatttgaactcgaaatagaagaggtttaagtatttgaataagttgggaaaaaaaggaaaaatagtcttccctgcccttgtcactgatggtgacactacttgtaattactgtattttttggcagaacactcagatgaacagattcctatgctgtggacttttatcattctttttgatggctgatagtagaaagcacacagtaggtactccataaatgtaagactatggcagctgtctagtacaagtgcttctcactgattcttggttaccaggaaaaccagaaagcccgtcacttgccttgcctgcaaaggcgagcctaaagaaatttctctaaccaaaattggcaggttctttccaccacaaaaggctcttggaaatataacttatggggcttaaggctaatttgagttgaagggtatttgtaatatttgatttgcttttagcagagaaaacaataaaagaatccaggaaaagtagaaaa

SEQ ID NO: 3752 - DNA, 3765 bp, Homo sapiens
gtcggcgcggcggtgggaaagcagagccgagccgggactgtccagtgggagcaggcgccccggccagcgcagacctggaggcgcacgggcgccgcaccgcacgattcggctcggggtagagcggagccgcagccccacgcgcagcccaggacccactcgccaccgccgcttcctcagcacccatggggaccaggagactttaaaggagtttggggtttcgggagcagggaaatcacggcccacccctcggtccttcctgggtgtccgtctcccacactgccacagccagcactctcctccccaccgggaccccgcaagctctccagccagcctgggtgttttcttctgggagttggaccgagttcccggaaggggtcggaggctgtgtggtggcgtctgctctcgcctgacctgtggcggcttctccgcccctcgtacccctggggaggcacggaggactcggctggaaagggtgactccgatccccgctcctggccctcgcctcgccacctcattgatgggcaaccaactggaccgcatcacccacctcaactacagcgagttgcccacaggggacccgtcggggattgaaaaggacgaactgcgggtcggggttgcctacttcttctcggatgatgaggaagacctggacgaacgcgggcagcccgacaagtttggcgtgaaggcccccccgggttgcaccccctgcccggagagccccagccgccaccaccaccacctgctgcaccagctggtcctcaacgagactcagttttccgcctttcggggccaggaatgcatcttttccaaagtgagcggtggccctcagggcgccgacctaagcgtctacgcggtcaccgcgctgccagcgctctgcgaacccggcgacctgctggagctgctgtggctgcagcccgcgccggagccgcccgcgcccgccccgcactgggccgtctacgtgggcggcgggcagatcatccacctgcaccaaggcgagatccgccaggacagcctgtatgaggcgggcgcggccaacgtgggccgggtggtgaatagctggtaccgctaccgcccgctggtggccgagctggtggtgcagaacgcctgcggccacctgggcctcaagagcgaggagatctgctggacgaactcggagagcttcgccgcctggtgccgctttggcaagcgggagttcaaggcgggaggggaggtgccggcaggcacgcagcccccgcagcagcagtactatctcaaggtgcacctgggagagaacaaggtccacaccgccaggtttcacagcctggaagacctcatccgcgagaagcgccgtatcgacgccagcggccgcctgcgagtgctccaggagctcgccgacctcgtggacgacaaggagtagccgcctaggggctgccggcccctctgcctcccccgcacctcgctcccttcccttccccgcacccggacttcgcagtcagcggttctcaacctctgccccgccccgccacgcgcgtccgccgccggtggcccgggcccgggctgcacccccgcatccccaagccagcggcaggaagtctcaggaactgccccagggccgaaagggcgccgctgcgagcgcctggctgacagccacagcggtggtgacggtgctgggagaccccgcgtgcgctttccccttgagatgtaaaccgggaacggggaaggggctgaggggagaaaggacatggccttccccgcgagtccatggccagtgactgtggcccgactcgaaaacaaccctcttctcaaaagggaccatcaccgccccgagcgtgcgcacacagaccggtcggaggcgagaactggtctctacagggcacagttcagctcctctgtggatgcgtccccagatcgcaggatttccaagaaatcgagcctgtcccttgtgcacttgggaataattccccaagacagcacttcgggattccgggttatcctgaggctgcccgggacttttccagctctccagccccaggtctcctgacattgtgttccaggctgcgggctaagccagacagtgtttgcctccggttctttccaccgtgggaagcgaacgccacccccacccgcctttgcctgcgagtctccctcgctggcagaagggaagccggcccggtcccgggaggaagatggcgctgcgaattcggtgaggacagccggccccgcccccgacaaggagctcgctcgttcacctggtgtctgggaacttgaatgtgtgaagggcgcttattgttctgaacccttgattgctccctcctcgggctgcatttcaaaaatagtcatatttttaaaggagttggaggagagggagggggaggacatggcaccattccagaaaccagcattgttacaacaccatagccagtatatttagtttggcttttcctaacatagaaatcttcaaagctggggaagtggaaataaagttttaaaaatgagagagcagttttccaactatgtcaacaaagcctatcgtgttgatgtttttattgaccattttagcaacaggctaataaaatttcaaattgaaatttttattttcatggctttaatccatgatagtttaaatactgggggccattaagagtggatgtagctaagagcttagctaacattgccttttcactctatttttctcagatattgtaagcattctgtttttcaatattgtagttaattttttggctttcaacagcagccctagtaatggtggagttgttaattaatgtgtatattgtactgaatttctgtcagttaaggggttcactgctttggtggaaattggtggaaattgctagcaggttccacgatgtttatttttttctccatgttgtatatcattaccatttcacatacgcgtttctatttttcttcctctcctcctgatctccttaaaaatgaatctagagttggtggctttttccccctcctctttggccagttccacagttcagttcttcctgaaaacagggatgatgaacttgtaggatcaggacaaatgtgtgtttttcaaaaacttaaggctgggtgtgaaacaccttctgtggacaaggatttgtaaacttctctcctccctccagctgcggccccagcctaactgatagttacttgattcagtgtgctagacacttaaatagcatctatgtctctttcaagggaatttgtcaaataatgctgtttagctaattgttgcaagcaattgcatattaacagctgtgattttgttggacagcaagtattatggccaaagccagtttcttggcatttcaaaaataatgcaataaaaactagttgaggttagctgaggctggaaatgcctttttcatggtaaatgattcacttctatatttttctttctttttctttttttttctttggttttcatcctggattcatcccctgatcttaaatcaaaacgtcagatcaatgaactatgaactaaagtatttttcttaagcctattgagtgatttattttttaaaaaatgtttaaatgcatatgcttttctttcagcacaaacaacagcaaaaacttttgtaataactaacttacctttgcatgtatgaagaactgagtcatttatttccctaacttactcctctttcaagtaacaggtggcagatcataaaatgaattctttattgtatctacacactccacattctttactgtgtcctactactgtatcttggctccctgctgtattaaacaccatcttaagcacttgtt

SEQ ID NO: 3753 - DNA, 1068 bp, Homo sapiens
atgggcaaccaactggaccgcatcacccacctcaactacagcgagttgcccacaggggacccgtcggggattgaaaaggacgaactgcgggtcggggttgcctacttcttctcggatgatgaggaagacctggacgaacgcgggcagcccgacaagtttggcgtgaaggcccccccgggttgcaccccctgcccggagagccccagccgccaccaccaccacctgctgcaccagctggtcctcaacgagactcagttttccgcctttcggggccaggaatgcatcttttccaaagtgagcggtggccctcagggcgccgacctaagcgtctacgcggtcaccgcgctgccagcgctctgcgaacccggcgacctgctggagctgctgtggctgcagcccgcgccggagccgcccgcgcccgccccgcactggtgggcctcaagagcgaggagatctgctggacgaactcggagagcttcgccgcctggtgccgctttggcaagcgggagttcaaggcgggaggggaggtgccggcaggcacgcagcccccgcagcagcagtactatctcaaggtgcacctgggagagaacaaggtccacaccgccaggtttcacagcctggaagacctcatccgcgagaagcgccgtatcgacgccagcggccgcctgcgagtgctccaggagctcgccgacctcgtggacgacaaggagtagccgcctaggggctgccggcccctctgcctcccccgcacctcgctcccttcccttccccgcacccggacttcgcagtcagcggttctcaacctctgccccgccccgccacgcgcgtccgccgccggtggcccgggcccgggctgcacccccgcatccccaagccagcggcaggaagtctcaggaactgccccagggccgaaagggcgccgctgcgagcgcctggctgacagccacagcggtggtgacggtgctgggagaccccgcgtgcgctttccccttgagatgtaaaccgggaacggggaaggggctgaggggagaaaggacatggccttccccgcgagtccatggccagtga

SEQ ID NO: 3754 - DNA, 594 bp, Homo sapiens
atgcatcttttccaaagtgagcggtggccctcagggcgccgacctaagcgtctacgcggtcaccgcgctgccagcgctctgcgaacccggcgacctgctggagctgctgtggctgcagcccgcgccggagccgcccgcgcccgccccgcactgggccgtctacgtgggcggcgggcagatcatccacctgcaccaaggcgagatccgccaggacagcctgaggcgggcgcggccaacgtgggccgggtggtgaatagctggtaccgctaccgcccgctggtggccgagctggtggtgcagaacgcctgcggccacctgggcctcaagagcgaggagatctgctggacgaactcggagagcttcgccgcctggtgccgctttggcaagcgggagttcaaggcgggaggggaggtgccggcagcagcccccgcagcagcagtactatctcaaggtgcacctgggagagaacaaggtccacaccgctttcacagcctggaagacctcatccgcgagaagcgctatcgacgccagcggccgcctgcgagtgctccaggagctcgccgacctcgtggacgacaaggagtagccgcctag

SEQ ID NO: 3755 - DNA, 2390 bp, Homo sapiens
ccgccccctcttcagtccaggccgggcttccgcccggtctgccggcaacgctgcggccccgcccacgtcatggcgcccgaggagaacgcggggaccgaactcttgctgcagagtttcgagcgccgcttcctggcggcacgcacactgcgctccttcccctggcagagcttagaagcaaagttaagagactcatcagattctgagctgctgcgggatattttgcacaagactgtgaagcatcctgtgtgtgtgaagcacccgccgtccgtcaaatatgcccggtgctttctctcagaactcatcaaaaagcacgaggctgtccacacagagcctttggacgagctgtatgaagcgctggcggagaccctgatggccaaggagtccacccagggccaccggagctatttgctgccctcgggaggctcggtcacactctccgagagcacggccatcatctcctacggtaccacaggcctggtcacatgggacgccgccctctaccttgcagaatgggccatcgagaacccggcagtcttcactaacaggactgtcctagagcttggcagtggtgctggcctcacaggcctggccatctgcaagatgtgccgcccccgggcatacatcttcagcgactgtcacagccgggtccttgagcagctccgagggaatgtccttctcaatggcctctcattagaggcagacatcactgccaagttagacagccccagggtgacagtggcccagctggactgggacgtcgcgacggtccatcagctctctgccttccagccagatgttgtcattgcagcagatgtgctgtattgcccagaagccatcatgtcgctggtcggggtcctgcggaggctggctgcctgccgggagcaccagcgggctcctgaggtctacgtggcctttaccgtccgcaacccagagacgtgccagctgttcaccaccgagctaggccgggccgggatcagatgggaagtggaacctcgtcatgagcagaaactgtttccctacgaagagcacttggagatggcaatgctgaatctcaccctgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcagttcctcacaaagccaagcccactgcagctgccacatccctgggcttacggtgcagcaggtgcttttttcaagacaggaatcaaaatgttaggaacacggcagaaaggggacacctggagaccaaacgcaggatgaggagttctgcagaggtcacagggaagtcacagaacagtaatacgctagcaggggcatggggcgtgaagaacagaagaagagaggaagcgtttccaagcctccagagaagaaatcaaggccaaccaaagcttcccgggtcacagaaccaattcttttaccaggcagtaccactgctgtcatttcagcttctggccactgggaggtgctgctcgaaagggtttgccctgagactccaagaagaagctgcgggaaggacagcaggggtcctggggttttagcctctggcccaggagttatgtgtccataaccaaagggagcacagtctgcacccagctctcatcccatcggagctgctgcgactcccgcaggttcttccggaactggtttagcttgcccgcaggatcaggaaagtttgagaaaagcatctgcaaaaaaataaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcggcctctggccaacgcagtctcacccatctgtgggtaacaagggggtgtcggtgttctttgcagccttgctaaactgtctgaatcaaggatcacaaactacagcctgcaggccaaatccagcccacagcctgtgtttgtaaataaagttttattggaacaaa

SEQ ID NO: 3756 - DNA, 2268 bp, Homo sapiens
gccgggcttccgcccggtctgccggcaacgctgcggccccgcccacgtcatggcgcccgaggagaacgcggggaccgaactcttgctgcagagtttcgagcgccgcttcctggcggcacgcacactgcgctccttcccctggcagagcttagaagcaaagttaagagactcatcagattctgagctgctgcgggatattttgcacaagactgtgaagcatcctgtgtgtgtgaagcacccgccgtccgtcaaatatgcccggtgctttctctcagaactcatcaaaaagccctcgggaggctcggtcacactctccgagagcacggccatcatctcctacggtaccacaggcctggtcacatgggacgccgccctctaccttgcagaatgggccatcgagaacccggcagtcttcactaacaggactgtcctagagcttggcagtggtgctggcctcacaggcctggccatctgcaagatgtgccgcccccgggcatacatcttcagcgactgtcacagccgggtccttgagcagctccgagggaatgtccttctcaatggcctctcattagaggcagacatcactgccaagttagacagccccagggtgacagtggcccagctggactgggacgtcgcgacggtccatcagctctctgccttccagccagatgttgtcattgcagcagatgtgctgtattgcccagaagccatcatgtcgctggtcggggtcctgcggaggctggctgcctgccgggagcaccagcgggctcctgaggtctacgtggcctttaccgtccgcaacccagagacgtgccagctgttcaccaccgagctaggccgggccgggatcagatgggaagtggaacctcgtcatgagcagaaactgtttccctacgaagagcacttggagatggcaatgctgaatctcaccctgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcagttcctcacaaagccaagcccactgcagctgccacatccctgggcttacggtgcagcaggtgcttttttcaagacaggaatcaaaatgttaggaacacggcagaaaggggacacctggagaccaaacgcaggatgaggagttctgcagaggtcacagggaagtcacagaacagtaatacgctagcaggggcatggggcgtgaagaacagaagaagagaggaagcgtttccaagcctccagagaagaaatcaaggccaaccaaagcttcccgggtcacagaaccaattcttttaccaggcagtaccactgctgtcatttcagcttctggccactgggaggtgctgctcgaaagggtttgccctgagactccaagaagaagctgcgggaaggacagcaggggtcctggggttttagcctctggcccaggagttatgtgtccataaccaaagggagcacagtctgcacccagctctcatcccatcggagctgctgcgactcccgcaggttcttccggaactggtttagcttgcccgcaggatcaggaaagtttgagaaaagcatctgcaaaaaaataaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcggcctctggccaacgcagtctcacccatctgtgggtaacaagggggtgtcggtgttctttgcagccttgctaaactgtctgaatcaaggatcacaaactacagcctgcaggccaaatccagcccacagcctgtgtttgtaaataaagttttattggaacaaa

SEQ ID NO: 3757 - DNA, 1171 bp, Homo sapiens
ctcttcagtccaggcccggcttcctccaggtctcccggcaacggctgcggcctcgcccacgttatggcgcccgaggagaacgcggggaccgaactcttgctgcagggttttgagcgccgcttcctggcggtgcgcacactgcgctccttcccctggcagtcctcaggaggctcagtcacactctccaagagcacagccatcatctcccacggtaccacaggcctggtcacatgggatgccgccctctaccttgcagaatgggccatcgagaacccggcagccttcattaacagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctaggtgaacccccacgcccacccgggcctacatggtgcccgagctgtccctgcaggactccagtggaagtgaaagaactgggcgctggggaaaagctaggatgctccacactcccacactatgcggggaactcgggcagaggccggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaatcatcataaatcagacatgaaaattctagctccaaaaatagcattttctttctgcaaataaaaacgtgtgtatcaaggatgacgttcccccaacgtggacacactcggttcctcagaaagccaagcccgctgcagctgccacatccctggacacactcggttcctcacaaagccaagcccgctgcagctgccacatccctggacacactcggttcctcacaaagccaagcccgctgcagctgccacatccctggacacactcggttcctcac

SEQ ID NO: 3758 - DNA, 2169 bp, Homo sapiens
gcttcctccaggtctcccggcaacggctgcggcctcgcccacgttatggcgcccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagtcctcaggaggctcagtcacactctccaagagcacagccatcatctcccacggtaccacaggcctggtcacatgggatgccgccctctaccttgcagaatgggccatcgagaacccggcagccttcattaacagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctaggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaatcatcataaatcagacatgaaaattctagctccaaaaatagcattttctttctgcaaataaaaacgtgtgtatcaaggatgacgttcccccaacgtggacacactcggttcctcagaaagccaagcccgctgcagctgccacatccctggacacactcggttcctcacaaagccaagcccgctgcagctgccacatccctggacacactcggttcctcacaaagccaagcccgctgcagctgccacatccctggacacactcggttcctcacaaagccaagcccgctgcagctgccacatcccagggcttatggtgcagcaggcgcttttttcaagacaggaatgaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcatttcagagactccaaagaagaaatcagggccaaccacagcttcccgggtcattcaccaggtgacaccactgccgtcatttcagcttctggccactgggaggcgctgctcgaaaggctttgccctgagactccaagaagctgcgggaaggacagcaggggccctggggttttagcctctggcccaggagttatgtgtccataaccaaagggagcacagtctgcacccagctctcatcccatcagagctgctgagactcttgcaggttcttccagaactggcttagcttgcctgcaggatcagaaaagtttgagaaaagcatctgcaaaatgctaaagagcagagcttaactcattgcctgtccccaccccatcccaggtcaccacttggatgaccccaggtccccgacccaacaacaacccctcccaagtccctaactccctcacttggacttgagacccttcacaacccccctcacttggacttgagacccttcacaacccagcagcgctccacttccaacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggtgtgggtgttcttttcagccttgctaaactgtctgaatcaaggatcacaaactacagcctgcaggccaaatccagcccacagcctgtgtttgtaaataaagctttgttggaacaaagcc

SEQ ID NO: 3759 - DNA, 2537 bp, Homo sapiens
gcttcctccaggtctcccggcaacggctgcggcctcgcccacgttatggcgcccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagcacgaggctgtccacacggagcctttggacaaactgtacgaggtgctcacggagactctgatggccaaggagtccacccagggccaccggagctatttgctgtcctcaggaggctcagtcacactctccaagagcacagccatcatctcccacggtaccacaggcctggtcacatgggatgccgccctctaccttgcagaatgggccatcgagaacccggcagccttcattaacaggactgtcctagagcttggcagtggtgccggcctcacaggccttgccatctgcaagatgtgccgcccccgggcatacatcttcagcgaccctcacagccgggtcctcgagcagctccgagggaatgtccttctcaatggcctctcattagaggcagacatcactggcaacttagacagccccagggtgacagtggcccagctggactgggacgtagcaatggtccatcagctctctgccttccagccagatgttgtcattgcagcagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctaggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaatcatcataaatcagacatgaaaattctagctccaaaaatagcattttctttctgcaaataaaaacgtgtgtatcaaggatgacgttcccccaacgtggacacactcggttcctcagaaagccaagcccgctgcagctgccacatccctggacacactcggttcctcacaaagccaagcccgctgcagctgccacatccctggacacactcggttcctcacaaagccaagcccgctgcagctgccacatccctggacacactcggttcctcacaaagccaagcccgctgcagctgccacatcccagggcttatggtgcagcaggcgcttttttcaagacaggaatgaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcatttcagagactccaaagaagaaatcagggccaaccacagcttcccgggtcattcaccaggtgacaccactgccgtcatttcagcttctggccactgggaggcgctgctcgaaaggctttgccctgagactccaagaagctgcgggaaggacagcaggggccctggggttttagcctctggcccaggagttatgtgtccataaccaaagggagcacagtctgcacccagctctcatcccatcagagctgctgagactcttgcaggttcttccagaactggcttagcttgcctgcaggatcagaaaagtttgagaaaagcatctgcaaaatgctaaagagcagagcttaactcattgcctgtccccaccccatcccaggtcaccacttggatgaccccaggtccccgacccaacaacaacccctcccaagtccctaactccctcacttggacttgagacccttcacaacccccctcacttggacttgagacccttcacaacccagcagcgctccacttccaacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggtgtgggtgttcttttcagccttgctaaactgtctgaatcaaggatcacaaactacagcctgcaggccaaatccagcccacagcctgtgtttgtaaataaagctttgttggaacaaagcc

SEQ ID NO: 3760 - DNA, 2096 bp, Homo sapiens
gcccggcttcctccaggtctcccggcaacggctgcggcctcgcccacgttatggcgcccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagtcctcaggaggctcagtcacactctccaagagcacagccatcatctcccacggtaccacaggcctggtcacatgggatgccgccctctaccttgcagaatgggccatcgagaacccggcagccttcattaacaggactgtcctagagcttggcagtggtgccggcctcacaggccttgccatctgcaagatgtgccgcccccgggcatacatcttcagcgaccctcacagccgggtcctcgagcagctccgagggaatgtccttctcaatggcctctcattagaggcagacatcactggcaacttagacagccccagggtgacagtggcccagctggactgggacgtagcaatggtccatcagctctctgccttccagccagatgttgtcattgcagcagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctaggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaatcatcataaatcagacatgaaaattctagctccaaaaatagcattttctttctgcaaataaaaacgtgtgtatcaaggatgacgttcccccaacgtggacacactcggttcctcagaaagccaagcccgctgcagctgccacatccctggacacactcggttcctcacaaagccaagcccgctgcagctgccacatccctggacacactcggttcctcacaaagccaagcccgctgcagctgccacatccctggacacactcggttcctcacaaagccaagcccgctgcagctgccacatcccagggcttatggtgcagcaggcgcttttttcaagacaggaatgaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcatttcagagactccaaagaagaaatcagggccaaccacagcttcccgggtcattcaccaggtgacaccactgccgtcatttcagcttctggccactgggaggcgctgctcgaaaggctttgccctgagactccaagaagctgcgggaaggacagcaggggccctggggttttagcctctggcccaggagttatgtgtccataaccaaagggagcacagtctgcacccagctctcatcccatcagagctgctgagactcttgcaggttcttccagaactggcttagcttgcctgcaggatcagaaaagtttgagaaaagcatctgcaaaatgctaaagagcagagcttaactcattgcctgtccccaccccatcccaggtcaccacttggatgaccccaggtccccgacccaacaacaacccctcccaagtccctaactccctcacttggacttgagac

SEQ ID NO: 3761 - DNA, 808 bp, Homo sapiens
agtccaggcccggcttcctccaggtctcccggcaacggctgcggcctcgcccacgttatggcgcccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagtcctcaggaggctcagtcacactctccaagagcacagccatcatctcccacggtaccacaggcctggtcacatgggatgccgccctctaccttgcagaatgggccatcgagaacccggcagccttcattaacagacgtgctgtattgcccagaagccatcgtgtcgctggtcggggtcctgcagaggctggctgcctgccgggagcacaagcgggctcctgaggtctacgtggcctttaccgtccgcaacccagagacgtgccagctgttcaccaccgagctaggtgaacccccacgcccacccgggcctacatggtgcccgagctgtccctgcaggactccagtggaagtgaaagaactgggcgctggggaaaagctaggatgctccacactcccacactatgcggggaactcgggcagaggccggtgagcagggtgggctcggggcgtggggggcttgaggcaggaggaggacacctcagcacagggagggagggtctgagcccagcag

SEQ ID NO: 3762 - DNA, 1268 bp, Homo sapiens
atggcgcccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagcacgaggctgtccacacggagcctttggacaaactgtacgaggtgctcgcggagactctgatggccaaggagtccacccagggccaccggagctatttgctgtcctcaggaggctcagtcacactctccaagagcacagccatcatctcccacggtaccacaggcctggtcacatgggatgccgccctctaccttgcagaatgggccatcgagaacccggcagccttcattaacaggactgtcctagagcttggcagtggtgccggcctcacaggccttgccatctgcaagatgtgccgcccccgggcatacatcttcagcgaccctcacagccggatcctcgagcagctccgagggaatgtccttctcaatggcctctcattagaggcagacatcactggcaacttagacagccccagggtgacagtggcccagctggactgggacgtagcaatggtccatcagctctctgccttccagccagatgttgtcattgcagcagacgtgctgtattgcccagaagccatcgtgtcgctggtcggggtcctgcagaggctggctgcctgccgggagcacaagcgggctcctgaggtctacgtggcctttaccgtccgcaacccagagacatgccagctgttcaccaccgagctaggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaatcatcataaatcagacatgaaaattctagctccaaaaatagcattttctttctgcaaataaa

SEQ ID NO: 3763 - DNA, 900 bp, Homo sapiens
atggcgcccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagtcctcaggaggctcagtcacactctccaagagcacagccatcatctcccacggtaccacaggcctggtcacatgggatgccgccctctaccttgcagaatgggccatcgagaacccggcagccttcattaacagacgtgctgtattgcccagaagccatcgtgtcgctggtcggggtcctgcagaggctggctgcctgccgggagcacaagcgggctcctgaggtctacgtggcctttaccgtccgcaacccagagacatgccagctgttcaccaccgagctaggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaatcatcataaatcagacatgaaaattctagctccaaaaatagcattttctttctgcaaataaa

SEQ ID NO: 3764 - DNA, 1166 bp, Homo sapiens
atggcgcccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagtcctcaggaggctcagtcacactctccaagagcacagccatcatctcccacggtaccacaggcctggtcacatgggatgccgccctctaccttgcagaatgggccatcgagaacccggcagccttcattaacaggactgtcctagagcttggcagtggtgccggcctcacaggccttgccatctgcaagatgtgccgcccccgggcatacatcttcagcgaccctcacagccggatcctcgagcagctccgagggaatgtccttctcaatggcctctcattagaggcagacatcactggcaacttagacagccccagggtgacagtggcccagctggactgggacgtagcaatggtccatcagctctctgccttccagccagatgttgtcattgcagcagacgtgctgtattgcccagaagccatcgtgtcgctggtcggggtcctgcagaggctggctgcctgccgggagcacaagcgggctcctgaggtctacgtggcctttaccgtccgcaacccagagacatgccagctgttcaccaccgagctaggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaatcatcataaatcagacatgaaaattctagctccaaaaatagcattttctttctgcaaataaa

SEQ ID NO: 3765 - DNA, 1171 bp, Homo sapiens
ctcttcagtccaggcccggcttcctccaggtctcccggcaacggctgcggcctcgcccacgttatggcgcccgaggagaacgcggggaccgaactcttgctgcagggttttgagcgccgcttcctggcggtgcgcacactgcgctccttcccctggcagtcctcaggaggctcagtcacactctccaagagcacagccatcatctcccacggtaccacaggcctggtcacatgggatgccgccctctaccttgcagaatgggccatcgagaacccggcagccttcattaacagacgtgctgtattgcccagaagccatcgtgtcgctggtcggggtcctgcagaggctggctgcctgccgggagcacaagcgggctcctgaggtctacgtggcctttaccgtccgcaacccagagacatgccagctgttcaccaccgagctaggtgaacccccacgcccacccgggcctacatggtgcccgagctgtccctgcaggactccagtggaagtgaaagaactgggcgctggggaaaagctaggatgctccacactcccacactatgcggggaactcgggcagaggccggccgggatgggatcagatgggaagcggaagctcatcatgaccagaaactgtttccctatggagagcacttggagatggcaatgctgaacctcacactgtaggactcacacatgactccaaagggattgtgagaatcaagtcactctcgtgggaagaatttttatatgggaaagtggataaaactttcattggactggaatgtttggagattattaaactccaaatcaggaatcaaaactgccctctaataagacattagctgtctaggcgtgtgggtgccccctttctgccagcagttctggttctcaagaaaatcatcataaatcagacatgaaaattctagctccaaaaatagcattttctttctgcaaataaaaacgtgtgtatcaaggatgacgttcccccaacgtggacacactcagttcctcagaaagccaagcccgctgcagctgccacatccctggacacactcggttcctcacaaagccaagcccgctgcagctgccacatccctggacacactcggttcctcacaaagccaagcccgctgcagctgccacatccctggacacactcggttcctcac

SEQ ID NO: 3766 - DNA, 885 bp, Homo sapiens
atggcgcccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagtcctcaggaggctcagtcacactctccaagagcacagccatcatctcccacggtaccacaggcctggtcacatgggatgccgccctctaccttgcagaatgggccatcgagaacccggcagccttcattaacaggactgtcctagagcttggcagtggtgccggcctcacaggccttgccatctgcaagatgtgccgcccccgggcatacatcttcagcgaccctcacagccggatcctcgagcagctccgagggaatgtccttctcaatggcctctcattagaggcagacatcactggcaacttagacagccccagggtgacagtggcccagctggactgggacgtagcaatggtccatcagctctctgccttccagccagatgttgtcattgcagcagacgtgctgtattgcccagaagccatcgtgtcgctggtcggggtcctgcagaggctggctgcctgccgggagcacaagcgggctcctgaggtctacgtggcctttaccgtccgcaacccagagacatgccagctgttcaccaccgagctaggccgggatgggatcagatgggaagcggaagctcatcatgaccagaaactgtttccctatggagagcacttggagatggcaatgctgaacctcaca

SEQ ID NO: 3767 - DNA, 447 bp, Homo sapiens
atggcgcccgaggagaacgcggggaccgaactcttgctgcagggttttgagcgccgcttcctggcggtgcgcacactgcgctccttcccctggcagagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagtcctcaggaggctcagtcacactctccaagagcacagccatcatctcccacggtaccacaggcctggtcacatgggatgccgccctctaccttgcagaatgggccatcgagaacccggcagccttcattaacagacgtgctgtattgcccagaagccatcgtgtcgctggtcggggtcctgcagaggctggctgcctgccgggagca

SEQ ID NO: 3768 - DNA, 2010 bp, Homo sapiens
cggcaaggctgaggccccgcccccgtcatggcgcccgaggagaacgcggggagcgaactcttgctgcagagtttcaagcgccgcttcctggcagcgcgcgccctgcgctccttccgctggcagagcttagaagcaaagttaagagactcatcagattctgagctgctgcgggatattttgcagaagacgtgctgtattgcccagaagccatcgtgtcgctggtcggggtcctgcggaggctggctgcctgccgggagcaccagcgggctcctcaattctacatggcccttaccgtctgcaacccagagatgtgccagctgttcaccaccgagctatgctggactgggatcagatgggaagcggaagctcatcatgaccagaaactgtttccctacagagagcacttggagatggcaaagctgaacctcacactgtaggactcacacatgactccaacgggattgtgagaattaagtcactctcgtgggaagaatttttatatgggaaagcggataaaactttcattggactggaatgtttggagaatgttaaattccaaatcaggaaccacaaactgcgctctaataagacatcggctatctaagcatgtgggttccccctttctgccagcagttctggttcttaagaaaatcaccataaatcagacatgaaaattctggctccaaaaatagcattttcattgtgcaaataaaaacgtgtgtatcaagtatgacattcccccaacgtggacacacttggttcctcacaaagccaagcccgctgcagctgccacatccctggacacactcgtttcctcacaaagccaagcccgctgcagctgccacatccctggacacactcggttcctcacaaagccaagcccgctgcagctgccacatccctggacacactcgtttcctcacaaagccaagcccgctgcagctgccacatccctggacacactcgtttcctcacaaagccaagcccgctgcagctgccacatccctggacacactcggttcctcaaaaagccaagccggctgcagctgccacatccctgggtttatgatgcagcaggtgcttttttcaagacaggaatcaaagtgttaggaacatggcagaaaggtgacacctggagaccaaatgcagggtaaggagtactgcagaggtcacagggaagtcacagaacagtaatacgctagcaggggcatggggcgtgaagaacagaagacaggaagcgtttcagagactccaaagaagaaatcagggccaaccacagcttcccgagtcattcaccaggtggcaccactgccttcatttcagcttccggccactgggaggcgctgctcgaaagggtttgccctgagacaccaagaagaagctgcgggaaggacagcaggggccctggggttttagcctctggcccaggagttatgtgtccataaccaaagggagcacagtctgcacccagctctcatcccatcagagctgctgcgactcccgcaggttcttccagaactggtttagcttgcctgcaggatcaggaaagtttgagaaaagcatctgcaaaatactaaagagcagagcttacttcattgcctgtccccaccccatcccaggtcaccacctggctgaacccaggtccccgacccaacaacaacccctcccaagtccctaactccctcacttggacttgagacccttcacaacccagcagcgctccgcctccaacttgacatcatgctttctggaaacttccccgtgtgtcccactttcccacacttggtgcgctggagcaccttccggcctctacatgctgtacgttcccctgtgagcaccctcctctcagcctctggccaacacagtcccacccatctgtgggtaacaagggggtgtgggtgttcttttcagccttgctaaactgtctgaatcaaggatcacaaactacagcctgcaggccaaatccagcccacagcctgtgtttgtaaataaagctttattggaacaaag

SEQ ID NO: 3769 - DNA, 2110 bp, Homo sapiens
aaggctgaggccccgcccccgtcatggcgcccgaggagaacgcggggagcgaactcttgctgcagagtttcaagcgccgcttcctggcagcgcgcgccctgcgctccttccgctggcagagcttagaagcaaagttaagagactcatcagattctgagctgctgcgggatattttgcagaagcacgaggctgtccacacagagcctttggatgagctgtacgaggtgctggtggagaccctgatggccaaggagtccacccagggccaccggagctatttgctgacgtgctgtattgcccagaagccatcgtgtcgctggtcggggtcctgcggaggctggctgcctgccgggagcaccagcgggctcctcaattctacatggcccttaccgtctgcaacccagagatgtgccagctgttcaccaccgagctatgctggactgggatcagatgggaagcggaagctcatcatgaccagaaactgtttccctacagagagcacttggagatggcaaagctgaacctcacactgtaggactcacacatgactccaacgggattgtgagaattaagtcactctcgtgggaagaatttttatatgggaaagcggataaaactttcattggactggaatgtttggagaatgttaaattccaaatcaggaaccacaaactgcgctctaataagacatcggctatctaagcatgtgggttccccctttctgccagcagttctggttcttaagaaaatcaccataaatcagacatgaaaattctggctccaaaaatagcattttcattgtgcaaataaaaacgtgtgtatcaagtatgacattcccccaacgtggacacacttggttcctcacaaagccaagcccgctgcagctgccacatccctggacacactcgtttcctcacaaagccaagcccgctgcagctgccacatccctggacacactcggttcctcacaaagccaagcccgctgcagctgccacatccctggacacactcgtttcctcacaaagccaagcccgctgcagctgccacatccctggacacactcgtttcctcacaaagccaagcccgctgcagctgccacatccctggacacactcggttcctcaaaaagccaagccggctgcagctgccacatccctgggtttatgatgcagcaggtgcttttttcaagacaggaatcaaagtgttaggaacatggcagaaaggtgacacctggagaccaaatgcagggtaaggagtactgcagaggtcacagggaagtcacagaacagtaatacgctagcaggggcatggggcgtgaagaacagaagacaggaagcgtttcagagactccaaagaagaaatcagggccaaccacagcttcccgagtcattcaccaggtggcaccactgccttcatttcagcttccggccactgggaggcgctgctcgaaagggtttgccctgagacaccaagaagaagctgcgggaaggacagcaggggccctggggttttagcctctggcccaggagttatgtgtccataaccaaagggagcacagtctgcacccagctctcatcccatcagagctgctgcgactcccgcaggttcttccagaactggtttagcttgcctgcaggatcaggaaagtttgagaaaagcatctgcaaaatactaaagagcagagcttacttcattgcctgtccccaccccatcccaggtcaccacctggctgaacccaggtccccgacccaacaacaacccctcccaagtccctaactccctcacttggacttgagacccttcacaacccagcagcgctccgcctccaacttgacatcatgctttctggaaacttccccgtgtgtcccactttcccacacttggtgcgctggagcaccttccggcctctacatgctgtacgttcccctgtgagcaccctcctctcagcctctggccaacacagtcccacccatctgtgggtaacaagggggtgtgggtgttcttttcagccttgctaaactgtctgaatcaaggatcacaaactacagcctgcaggccaaatccagcccacagcctgtgtttgtaaataaagctttattggaacaaagcc

SEQ ID NO: 3770 - DNA, 952 bp, Homo sapiens
ctgaggccccgcccccgtcatggcgcccgaggagaacgcggggagcgaactcttgctgcagagtttcaagcgccgcttcctggcagcgcgcgccctgcgctccttccgctggcagagcttagaagcaaagttaagagactcatcagattctgagctgctgcgggatattttgcagaagactgtgaagcatcctgtgtgtgtgaagcacccgccgtcagtcaagtatgcccggtgctttctctcagaactcatcaaaaagacgtgctgtattgcccagaagccatcgtgtcgctggtcggggtcctgcggaggctggctgcctgccgggagcaccagcgggctcctcaattctacatggcccttaccgtctgcaacccagagatgtgccagctgttcaccaccgagctatgctggactgggatcagatgggaagcggaagctcatcatgaccagaaactgtttccctacagagagcacttggagatggcaaagctgaacctcacactgtaggactcacacatgactccaacgggattgtgagaattaagtcactctcgtgggaagaatttttatatgggaaagcggataaaactttcattggactggaatgtttggagaatgttaaattccaaatcaggaaccacaaactgcgctctaataagacatcggctatctaagcatgtgggttccccctttctgccagcagttctggttcttaagaaaatcaccataaatcagacatgaaaattctggctccaaaaatagcattttcattgtgcaaataaaaacgtgtgtatcaagtatgacattcccccaacgtggacacacttggttcctcacaaagccaagcccgctgcagctgccacatccctggacacactcgtttcctcacaaagccaagcccgctgcagctgccacatccctggacacactcggttcctcacaaagccaa

SEQ ID NO: 3771 - DNA, 1495 bp, Homo sapiens
gcagcggggcaggcgcgtggccgggccgcggcgcgatgagtggggcccgggcggcgcccggggccgcgggcaacggcgcggtccgggggctgcgggtggacgggctgcccccgctgccaaagagcttgagcgggctgctgcactcggcgtcgggcggcggcgcgtctgggggctggcggcacctggagcggctgtacgcgcagaagtcgcgcatccaggacgagctgagccgcgggggcccgggcggcggcggggcccgggcggcagcgctgcccgccaagcctcccaacctggacgccgctctggcgctgctccgcaaagagatggttggtctccgccagctggacatgtccttgctctgccaactgtacagcctctacgagtcgattcaggagtacaagggggcatgccaggcagcctccagcccagactgcacttacgctctggagaacggcttcttcgatgaagaggaggaatatttccaggagcagaactccctgcacgacaggagggaccgaggccctcctcgggacttgtcactgcctgtctcctccctctccagcagcgactggattctggagtccatctagagggtcttgggagggatgtgactgttgggaagcccttcctactggacacgctgtcatcatttgctgcttctcttgcaagaaagcacctccgttgtggacggtcctcgggcacaggggatgagcgctaccagtttcatttgtaggcagggagttctccgcggatgcatggtggcagtctgctttgatggcagcagtttctgcttaggtgacctagaggtcctcagcagtatcctccacacctatttattgaggtgcacctgctggggattcataatgagaatataacaagaggatctcggtgaaaggccttagtgggtgttttgtgtgaggtggcttgtagctagctacttccttacagatggtagagtattccaatcctctttgtgttagggttcttgcttccagtttgggatgtattaaaaccaccatttcactgcttcccttcctcaatatgctctgcagcttttcttgctgtttaaacctctcgcctcagctttatttatttgtaagctgcattactaactgcccagtgattcggtgaaagctttttactgaaaaagttaacatttctagtcatcccaatcaactggcttttttcaaccaaaattttatatcattctttgtctatcagatacgagaggaaggaagataatacgaagacatgttgaatagtgaaaaaaaaaaaaagaacacaaaaactggggcaagccaatgtgatgtatcactcactgtaagatggcaaatgttttcatttttaagattccgaatgtaaactagtgtgctagaaagcaaaccacccgccactcaaaccagtaattaccttaagccttaatatatttattaaaatactttatgagaacattacactttgtaggttaaaaatgaggataaaatgctaaactatc

SEQ ID NO: 3772 - DNA, 1409 bp, Homo sapiens
agaaaccacgcctgcccccttcagccttttcccccctccgccgcatttttccatctccccttgagtgagtggatgtcccgttgccttttctcagctttgcgcgacgtggtcccacaaccgttgcctttttaagagaggcccggcccatccagagggggtggggcagaggcggagtctgaggagctggggaaggaacaaagcgaggcctgcgggcggcggctgggctccggcggggccgcggggtgcggggcctgcgggcggcggcccgggcggagcgttggagggaaggaggtggcatcgccgtccgcgccggccccggccatgaacgggctgccctcggcagaggcgccgggcggggcgggctgcgctttggccgggctcccaccgctgccgcgcggcctcagcggcctccttaatgcgagcgggggctcgtggcgggagctggagcgcgtctacagccagcgcagccgcatccacgacgagctgagccgcgccgcccgcgccccggacgggccccgccacgccgccggcgccgccaacgcgggacccgcagccggcccgcgtcgtcctgtcaacctcgactcagcgctggccgcgctgcgcaaggagatgctgtggggcctgtacgagtcaatccaggactacaaacacctgtgccaagacctgagcttctgccaggacctgtcatcctccctccattcggacagctcctacccaccggatgcgggcctgtctgacgacgaggagcctcccgatgccagcctgcctcctgacccgccaccccttactgtgccccagacgcacaatgcccgtgaccagtggctgcaggatgccttccacatcagcctctgaagggctggggggcagggggcatgcacccatgcaaaaggctcagaaactccccctccggcaagccctcagacttcggagcctgcgccttcccccctaccgcctcacctcacaggagggccaggcatgtattcctcagaggcgaaactgccaaactctttctcctgtcttgggttggctggcactggggcgggcatctagggtacagcctctgctcatggcactgggcctccagttcttccacatgtgtgcacccccagcttggccaaccctcagccttgcggtggggcccgaagcatcttcccttccgcttggcgtctctgggattgggatgagtgcctggctcccatctcctcctcaccttttgttgctatcggcagctgctggctcaggggcatcccacctccgggctctgggttcctctgccctggaagggctccaggacccgtcccaataaccacccacggccaggagggccaaggccccgtgctggatatttaaatttaggggccggtctccagggcgcgtagataaataaatacactcagcgtcgttgtgct

SEQ ID NO: 3773 - DNA, 1010 bp, Homo sapiens
atgaacgggctgccctcggcagaggcgccgggcggggcgggctgcgctttggccgggctcccaccgctgccgcgcggcctcagcggcctccttaatgcgagcgggggctcgtggcgggagctggagcgcgtctacagccagcgcagccgcgtcgtcctgtcaacctcgactcagcgctggccgcgctgcgcaaggagatgttgtctgcaggtggggctgcggcagttggacatgtccttgttgtgccagctgtggggcctgtacgagtcaatccaggactacaaacacctgtgccaagacctgagcttctgccaggacctgtcatcctccctccattcggacagctcctacccaccggatgcgggcctgtctgacgacgaggagcctcccgatgccagcctgcctcctgacccgccaccccttactgtgccccagacgcacaatgcccgtgaccagtggctgcaggatgccttccacatcagcctctgaagggctggggggcagggggcatgcacccatgcaaaaggctcagaaactccccctccggcaagccctcagacttcggagcctgcgccttcccccctaccgcctcacctcacaggagggccaggcatgtattcctcagaggcgaaactgccaaactctttctcctgtcttgggttggctggcactggggcgggcatctagggtacagcctctgctcatggcactgggcctccagttcttccacatgtgtgcacccccagcttggccaaccctcagccttgcggtggggcccgaagcatcttcccttccgcttggcgtctctgggattgggatgagtgcctggctcccatctcctcctcaccttttgttgctatcggcagctgctggctcaggggcatcccacctccgggctctgggttcctctgccctggaagggctccaggacccgtcccaataaccacccacggccaggagggccaaggccccgtgctggatatttaaatttaggggccggtctccagggc

SEQ ID NO: 3774 - DNA, 1337 bp, Homo sapiens
acaaccgttgcctttttaagagaggcccggcccatccagagggggtggggcagaggcggagtctgaggagctggggaaggaacaaagcgaggcctgcgggcggcggctgggctccggcggggccgcggggtgcggggcctgcgggcggcggcccgggcggagcgttggagggaaggaggtggcatcgccgtccgcgccggccccggccatgaacgggctgccctcggcagaggcgccgggcggggcgggctgcgctttggccgggctcccaccgctgccgcgcggcctcagcggcctccttaatgcgagcgggggctcgtggcgggagctggagcgcgtctacagccagcgcagccgcatccacgacgagctgagccgcgccgcccgcgccccggacgggccccgccacgccgccggcgccgccaacgcgggacccgcagccggcccgcgtcgtcctgtcaacctcgactcagcgctggccgcgctgcgcaaggagatgttgtctgcaggtggggctgcggcagttggacatgtccttgttgtgccagctgtggggcctgtacgagtcaatccaggactacaaacacctgtgccaagacctgagcttctgccaggacctgtcatcctccctccattcggacagctcctacccaccggatgcgggcctgtctgacgacgaggagcctcccgatgccagcctgcctcctgacccgccaccccttactgtgccccagacgcacaatgcccgtgaccagtggctgcaggatgccttccacatcagcctctgaagggctggggggcagggggcatgcacccatgcaaaaggctcagaaactccccctccggcaagccctcagacttcggagcctgcgccttcccccctaccgcctcacctcacaggagggccaggcatgtattcctcagaggcgaaactgccaaactctttctcctgtcttgggttggctggcactggggcgggcatctagggtacagcctctgctcatggcactgggcctccagttcttccacatgtgtgcacccccagcttggccaaccctcagccttgcggtggggcccgaagcatcttcccttccgcttggcgtctctgggattgggatgagtgcctggctcccatctcctcctcaccttttgttgctatcggcagctgctggctcaggggcatcccacctccgggctctgggttcctctgccctggaagggctccaggacccgtcccaataaccacccacggccaggagggccaaggccccgtgctggatatttaaatttaggggccggtctccagggcgcgtagataaataaatacactcagcgtc

SEQ ID NO: 3775 - DNA, 1263 bp, Homo sapiens
ggagctggggaaggaacaaagcgaggcctgcgggcggcggctgggctccggcggggccgcggggtgcggggcctgcgggcggcggcccgggcggagcgttggagggaaggaggtggcatcgccgtccgcgccggccccggccatgaacgggctgccctcggcagaggcgccgggcggggcgggctgcgctttggccgggctcccaccgctgccgcgcggcctcagcggcctccttaatgcgagcgggggctcgtggcgggagctggagcgcgtctacagccagcgcagccgcatccacgacgagctgagccgcgccgcccgcgccccggacgggccccgccacgccgccggcgccgccaacgcgggacccgcagccggcccgcgtcgtcctgtcaacctcgactcagcgctggccgcgctgcgcaaggagatggtggggctgcggcagttggacatgtccttgttgtgccagctgtggggcctgtacgagtcaatccaggactacaaacacctgtgccaagacctgagcttctgccaggacctgtcatcctccctccattcggacagctcctacccaccggatgcgggcctgtctgacgacgaggagcctcccgatgccagcctgcctcctgacccgccaccccttactgtgccccagacgcacaatgcccgtgaccagtggctgcaggatgccttccacatcagcctctgaagggctggggggcagggggcatgcacccatgcaaaaggctcagaaactccccctccggcaagccctcagacttcggagcctgcgccttcccccctaccgcctcacctcacaggagggccaggcatgtattcctcagaggcgaaactgccaaactctttctcctgtcttgggttggctggcactggggcgggcatctagggtacagcctctgctcatggcactgggcctccagttcttccacatgtgtgcacccccagcttggccaaccctcagccttgcggtggggcccgaagcatcttcccttccgcttggcgtctctgggattgggatgagtgcctggctcccatctcctcctcaccttttgttgctatcggcagctgctggctcaggggcatcccacctccgggctctgggttcctctgccctggaagggctccaggacccgtcccaataaccacccacggccaggagggccaaggccccgtgctggatatttaaatttaggggccggtctccagggcgcgtagataaataaatacactcagcgtcgt

SEQ ID NO: 3776 - DNA, 5511 bp, Homo sapiens
ccgaaactaggaagaaacttggagctgttcaggcgatccagcctccaatcgctgctgctcttgtactcggttggcccgggcggcgctgaactgtcgggagcctaggccatggggcagcctgggccttctgcagtgtgaggcgcggggcctcccgcgtcgctccgctgacaggctgcgggcgggcaggcgggaggcgtagtgtgggtcgcggtggcggccccggccgccggccctggccgcggcatcatgaacatagacgtggagttccacatccggcacaactacccctggaacaagttgccggccaacgtgagacagagtcttggaaattcacagagagaatatgaaaagcaggttgtcctgtacagtatccgcaatcagttacgatatagaaataacttagttaaacatgtcaagaaagatgaacgcagatactatgaggaactgctaaagtacagccgagatcatctcatgctgtacccttaccatctatcggatattatggtgaaaggcttgaggataacaccattttcatattatactgggattatggaggatattatgaacagtgagaaaagttatgattcattgcccaattttactgctgctgactgtctaaggcttcttggcataggaagaaaccagtatattgatcttatgaatcagtgtagatcatcaaaaaaattcttcagaaggaaaacagcccgtgatcttctaccaataaagccagtggaaattgccatagaggcgtggtgggtggtgcaggctggctatatcacagaagatgacatcaagatatgcactttgcctgagaaatgcgctgttgataagatcatcgattcaggccctcaactctctggatcactagattacaatgtagtacatagtttgtataacaaaggatttatttatctggatgtaccaatatctgatgacagttgtatagcagttccacctcttgaaggttttgtaatgaatcgagtgcaaggtgattattttgaaactctactctataagatatttgtttcaatagatgagcacacaaatgttgcagagcttgcaaatgtccttgagattgacttatccctggttaagaatgctgtttcaatgtattgccgattgggctttgcccataagaagggacaagtaattaatttggatcaacttcattcatcatggaagaatgttccatccgtaaacagattaaagagtaccttagatccacagaagatgctcttgtcatgggatggaggggaaagtaggagtcctgtacaagaagcttcatcggcaactgacactgatacaaatagtcaagaagatccagctgacacagccagtgtaagcagcctgagtctgtctacaggacacacgaagcgcatcgcattcctgtttgactccactcttactgccttcttaatgatgggaaatctttcaccaaacttgaaaagtcatgcagtcacaatgtttgaagtaggcaaactctcagatgagtctctggacagctttcttatagaactagaaaaggttcagagcactggtgaaggagaagcacagagatattttgatcatgcacttactctgagaaacacaatactgtttctgcgtcataacaaagatctagttgcgcaaactgcacagccagaccaacccaattatggttttcctctggatctcttacgctgtgaaagccttcttggtttggaccctgcaacttgcagcagagttctaaacaaaaattacacgctgcttgtttccatggctcccctcaccaatgaaatccggcctgtcagcagctgcacccctcagcatattggaccagctatcccagaagtcagctctgtctggtttaaactgtacatttatcatgtcactggacaaggaccaccatcccttttattgtccaaaggtacaagacttcgaaaactgccagatatatttcagagttatgatcgattgctaataacatcttggggtcatgatcctggagtagttcctacctcaaatgtgctcacgatgttgaatgatgctttaacacattctgcagttttaattcaggggcatggtctgcatgggataggagaaactgtccatgtcccatttccatttgatgaaacagaactacaaggagagttcactcgtgtcaatatgggtgttcataaagcattgcagatactaaggaacagagtggacttacagcatctctgtggatatgtcaccatgttgaatgcttccagccaacttgcagatagaaaactcagtgatgcttctgatgagagaggagaacctgatttggcttctggctcagatgtaaatgggagtacagagtcatttgaaatggtcattgaggaagcaactatagattcagcaacaaagcaaacctctggtgccacaacagaagcagattgggttcctctcgagctgtgctttggaattccactgttcagttccgaattaaaccggaaagtttgtaggaaaattgctgcacatggcctttgcagaaaagagagccttcaaaacctcttacattccagtagaaaactctctctgcaagtccttaactttgttcactcattccaggaaggtgcttcaatattggatattcacacagagcccagtttttcaagtttgctttcacagtcatcgtgtgctgacatgggtgttccacttcctgcaaaaaacttaatatttaaagatggtgtcttatcagaatggagtggacggtcaccttcctcacttcttattgctaatctccatttgcaataatttggttacaccatttgttgctcacactttctgccttttttctttcttaacgttagctttatagtgtcagccactaaaaagcatcctgctgctgcagtgcaattcttgcttaactaatattaaaagttggggaacatattcatgttttctgaagttttgctcattattgcacatcttattgcgacaaagtgctttttagcagccagcactgtattttttaccttgagacaatctgcatttcttttataaaactaagtatatactttataggctttatgatgactgttatgtttataagcagtcactatgaaaattgcaatggtaattttatatgttagtttatcaaacataaatcttgtttaattttatattttgttacctatactttgggggatcaagggaagagatggaactcttcctctgaaaaggcttcttggtacttaaagtagtaaaactataaaacaataaacatccagtattgagagatgatatgatagggcattatgaattcctatgggtgtctgtaaattatgtatgtcagttggacattgtagaaggtatgtaaatcagcatagttgtgtataacttaaccttgatttataaggtcttaagattatgactattcattgacatctcatgagaagctttagaagactttctatttttaaacaccatttatatgtggacttctgttgtcactgactttgggctttatattttcatagagtctttatggaaaaaatagaatttattttccactcttgtagctatagctgctgcacactttcaccctgatttatttttttgtttcttagctttgatgttttcaaaccaaggattgtgattttaggttagaattacatattagaagcattaagactatgtctttggatcagaatgctttagtgataaacctactttgaagacatactcttaagcaatctggatcttaaatttatgtgaatacttttttagaaaatgataaagaaaaatggaattacttcaaagtgtttcttgagtcattgattcttttagcatctcaaatgttaattagaataattggaatcactttttagacttttcaagttaccttccttgggaagtttgtgcagtgttatagtttagtttagctcctcttacagggtaatggtttgctagtttaaaactgtaaccaaacgaactggtcagacaacatatatctaaaacacttaaaatgttaggaagtttgggaatgttataacctaaacgtttttgctggtaactttttgttatttatagatatttgtgtatttaacatacatacttcaggaaatatatgcctttcctaaaacttaaccatgcattcaataccatggcctatctatagaattgaatattttggaccatgttatctgtggcacagtcagtgctgtgtttgaggtaaatgcagtaacggttagttttctactttgtcttatagaaggtagaaaccatgtgtatgttatgtttgtctataaaagaaaaaatactaatattaaataatttcttacgactctgagtcactcacttatttttccaataattgatattgtacattcctagtgccattaggtatgtatgtatgtaacttttacagtttttcagctgaaagttgtaagtattttttttttttgatcggggctctttaatctcattttaatttcctttgtttgaactgtagttattttatttattcctatattaaccatctaaaccaactgtaatgacatgtacactaatacagaattgaacatttgtagttgttggcagtgaacccagttgttggtgaatttaaagcttaaaatatgggaatgatttgctgctatatttcctttgagagagaaaggaggaagaaatagaacctaatagtgatcatgaattttagggaaagtaccgaagaaccatggggtcccctctggtttcttgtgttgaatgaggcaagggtaatcatctgattccgagctgaagacctctggtcctcttaaggagggagagtgcatttttagagcttttagcaaaatgtgaaaagctgatgtttgcgccttgctttgtgaatttggctttgttttacttatacattaactcatgtaatctcttaaatcttacaagcattgatccatttcaacaaaaaggtaaatttaaaatgcagactttgttatttgccaaagaagattcatgaaaaatttacgtccaattattttgcaaatagttaatttcatttggctttttaccatgttccttcctttctttttcccgcttccttaatgtaatttaaaccctggcaaacattctttagaaaccaagaggaaagaaagaacaaatatcaaaaaagacatagaatttaatattgatacaatttcacctctaaaatggatttgaagaaatgcaactttatatcaaaaaatgtcatctgatttcctttgtttcttttttaaattatgtaatcagatgattttatgtttttttttcaggggagcggaatattggtttcttttacttgttgttttcagttttctctgccattcatgtttcttttttgtgttcagtgtttcaaatacaatttgtatttaaggattttaaaataccaaactgtaactgagtacagtggatcgttttctgttaggatgttaatattatacaatgaaatctataaagtgttgtcaatttgattattgacacatataacatgtttacaaataaactgtggtattgatcaagttactatgaaaa

SEQ ID NO: 3777 - DNA, 1753 bp, Homo sapiens
ctaggaagaaacttggagctgttcaggcgatccagcctccaatcgctgctgctcttgtactcggttggcccgggcggcgctgaactgtcgggagcctaggccatggggcagcctgggccttctgcagtgtgaggcgcggggcctcccgcgtcgctccgctgacaggctgcgggcgggcaggcgggaggcgtagtgtgggtcgcggtggcggccccggccgccggccctggccgcggcatcatgaacatagacgtggagttccacatccggcacaactacccctggaacaagttgccggccaacgtgagacagagtcttggaaattcacagagagaatatgaaaagcaggttgtcctgtacagtatccgcaatcagttacgatatagaaataacttagttaaacatgtcaagaaagatgaacgcagatactatgaggaactgctaaagtacagccgagatcatctcatgctgtacccttaccatctatcggatagtgtatgttatgtttgtctataaaagaaaaaatactaatattaaataatttcttacgactctgagtcactcacttatttttccaataattgatattgtacattcctagtgccattaggtatgtatgtatgtaacttttacagtttttcagctgaaagttgtaagtattttttttttttgatcggggctctttaatctcattttaatttcctttgtttgaactgtagttattttatttattcctatattaaccatctaaaccaactgtaatgacatgtacactaatacagaattgaacatttgtagttgttggcagtgaacccagttgttggtgaatttaaagcttaaaatatgggaatgatttgctgctatatttcctttgagagagaaaggaggaagaaatagaacctaatagtgatcatgaattttagggaaagtaccgaagaaccatggggtcccctctggtttcttgtgttgaatgaggcaagggtaatcatctgattccgagctgaagacctctggtcctcttaaggagggagagtgcatttttagagcttttagcaaaatgtgaaaagctgatgtttgcgccttgctttgtgaatttggctttgttttacttatacattaactcatgtaatctcttaaatcttacaagcattgatccatttcaacaaaaaggtaaatttaaaatgcagactttgttatttgccaaagaagattcatgaaaaatttacgtccaattattttgcaaatagttaatttcatttggctttttaccatgttccttcctttctttttcccgcttccttaatgtaatttaaaccctggcaaacattctttagaaaccaagaggaaagaaagaacaaatatcaaaaaagacatagaatttaatattgatacaatttcacctctaaaatggatttgaagaaatgcaactttatatcaaaaaatgtcatctgatttcctttgtttcttttttaaattatgtaatcagatgattttatgtttttttttcaggggagcggaatattggtttcttttacttgttgttttcagttttctctgccattcatgtttcttttttgtgttcagtgtttcaaatacaatttgtatttaaggattttaaaataccaaactgtaactgagtacagtggatcgttttctgttaggatgttaatattatacaatgaaatctataaagtgttgtcaatttgattattgacacatataacatgtttacaaataaactgtggtattgatc

SEQ ID NO: 3778 - DNA, 878 bp, Homo sapiens
gcgccttggaatccccgtccttgggcccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttattgctcaagcagaaacggaattacagagagctgcaatggatgctagccgaacaagtcgtcatctggaggaaactattaacaactttgaaaggcagaaaatgaaggatataaagactatattttctgaatttatcacaatcgaaatgttatttcacggcaaagctttagaggtctacactgctgcctaccagaatatacaaaacattgatgaagatgaagatttagaggttttccgaaattctctgtatgcaccagattattcatctcgtttagatattgtaagagcaaattcaaagtcacctcttcagagatcactgtcagctaagtgtgtatctggaacaggacagcaggaggctggctgggccgcaacttgccaaaccctgatctag

SEQ ID NO: 3779 - DNA, 959 bp, Homo sapiens
gcgccttggaatccccgtccttgggcccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttattgctcaagcagaaacggaattacagagagctgcaatggatgctagccgaacaagtcgtcatctggaggaaactattaacaactttgaaaggcagaaaatgaaggatataaaggttttccgaaattctctgtatgcaccagattattcatctcgtttagatattgtaagagcaaattcaaagtcacctcttcagagatcactgtcagctaagtgtgtatctggaacaggacaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgacc

SEQ ID NO: 3780 - DNA, 4241 bp, Homo sapiens
agaaacgcccggcctgccgcggcggcgcgaggggcgggctttcaggctcccggcggctgcttgcgccccagcgcgcgcccaggcgccttggaatccccgtccttgggcccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttatttcacaggcagaaacggaattacagagagctgcaatggatgctagccgaacaagtcgtcatctggaggaaactattaacaactttgaaaggcagaaaatgaaggatataaagactatattttctgaatttatcacaatcgaaatgttatttcacggcaaagctttagaggtctacactgctgcctaccagaatatacaaaacattgatgaagatgaagatttagaggttttccgaaattctctgtatgcaccagattattcatctcgtttagatattgtaagagcaaattcaaagtcacctcttcagagatcactgtcagctaagtgtgtatctggaacaggacaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaatgaaggctttaaaaaatattgcataccagtcatttcaacatcctacctagtgttacatgatttttgtgtaagtgcctttttttttaaagatggtgtatttcaaagtatttcatattaatgtactatatctacttgaagttccaatagtacattatgacagaaaccaaaagatctaacaattctgcttagctttttggttaagactccatgctttcattaccagaaaagggtcttacgtagtcattatgattcatggaattctattccatgaagccttaagaaaaaaaactttttttaactttccctgaaactttatcatttgataagtaaatttacttttcaagaagagtataaccaaagagtaaagataatgtgacactaagttatcaatgttttatgaatacacataaggcataaatttcagctgtaaaaaagctacattcaatctgactctggttttaaaacaaaactgctgtcataattatacatgatactgcaacttttggaaggctaatttggtggaatgttgcctcatcatagaacaccatagatcattaaaaattctataaaaattttaccaagctaccatatagttaataaaagggtatacagtcacttttatttctgaaaatataaaacattgagcctttcagtgtatctgatgcttctcttttggtaaggaatacttttatttcatggatcccaggcaggcatataaaagttacggaatttataaaatcatttgggataattagaaaatgcaattattcataacagaaaaataaagactttctagaaagcttctgactttgtcaatcatggctctgttcttaacaaagcactccttcctgagaatagtcctaagtgacaaagttgtttcagtacttttttgtaaaatatttaaaacattttaaaaccctaaattgatattcttaagaaactcaagatatcattggatatttactgcttcctcactcagtatttaaatttggttgtacttcgggggaaaacaacagagttattattttgctgcttactaaatagcaacttctcttgagcattatttgccttgtttgtaaagttaaaactgcgtaaaacagtaattctggaataaaacatacattctgcctacctcaaagaaatattctaagaacaaaaggaatactatccatgaaaatactttcattaatgtaaaattttcattatttagaccagcctaggttggcaaacttcttaaagggccagatagcaaatactgttattcttcgtgggtttaggcaaattcaagactattatacaggtaactatgtaaccatgtaagacttaagtacacttaaaaaatgtgaaaaaccattcctagcttccactacaacaacaacaaaaaacaggcaaccaatccaaccaacccagcctgtaagtctccatctcttatctccaaaataggaatacaaattgagtatcctttatctgaagtgcttgggaccagaagtatttaagactttggatttcttcagattttggagtatttgcattataccagttcaacattcctaacccaaaaatctgaaatcttaaatgctgcaatgagcattttctttgagcatcatgttggcactcaaaaagtttgtgattttcggagcatgtgaaatttcagattaccagattaggaatactcaacctgtagtacatttactaggattatcagaattaaatgatagttaattcatacataattatacatcatatagtatctaatacagctcaataaacaacagctaatatttactgcaaaaacagaggcagcaaggtcactacttaacaggtgatatatggatcaagaatcactgctcttaacagtgatctcagtaaattaatagaaatgcactcctaacatgatttttacctatctcttggttgtgggattgactttctagacatgatctacatttttttagataatttctagacaaaaatgtttggctttaagacaaatgccactgggtatcaggctagagaatacacctccagtgtacctggtataccttgaggataggagaggaaaaactggctatgagacgacaattactgaagctgagtgatgtgtacatgaaaatttactattctttttttatatttgaaattgatgaggtgctgggaagctggctttctgaggggacaacaggaggggaattccttgatttgctgcatttatcactttccatggtgtaaaatactcctgccatggccaatttgttattgacatatcactaaaggcagagttggagagagatgtgcaaagatggctcccaactagaagataccactttctgtaatcaactttttataatgaagtttaaaaatattaagccctgatacattatagggtaaaaggaaatattcatataaattaatttaaaaatcaaaatacaaggctgggcacagtggctcacacctgtaatcccaacacattctgggagaccaaggagtgaggattgcttgaggccagaaatttgagaacagcctgggcaacacagtgagactctgtctctacaaataataaaaaatttagccagacaaggtggcacacacctgtagtcccagctctcaggaggctgaggcaggaagacagcttgagcccaggagttagaagctgcagtgaaccattatcagaccactgcactccagcctggccagcagaacaagactctgactcttaaaataataaaactacaaagcttatgtttactctagctggcctcttatctaccaccaccatcccacctcagcccagtttgaaatgcaattccacagtaagtaatccctcacgttaagcttcatcttagctttattcctttgtatctgagaagcattttttaactttccatatattattcaaaatgggtgaccaaatgaaccatctatacaatctttgctcaattaaaaatatcatttctactttcttcattgtgcttggtttggatattccaaacaatcaatttaacattatcctagctacttacaagcttatactttaaagaatcatactgaggtgctttttcatatcaaatttacctgtttatt

SEQ ID NO: 3781 - DNA, 1159 bp, Homo sapiens
gcgccttggaatccccgtccttgggcccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaattaactcagttagaaagaacacgtcagcgaaacccatctgatcgacatgttattgctcaagcagaaacggaattacagagagctgcaatggatgctagccgaacaagtcgtcatctggaggaaactattaacaactttgaaaggcagaaaatgaaggatataaagactatattttctgaatttatcacaatcgaaatgttatttcacggcaaagctttagaggtctacactgctgcctaccagaatatacaaaacattgatgaagatgaagatttagagagatggagtttcgccatgttgcccaggctggtcttgaactcctggggctcaagcgatccgcctgcgttggcctcccaaagtgtcaggttttccgaaattctctgtatgcaccagattattcatctcgtttagatattgtaagagcaaattcaaagtcacctcttcagagatcactgtcagctaagtgtgtatctggaacaggacaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgacc

SEQ ID NO: 3782 - DNA, 826 bp, Homo sapiens
gcgcgattgggacagtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaagtttatgatttgattagaactatccgggacccagaaaagcccaatactttagaagaactggaagtggtctcggaaagttgtgtggaagttcaggagataaatgaagaagaatatctggttattatcaggttcacgccaacagtacctcattgctctttggcgactcttattgttggaaatctacatttctgaaggaacccactcaacagaagaagacatcaataagcagataaatgacaaagagcgagtggcagctgcaatggaaaaccccaacttacgggaaattgtggaacagtgtgtccttgaacctgactgatagctgttttaagagccactggcctgtaattgtttgatatatttgtttaaactctttgtataatgtcagagactcatgtttaatacataggtgatttgtacctcagagtattttttaaaggattctttccaagcgagatttaattataaggtagtacctaatttgttcaatgtataacattctcaggatttgtaacacttaaatgatcagacagaataatattttctagttattatgtgcaagatgagttgctatttttctgatgctcattctgatacaactatttttcgtgtcaaatatctactgtgcccaaatgtactcaatttaaatcattactctgtaaaataaataag

SEQ ID NO: 3783 - DNA, 1105 bp, Homo sapiens
aatgtgctgacgagccgcgaagattgtttttgtcccgccgaaatcgagcaaagcacgctggaacttgtagtccttgaggccccttccctaggtccttcgagctactccgtctggccccgccttttctctgctctcctgaacctttaggcttgtctcggcccatttgaagaccaggaagttgatcaatcccgaggctgctgagagacggtggcgcgattgggacagtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaagtttatgatttgattagaactatccgggacccagaaaagcccaatactttagaagaactggaagtggtctcggaaagttgtgtggaagttcaggagataaatgaagaagaatatctggttattatcaggttcacgccaacagtacctcattgctctttggcgactcttattgggctgtgcttaagagtaaaacttcagcgatgtttaccatttaaacataagttggaaatctacatttctgaaggaacccactcaacagaagaagacatcaataagcagataaatgacaaagagcgagtggcagctgcaatggaaaaccccaacttacgggaaattgtggaacagtgtgtccttgaacctgactgatagctgttttaagagccactggcctgtaattgtttgatatatttgtttaaactctttgtataatgtcagagactcatgtttaatacataggtgatttgtacctcagagtattttttaaaggattctttccaagcgagatttaattataaggtagtacctaatttgttcaatgtataacattctcaggatttgtaacacttaaatgatcagacagaataatattttctagttattatgtgcaagatgagttgctatttttctgatgctcattctgatacaactatttttcgtgtcaaatatctactgtgcccaaatgtactcaatttaaatcattactctgtaaaataaataagcagatgattcttataatga

SEQ ID NO: 3784 - DNA, 1536 bp, Homo sapiens
agtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaagtttatgatttgattagaactatccgggacccagaaaagcccaatactttagaagaactggaagtggtctcggaaagttgtgtggaagttcaggagataaatgaagaagaatatctggttattatcaggttcacgccaacagtacctcattgctctttggcgactcttattgttggaaatctacatttctgaaggaacccactcaacagaagaagacagtaagtgaatgttgaaacataattgaaaaacaacttcagatagtattttatcttggatactggattcttctgccagccaagaatctactgggttactttcaaaaaagtgcacaattggttattggctcttccttcctaggtgaggaaacctaggcatttcaaagaagtaatttttgcagtggactccgagtgcactagagcccacggatgttgactggtttaggccagtggctacacatctgtaaagaatatccagtgctggggaccttgacttatgagctctaagtaggcttcttttctttggtgacaggatagagagctgtgtacttgaaattgaaggtctagcaagtagagctttagtgaatcttggggtaggtgctgtctctctgggttagtatattagaatgggagtggggaaccttttttatatagaggacctctggcctacagagagaaatcaatcagtagctacttaaaaatagcagaagtggggtttgggaaaagcaaaaaacaaaatgttctgtatgatccctgtgttacattaaaaacataattttaatgtttttaatctacaaatgatagagtgcaaataatgagaaatacatttaaaaggcatgttgtacttaagtttcatcactaagtaaattgagaaggtgggaaaaaatagcagaggaatggaagaaagagctaatagaggaagagcaacagtgagatagataccaagaagactcagaaaggcatacacagggctggagagagacacacaaaatctcctacataaaagagagctatagagagggaagcctgctgcttccagaggaacagcctatccaggaaactttttaggtactgtcatgaaaactgttaaaaaccatgccctatttatagttctagacatgtagattattatactctttgtgggctgaatttctttaaaccccacgagctgagggcttctacctgtaatttagaaaaataagagtttaggtaccctaaatccactcaggttatcgttttgaaattccttgaatgataggattttacagcagcaatagtattaagtcttatgagtcttgtttttcatttagtaagtatttattaagtgccttctatgtgtgggtacagttcagcctttgagatacattcctgcctttgtggagcctacattgtagta

SEQ ID NO: 3785 - DNA, 2816 bp, Homo sapiens
acgctccggacatgcgcagtgcgggagctgaggcgccagctgtggatttggaagttccggggaagtcgcgcatgcgcgagtgtacgcgttgccggcgaagaggggagcctgacgactcggaaatttgaataccacagtagcatggagtgtgacctcatggagactgacatcttggagtcgttggaagatctaggttacaagggcccattgttggaagatggagcgctctctcaggcagtctctgctggagccagttcccccgagtttaccaaactctgtgcttggctggtgtctgaattaagagtgctctgtaaactagaggaaaacgtgcaagcaactaacagtccgagtgaagctgaagaattccagcttgaggtgagtgggctactaggggagatgaactgcccgtatctttcactgacatctggggatgtgaccaagcgccttctcattcagaagaactgcctcctcttgctcacatacctcatctcagaactagaagctgccagaatgctctgtgtgaatgctcctccaaaaaaagctcaagaaggaggcggtagtgaggtctttcaagagttgaaaggcatatgtattgctctaggaatgtccaaacctccagccaatataactatgttccaattcttcagcgggattgaaaaaaaattaaaggaaacattagcaaaagttccacctaatcatgtgggaaagcctttactgaagaagccaatgggaccagcccactgggaaaagatagaagcaattaaccaagccatagccaatgaatatgaagtccggagaaagctgctaataaaacgtttggatgtcactgtacaatcctttggctggtctgacagagctaagagccagacagaaaaattagccaaggtttaccagccgaaacgttcagtcttatcccctaaaactactatttctgttgcccatcttttggctgcaaggcaggacttgtcaaagattttaaggacaagcagcggctctataagagaaaagactgcctgtgccatcaataaggtgttgatgggcagggtgcctgacagaggtggtagacccaatgaaatcgaacctccacccccagagatgccaccgtggcagaagaggcaagatggcccccagcagcaaacaggaggccgaggaggagggagaggtggctatgaacattcctcatacggaggacgaggaggtcatgaacaaggaggcgggagaggtggacgtggtggctatgaccatggtggccgagggggaggaagaggaaataagcatcaaggaggctggacagatggagggagtggtggaggaggtggctaccaagatggtggttatcgagattcaggtttccagccaggtggctatcatggtggccacagcagtggtggctatcaaggcggaggttatggtggcttccaaacatcttcttcatatacaggaagtggataccagggtggtggctaccagcaggacaatagataccaagatggcgggcaccatggtgatcgtggtggtggtcgtggtgggcgaggtggtcgtggaggccgaggtggtcgtgcaggccagggaggaggctggggaggaagagggagccagaattatcaccaagggggtcaatttgaacagcatttccagcatggaggttatcagtataatcattctggatttggacagggaagacattacactagttgaggctaccgaaccttacattttgctagagctcaagtaatagaaacttagtttcagaatcctgaattcagcacctattttgaattaatgtgagaccacaggtggcaggcagattcctgcttggcataagcatttgtaggtcttcattcaattctgttagatttttttattggacttacataatgccgtttatttgagaaacacataacatctctcctttctatgaaaaattttttaaaaggtggttaaaattgcctttaattgcccagtagactaattccacagtcagaacatgcaaacttttttgaagaaattacttgaataagtagttttcatgttttcaatatgcagttttgaaaatgaggattcacctagacttttttagatttactactaggaaaccttcctcatatgaataaccatttatatgtgttttgcttaaagtattccaatgcctattttccaagcacagttctgccccccggttgacttttatgccacgtgtgcttcatgatggaacttttaggtcagttcctattaaatgagctcttttgcagatagcacattcagtagccttattttgttgatggaatactgtatcatatgctcaactctgaaaaccttgaacacggccaaaatccataaagattataaaagcaaactaagttgtgaagctatagtacatgtaggcatttagttaagtatagcaattcaaactgacctgcatccatccaaaacaaattcctccttcaaccttatttttacttgaaatttgctagaagaaatagcaaaccgaaatttgttttatgcatgagttaataccactggctcagcaaatacaagttagtttgctttaagcaggtaactttttttgtaatggaagaaatgcactacaaagttaagacagatttttgctaagtgcaggaggccctttattattgctgcagaaaacaaaagcctggctgagttgatgttttacattctcccttactgaaatctacatgacatgatgcttcttgctgggtttttgtacatgtaaacattgtcaagctgtgaaagaaaatggctggaggtgtgctttgtgtgaaaggtgagcaataaagtatctgttaagttctctc

SEQ ID NO: 3786 - DNA, 2752 bp, Homo sapiens
agtcgcgcatgcgcgagtgtacgcgttgccggcgaagaggggagcctgacgactcggaaatttgaataccacagtagcatggagtgtgacctcatggagactgacatcttggagtcgttggaagatctaggttacaagggcccattgttggaagatggagcgctctctcaggcagtctctgctggagccagttcccccgagtttaccaaactctgtgcttggctggtgtctgaattaagagtgctctgtaaactagaggaaaacgtgcaagcaactaacagtccgagtgaagctgaagaattccagcttgaggtgagtgggctactaggggagatgaactgcccgtatctttcactgacatctggggatgtgaccaagcgccttctcattcagaagaactgcctcctcttgctcacatacctcatctcagaactagaagctgccagaatgctctgtgtgaatgctcctccaaaaaaagctcaagaaggaggcggtagtgaggtctttcaagagttgaaaggcatatgtattgctctaggaatgtccaaacctccagccaatataactatgttccaattcttcagcgggattgaaaaaaaaaaattaaaggaaacattagcaaaagttccacctaatcatgtgggaaagcctttactgaagaagccaatgggaccagcccactgggaaaagatagaagcaattaaccaagccatagccaatgaatatgaagtccggagaaagctgctaataaaacgtttggatgtcactgtacaatcctttggctggtctgacagagctaagagccagacagaaaaattagccaaggtttaccagccgaaacgttcagtcttatcccctaaaactactatttctgttgcccatcttttggctgcaaggcaggacttgtcaaagattttaaggacaagcagcggctctataagagaaaagactgcctgtgccatcaataaggtgttgatgggcagggtgcctgacagaggtggtagacccaatgaaatcgaacctccacccccagagatgccaccgtggcagaagaggcaagatggcccccagcagcaaacaggaggccgaggaggagggagaggtggctatgaacattcctcatacggaggacgaggaggtcatgaacaaggaggcgggagaggtggacgtggtggctatgaccatggtggccgagggggaggaagaggaaataagcatcaaggaggctggacagatggagggagtggtggaggaggtggctaccaagatggtggttatcgagattcaggtttccagccaggtggctatcatggtggccacagcagtggtggctatcaaggcggaggttatggtggcttccaaacatcttcttcatatacaggaagtggataccagggtggtggctaccagcaggacaatagataccaagatggcgggcaccatggtgatcgtggtggtggtcgtggtgggcgaggtggtcgtggaggccgaggtggtcgtgcaggccagggaggaggctggggaggaagagggagccagaattatcaccaagggggtcaatttgaacagcatttccagcatggaggttatcagtataatcattctggatttggacagggaagacattacactagttgaggctaccgaaccttacattttgctagagctcaagtaatagaaacttagtttcagaatcctgaattcagcacctattttgaattaatgtgagaccacaggtggcaggcagattcctgcttggcataagcatttgtaggtcttcattcaattctgttagatttttttattggacttacataatgccgtttatttgagaaacacataacatctctcctttctatgaaaaattttttaaaaggtggttaaaattgcctttaattgcccagtagactaattccacagtcagaacatgcaaacttttttgaagaaattacttgaataagtagttttcatgttttcaatatgcagttttgaaaatgaggattcacctagacttttttagatttactactaggaaaccttcctcatatgaataaccatttatatgtgttttgcttaaagtattccaatgcctattttccaagcacagttctgccccccggttgacttttatgccacgtgtgcttcatgatggaacttttaggtcagttcctattaaatgagctcttttgcagatagcacattcagtagccttattttgttgatggaatactgtatcatatgctcaactctgaaaaccttgaacacggccaaaatccataaagattataaaagcaaactaagttgtgaagctatagtacatgtaggcatttagttaagtatagcaattcaaactgacctgcatccatccaaaacaaattcctccttcaaccttatttttacttgaaatttgctagaagaaatagcaaaccgaaatttgttttatgcatgagttaataccactggctcagcaaatacaagttagtttgctttaagcaggtaactttttttgtaatggaagaaatgcactacaaagttaagacagatttttgctaagtgcaggaggccctttattattgctgcagaaaacaaaagcctggctgagttgatgttttacattctcccttactgaaatctacatgacatgatgcttcttgctgggtttttgtacatgtaaacattgtcaagctgtgaaagaaaatggctggaggtgtgctttgtgtgaaaggtgagcaataaagtatctgttaagttc

SEQ ID NO: 3787 - DNA, 1539 bp, Homo sapiens
atgcgcgagtgtacgcgttgccggcgaagaggggagcctgacgactcggaaatttgaataccacagtagcatggagtgtgacctcatggagactgacatcttggagtcgttggaagatctaggttacaagggcccattgttggaagatggagcgctctctcaggcagtctctgctggagccagttcccccgagtttaccaaactctgtgcttggctggtgtctgaattaagagtgctctgtaaactagaggaaaacgtgcaagcaactaacagtccgagtgaagctgaagaattccagcttgaggtgagtgggctactaggggagatgaactgcccgtatctttcactgacatctggggatgtgaccaagcgccttctcattcagaagaactgcctcctcttgctcattaaaggaaacattagcaaaagttccacctaatcatgtgggaaagcctttactgaagaagccaatgggaccagcccactgggaaaagatagaagcaattaaccaagccatagccaatgaatatgaagtccggagaaagctgctaataaaacgtttggatgtcactgtacaatcctttggctggtctgacagagctaagagccagacagaaaaattagccaaggtttaccagccgaaacgttcagtcttatcccctaaaactactatttctgttgcccatcttttggctgcaaggcaggacttgtcaaagattttaaggacaagcagcggctctataagagaaaagactgcctgtgccatcaataaggtgttgatgggcagggtgcctgacagaggtggtagacccaatgaaatcgaacctccacccccagagatgccaccgtggcagaagaggcaagatggcccccagcagcaaacaggaggccgaggaggagggagaggtggctatgaacattcctcatacggaggacgaggaggtcatgaacaaggaggcgggagaggtggacgtggtggctatgaccatggtggccgagggggaggaagaggaaataagcatcaaggaggctggacagatggagggagtggtggaggaggtggctaccaagatggtggttatcgagattcaggtttccagccaggtggctatcatggtggccacagcagtggtggctatcaaggcggaggttatggtggcttccaaacatcttcttcatatacaggaagtggataccagggtggtggctaccagcaggacaatagataccaagatggcgggcaccatggtgatcgtggtggtggtcgtggtgggcgaggtggtcgtggaggccgaggtggtcgtgcaggccagggaggaggctggggaggaagagggagccagaattatcaccaagggggtcaatttgaacagcatttccagcatggaggttatcagtataatcattctggatttggacagggaagacattacactagttgaggctaccgaaccttacattttgctagagctcaagtaatagaaacttagtttcagaatcctgaattcagcacctattttgaattaatgtgagaccaca

SEQ ID NO: 3788 - DNA, 4388 bp, Homo sapiens
acttagagcgccgaacagctctgggccaaaggaccatgagagggccggagccgggtccccaaccgacgatggagggagacgtgctggacacactggaggcgctggggtataaaggaccattgttagaagagcaagcccttacaaaggcggcagagggtggattatcttcacctgaattttcagagctctgtatttggttaggctctcaaataaaatcattatgcaacttggaagaaagtatcacgtctgctggaagagatgatctagagagcttccagcttgagataagtggctttttaaaagaaatggcatgtccatattctgtactcatatcaggagatattaaagatcgtttaaaaaagaaggaggactgtttgaaacttctattatttttaagtacagaacttcaagcttcacagatattacagaacaagaaacataaaaattctcaattagataaaaatagtgaagtttatcaggaagttcaagctatgtttgatacacttggtatacccaagtcaacaacttctgacattccgcatatgctaaaccaagtggaatcaaaggtgaaagatattctctcaaaggtccagaaaaatcatgtgggaaaaccactgctgaaaatggatttaaattcagaacaggcggaacaactggaaagaatcaatgatgctctttcctgtgaatatgagtgccgccgacgaatgttaatgaaacgattagatgtgactgtacagtcctttggatggtctgatagagcaaaggtaaaaacagatgatatagcaagaatttatcagcctaagcgttatgctttgtcacccaagacaacgattacaatggcacatctacttgctgctcgtgaagatctatccaagatcattaggacaagtagtggcaccagccgggagaagaccgcatgtgccattaataaggtgctgatgggaagggtgcctgacaggggaggccggccgaatgaaattgaaccaccacctccagaaatgcccccttggcaaaagagacaagaaggcggcggtggaaggggtggttggggtggtggtggtggaggtggtggtagaggaggtggtgggggtgggggtgggagaggtggctgggggggtggaggaggaggttggggaggtggtgggggagggggaggagggtgggggggaggaggaggaggtggtagaggaggtttccaaggcaggggagattatggtggaagagggggttatggtggaagagggggctatggtggaagaggctatggagatccatatggaggaggtggtggtggtggtggtggtggtggtggaggaggtggatatagaagatactaaaaactataaaaattagatagcagtgcttgcttctttatagatacattagaaatagtgttccaaataacatacttgaatatcatctttgaagtaaacaccatgttagactccctggtgataccactcttgaattggttaatatgtaagaacattgttttttattaccagttgatctctcaaatgaagtgatgactttttccatattctgtgtacccttgagcatgttgtgtctttttaaaaaacaaaaaaaagaacaaaaattattttttaaaatgtaaatatttattaccatcagacttggaaaatggaaagtattttattgtcatgattgaatttagattgttacctgtattttgttcaggtttgagacatataaaagaccccacctgtaatagaaaggaatatagacccttgcctcacctgtattgctgtggatgtgttttgtgggtttttcattcgattttacaaaatagggaaaggcacttccagttgtatttagtaggcagttgttgtgaatcatttttttctcttataggaggagattcctctctagccatgtttctgttaaagtttcattaattgaagcccaagtttactttttactgtacatacttattttctaattggatttgaaatcagcatgattttgtttgacaaagcaaagtttaagattgaggtcagaaatactttaatggagcaaagacacataccaactttacatgacggtgtgagaaatagtcctataaactggtctcttcatcatttatgctctcactttagatatccaaatattaaaaggcaggctgacctgtatcacacagaattaaggcagtaattttctgcttcagtagatcaagggtagggctaaggcatcctgtggtaattctgattcacagctagatttgggaaacacaaagttagggaatggctatatgtgatttgctagttggagcagtcaaagtcttagctatcaagagttgtgaatttgaatcatggcactaggtcaggggtgctatggattgaaatgaccttagttctcaaggagtgatttgtcctcatttgtcaaatgaggaatgagacacttaccatcatctcaggttgtttcttaaagacctaaatacaaatacaatttgttaaaaacttacagagggcctattttgaatgctttaagatgtaggccaagtaatgtatttttctcttagtgtagaaagttaagagaaaaagagctggtaccataaattttttcaatcttagtgtaaaatctgtatctcattgtaggcttctggtcaatacctatacataacaacttaatgtgatctaaccaactcaactgatagaaagctgaattgttcccagtggacaagtggtatttgatgtttagcaggtttttttgttgttatttttttggtaaactctgtggtaaaatctaaaataatgttaaaaccctaaaagtaactattgaatattctgtaatcttagacatgtatttttcaagctaaccctttgaagaaatgtgttcaaggtaggaaaatataaaattttttggttatttgtaaatttattttttgtgtgtttatatttaatgaaaagatgtaatttcatttgtgatagctgaaaaaaaggctttccataattaagaaaatacctttatcagtagctatgaactctgaaaaataatttttaaaaacttttaagaaaaaaactacttgagtaaaatatttcaagagttgtttaaaaatcttctttaaaacctttacatttctgcctcacttcttttttggtagcattagttgctgatgaaggagatttacaactactttcaacttttttaccactaaaggtttatggtaaatatggcagaaacaatagtttatcagtttcattagattttccataagatttctttgtacctttataggagtgctgcttgggttattcactacaatcacttatttcctatcaaagtttagcacttgctcctggaatcgtgttggagctgaaaccactcctatgtacacattcctataaaccttaattgaatgaaaagctgaatcaggtagactcttaatattttactctttcctgtaaggtgggattttcctgataatctttgttcagtaaaaatttcttttgtagaacagtttgctgagcagtatctggaatagcaggaaggaaatttggggccttaatgggaaaggccatagtgtgaaaatgttttataaattgagtgcaatacgacatggagtatgatgaatggcactccactgcttcctaaaatccaacactttttttgatacctccttttcattcttttttgcctggttctcaatttcattttttaattacctcattgtccttccccttttttcttctctttttgtccagcctggtacctaatagcaaatatagacatgatcttactgggagtttctgcctaaagtagtcatctttcctctcgaccgtataaagagcatgtattctgtctataacataatcaccacactattactcataagcacacatcaaaagggaaacaagggttttctttgaacttacttttgttttgcagatcagggaaaccttgcctcattaaacagaaaaaggaaaacattttaaataaaaaacatcttattacctgtatctgtgacaagaggaggcatgacaacctaaaaaaaatttgtgaccagaaaaatgtcctgagcagtgatactatctataccttggaaggagcacaggttagagaaatgtggggatgaaaattggggaaggtgagcaggcagtttaatcttgccttcaggatcaggctgtcagtgtgactttattactttgtatgaagtattatgaattgcccaaatgataaatacacccccatctaaatgttccagaatgcattccacagaggaatttgagtgactgaaatttttcctctttcttcattggtgtggttaaacaaaaattagctggggattaagggaaaattgtggctatgtctgatcattctaaataatcatgaccacaaataaattgccctgagtaggtctgtaacctgga

SEQ ID NO: 3789 - DNA, 3111 bp, Homo sapiens
aaaggaccatgagagggccggagccgggtccccaaccgacgatggagggagacgtgctggacacactggaggcgctggggtataaaggaccattgttagaagagcaagcccttacaaaggcggcagagggtggattatcttcacctgaattttcagagctctgtatttggttaggctctcaaataaaatcattatgcaacttggaagaaagtatcacgtctgctggaagagatgatctagagagcttccagcttgagataagtggctttttaaaagaaatggcatgtccatattctgtactcatatcaggagatattaaagatcgtttaaaaaagaaggaggactgtttgaaacttctattatttttaagtacagaacttcaagcttcacagatattacagaacaagaaacataaaaattctcaattagataaaaatagtgaagtttatcaggaagttcaagctatgtttgatacacttggtatacccaagtcaacaacttctgacattccgcatatgctaaaccaagtggaatcaaaggtgaaagatattctctcaaaggtccagaaaaatcatgtgggaaaaccactgctgaaaatggatttaaattcagaacaggcggaacaactggaaagaatcaatgatgctctttcctgtgaatatgagtgccgccgacgaatgttaatgaaacgattagatgtgactgtacagtcctttggatggtctgatagagcaaaggtaaaaacagatgatatagcaagaatttatcagcctaagcgttatgctttgtcacccaagacaacgattacaatggcacatctacttgctgctcgtgaagatctatccaagatcattaggacaagtagtggcaccagccgggagaagaccgcatgtgccattaataaggttggtgtttctttcagtacagtggaaaatgaattgatgatatcttacttaatgtttttacagattttagtctatttttctttcatgtcctggtaaatgtttagaaaaaagagtggcaggggggttcagtctaggcttagttatgttatttttgtgtatgtgtgtatgttcacttgaatttgtgtattcataaatcaaagtattttctgaattagaggaattatgaattgtttttgtcaaagctttagcaagaattatgttccatctttctaaaaagtaatcattttttgtcagtaagaatctttcggaattgtttcaagtactgacagattcgttatatccttggtgtaaagggaagaagagtttgtgctttagagtcagaccaatctgggttcccatcctggctctgtcatttacttacagaaatgaccctgagcaagctactgaacttctttgagcttctgtttcctgatttggagtatacatccatttctctgacagtagtctatttaaacaagctcaaggagtctgaatttttcactttacaacagcaataacaataaagtaatttagtatgtttatgtcagcttaactggcatgtcctcttcatttaggtagagcactccatggcaaactttattacaaaagagcaaaaaatcagaaataagggatttggataattttaaagcatcgcttctcactcagtgtaacttgagataaaataccttttcagagggatggttgtttttaaagtcattttgctaactattgctaagttaggcatcaccagtgtttgcctctgtgcttccactgtggctcaatcctatgttctgaaagtgttctctctttaaatatattacctaacatcttgcattgggtgataatttagtcttgctggatcaagagttctatttctgtaagtaacattggccatctcttctgagtttataatttatggtctcattatttgagggtagtcttatgatcagttctggcatctccatatgcccaccaacataccatgtttggtagagagaccagtgagaataataaccaagaaaggctgttttttggatttggtagttaggacatcattgccatctttaaaagaatgttgcatacttagaaccttgtctcactttgaggatattgcactttttatatttcatttgtgacataaatcctaaacttggttttgattggaggatcaatggaagtgtataattaattggtcattttggttgaggcagttgcttttttactttctttcctgaaaggcagtagcaggaagctattggcttccccttgtctgtggtgagcagatgacacccttcttattgctatctttcctctgctcatggcatataaagctgctactttttatagaaggttggatacttaaactcttccctagtttatttttgaaaggattataaagcatagtaaaggaattatattaactgtgttttccttttaataatatggtactagtatcatcactgaaagtaagtgagcttaagtttcttaaaagaagcagttcattgagaatccttctctctctttgcagtgatacctggaattatagtttttatatcaatctctgacctcattaaggtcccatgttatatgtacttcatacatttttgaaatgaaatgtgcttaggaatataatcttttattggataatcaattaccaaatcaatggcaatggaaagtccagagttgttattgtataaatggatattaagttaatgaatgtaaggtatgtcgttatatatataaaaaatgttttcctaaaagaacttcttagtgaaatgggtactacatttgttacagaatttgctaaacaaatttaagtgagaaaaaaattaagcctttaagtttcagaaatactctctcagattgtttaaaaataatatattctaggctgggtgtggtggctcatgcctgtaatcccagcactctgggaggccgaggcaggcggatcacgaggtcaggagatcaagaccatcctggctaacacgttgaaaccctgtctccactaaaaatacaaaaaattagctgggcgtggtggcgggtgcctgtagtcccaactactcggggggctgaggcaggagaatggcgtgaacccaggaggcagagcttgcagtgagctgagatcatgccactgcactccagcctgggcaacagagcaagactccatctc

SEQ ID NO: 3790 - DNA, 1782 bp, Homo sapiens
gatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccagtaaaaattttgattatttggagcatccacacctgaacaccattggttaatggagaattcagtgcatttctgctctgggtgccttaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacatatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaagttttgattttcaaatgttctgcttcatgtgtctgtgaagaattgtactttaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagt

SEQ ID NO: 3791 - DNA, 1931 bp, Homo sapiens
atggcggcggacggggactggcaggatttctatgagttccaggagccggcccggagcctcctggaccaggagaactgtaacgcgagccccgagcctggggcggaggcgggggccgaggcgggtgggggcgccgacggtttcccggccccggcctgcagcttggaggagaagctgagcctgtgcttccgcccctcggatccgggcgccgagcccccgaggacggccgtgcggcccatcacggagcgcagcctcctgcagggggacgagatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacatatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaagttttgattttcaaatgttctgcttcatgtgtctgtgaagaattgtactttaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaa

SEQ ID NO: 3792 - DNA, 2097 bp, Homo sapiens
gggcgggctgggccggcctgggcggggcgcgcgactgctccgggcggcgatggcggcggacggggactggcaggatttctatgagttccaggagccggcccggagcctcctggaccaggagaactgtaacgcgagccccgagcctggggcggaggcgggggccgaggcgggtgggggcgccgacggtttcccggccccggcctgcagcttggaggagaagctgagcctgtgcttccgcccctcggatccgggcgccgagcccccgaggacggccgtgcggcccatcacggagcgcagcctcctgcagggggacgagatttggaatgccctgacagataattatgggaatgtgatgcctgtagactggaagtcatcgcatactaggaccttgcacttgcttactctgaacctctcagaaaaaggggtaagtgacagtttgctctttgatacatcagatgatgaagagctgagagaacagctggatatgcactcaatcatcgtctcctgtgttaatgatgaacccctcttcacggcagaccaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacacgcttcagcatggaagggatctcaaatgtcattcagaatggcctccgccacacctttggaaattcaggtggagagaaacagtatttgactacagtcattccttatgagaaaaaaaacggaccaccgtctgttgaagatcttcaaatattaacaaaaattcttcgtgccatgaaggaggacagtgaaaaagttccgagcttgttaactgattatattctgaaagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaagttttgattttcaaatgttctgcttcatgtgtctgtgaagaattgtactttaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagtaaaaa

SEQ ID NO: 3793 - DNA, 551 bp, Homo sapiens
ttcagggaaaaccagcatacacatgaaactactgttctttgagatcaacttatctcagacagaatgattgaccagctccaaggaacatggaagtccatttcttgtgaaaattccgaagactacatgaaggagctgggtataggaagagccagcaggaaactgggccgtttggcaaaacccactgtgaccatcagtacagatggagatgtcatcacaataaaaaccaaaagcatctttaaaaataatgagatctcctttaagctgggagaagagtttgaggaaatcacgccaggtggccacaaaacaaagagtaaagtaaccttagataaggagtccctgattcaagttcaggactgggatggcaaagaaaccaccataacgagaaagctggtggatgggaaaatggtggtggaaagtactgtgaacagtgttatctgtacacgaacatacgagaaagtatcatcaaactcagtctcaaactcttaaggctttctcaagctgtcatccaaactactgaggttgtttaaataaaactccaaagtaaaatatta

SEQ ID NO: 3794 - DNA, 2744 bp, Homo sapiens
agaatgcgagaaagtgaagtcaaattcggacttgtaggcgatcagggctgaagacgctgattagagagaaaacagagggtgatggtggctgcacgtggggaatgggtgacatctcccagggggaatgagcacaaggcccagatcggaaaccccaaactcagattttaaggtttggacaagaagtacctgaggagtggaggagtgagaaagaagtgccagagagcctgaggaggaaaatcagcagactggcattatgaagaatgttgtcagaagtagggagtaggcactagtcacctaagataaggagctggattctgcccaaggcactgttatgtggtatacttgttacatgtcctgaggatccgctgaggtatttagagggaatgatcatggttataatcaaaagtggtcttcagaatcttctttgatgactccggaattgatgataaaagcctgtagcttttatactggacatttagtaaagactcatttttgcacttggagagacatagctcgtacaaatgaaaatgtcgtcctggctgaaaaaatgaacagagcagtgacatgctacaatttcagacttcaaaaatctgtatttcatcactggcactcttatatggaagaccagaaagaaaaacttaaaaatattctattgcggatacaacagatcatctattgtcacaagctaaccattatcctaacaaaatggcggaatacagcaagacataagagtaaaaagaaagaagatgagctgatattaaaacatgaacttcaattgaaaaaatggaaaaataggttaatactcaaaagagctgctgcagaagaatccaattttcctgaacgaagttcttctgaagtctttcttgtagatgagactctaaaatgtgacatttcactgttacctgaaagagcaatattacagattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatctgtcagccactgtaggaacttgcaagagttgaatgtctctgactgcccaacattcacagatgaatcaatgagacacatttctgagggctgcccgggggtcctgtgtctcaatctgtctaacacaactatcaccaacaggacgatgcgactcctgccgaggcacttccacaacttacagaatcttagtttggcttattgcagacggttcacagacaaaggcttacagtacctgaacttggggaatggatgccacaagctcatctatctggacctctctggctgcacccagatttcagtccaaggcttcaggtacattgcaaacagctgcactggaattatgcatcttaccattaatgacatgccaactctgacggacaactgtgtaaaagctttagttgaaaaatgctctcgtattacatcgctggttttcactggtgcaccgcatatctccgattgtactttcagagctctttctgcttgtaaactcagaaagatccgatttgaaggaaataaaagggttactgatgcatccttcaaatttatagacaagaattatccaaatctcagtcacatttatatggctgactgcaagggaataacagacagcagcctcagatccctttcacctttgaagcaactgactgtgttgaatttggcaaattgtgtaagaattggtgatatgggactaaagcaatttcttgatggtcctgcaagcatgaggataagagagctaaatttaagcaactgtgtgcggctaagtgatgcctctgttatgaaactatctgagcgctgccctaatttaaactacttgagtttacgaaattgtgaacatttgactgcccaaggaattggatatattgtaaacatcttttccttggtatcaatagatctctctggaacagacatctctaatgagggtttgaatgtgctttccagacataaaaaattgaaggaactttctgtatctgaatgttatagaatcactgatgatggaattcaggcattctgcaaaagctcactgatcttggaacatttggatgtctcttattgctcccagctgtcagatatgattatcaaagcactggccatttactgcattaacctcacatctctcagcattgctggctgtccaaagattactgactcagcaatggagatgttatcggcaaaatgccattacctgcacattttggatatctctggttgtgtcttgcttactgaccaaatccttgaggaccttcagataggctgcaaacaactccggatccttaagatgcaatactgcacaaatatttccaagaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatacagcagtgaagaccaagcagcgtgaccttcagcctcaagcaggaagaacaaaaaatcaagaacttggcaagttttctccatttgttgcaagtatgtttactagctgaatctcaataacaatgtaaacaagcaac

SEQ ID NO: 3795 - DNA, 2339 bp, Homo sapiens
gcagcttctccgtcaggccttgggccatggcctcgctacgcaatgccaacccgaggctgaagaactacttcaaggagaactacattcctcaggtctgcgaggcactgttatgtggtatacttgttacatgtcctgaggatccgctgaggtatttagagggaatgatcatggttataatcaaaagtggtcttcagaatcttctttggtaaagaaagtttttatggttcaccgaggataatcaactgcttcacagtctagaacctaaagactggatcttttgagaacatcagagaaagactgtgcttgccatccacactgcaacaaaactttggaaccttgaactttaagttcataatctcacaactgagaagggtccctccacactattggaactgtacacccattggaacccttaagatgactccggaattgatgataaaagcctgtagcttttatactggacatttagtaaagactcatttttgatattctattgcggatacaacagatcatctattgtcacaagctaaccattatcctaacaaaatggcggaatacagcaagacataagagtaaaaagaaagaagatgagctgatattaaaacatgaacttcaattgaaaaaatggaaaaataggttaatactcaaaagagctgctgcagaagaatccaattttcctgaacgaagttcttctgaagtctttcttgtagatgagactctaaaatgtgacatttcactgttacctgaaagagcaatattacagattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatccctttcacctttgaagcaactgactgtgttgaatttggcaaattgtgtaagaattggtgatatgggactaaagcaatttcttgatggtcctgcaagcatgaggataagagagctaaatttaagcaactgtgtgcggctaagtgatgcctctgttatgaaactatctgagcgctgccctaatttaaactacttgagtttacgaaattgtgaacatttgactgcccaaggaattggatatattgtaaacatcttttccttggtatcaatagatctctctggaacagacatctctaatgagggtttgaatgtgctttccagacataaaaaattgaaggaactttctgtatctgaatgttatagaatcactgatgatggaattcaggcattctgcaaaagctcactgatcttggaacatttggatgtctcttattgctcccagctgtcagatatgattatcaaagcactggccatttactgcattaacctcacatctctcagcattgctggctgtccaaagattactgactcagcaatggagatgttatcggcaaaatgccattacctgcacattttggatatctctggttgtgtcttgcttactgaccaaatccttgaggaccttcagataggctgcaaacaactccggatccttaagatgcaatactgcacaaatatttccaagaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatacagcagtgaagaccaagcagcgtgaccttcagcctcaagcaggaagaacaaaaaatcaagaacttggcaagttttctccatttgttgcaagtatgtttactagctgaatctcaataacaatgtaaacaagcaacaaaccatcttctgattcttattccaactacaaatatttccaaacacatcagtagttcttctgtctaaataatcatgatttaaaaaagaagccaggccaggagcggtggctcacacctgtaatcctagcactttggtaggccaaggcgggtggaccataagtcaggagttcaagaccagcctggccaacatggtgaaaccccatctttactaaaaatacaaaaattagccgggtgtggtggtgggcgcctgtaatcccagctactcaggaggctgaggcaggggacttgcttgaacctgagaggcggaggttgcagtgagcctagatcacgtcactgcattccagcctcggcgacagagcaagactccgtctc

SEQ ID NO: 3796 - DNA, 2478 bp, Homo sapiens
gcccggcccctagtcccagcgcggggagggtactatcgcagcttctccgtcaggccttgggccatggcctcgctacgcaatgccaacccgaggctgaagaactacttcaaggagaactacattcctcaggtctgcgaggcactgttatgtggtatacttgttacatgtcctgaggatccgctgaggtatttagagggaatgatcatggttataatcaaaagtggtcttcagaatcttctttgatgactccggaattgatgataaaagcctgtagcttttatactggacatttagtaaagactcatttttgcacttggagagacatagctcgtacaaatgaaaatgtcgtcctggctgaaaaaatgaacagagcagtgacatgctacaatttcagacttcaaaaatctgtatttcatcactggcactcttatatggaagaccagaaagaaaaacttaaaaatattctattgcggatacaacagatcatctattgtcacaagctaaccattatcctaacaaaatggcggaatacagcaagacataagagtaaaaagaaagaagatgagctgatattaaaacatgaacttcaattgaaaaaatggaaaaataggttaatactcaaaagagctgctgcagaagaatccaattttcctgaacgaagttcttctgaagtctttcttgtagatgagactctaaaatgtgacatttcactgttacctgaaagagcaatattacagattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatctgtcagccactgtaggaacttgcaagagttgaatgtctctgactgcccaacattcacagatgaatcaatgagacacatttctgagggctgcccgggggtcctgtgtctcaatctgtctaacacaactatcaccaacaggacgatgcgactcctgccgaggcacttccacaacttacagaatcttagtttggcttattgcagacggttcacagacaaaggcttacagtacctgaacttggggaatggatgccacaagctcatctatctggacctctctggctgcacccagatttcagtccaaggcttcaggtacattgcaaacagctgcactggaattatgcatcttaccattaatgacatgccaactctgacggacaactgtgtaaaagctttagttgaaaaatgctctcgtattacatcgctggttttcactggtgcaccgcatatctccgattgtactttcagagctctttctgcttgtaaactcagaaagatccgatttgaaggaaataaaagggttactgatgcatccttcaaatttatagacaagaattatccaaatctcagtcacatttatatggctgactgcaagggaataacagacagcagcctcagatccctttcacctttgaagcaactgactgtgttgaatttggcaaattgtgtaagaattggtgatatgggactaaagcaatttcttgatggtcctgcaagcatgaggataagagagctaaatttaagcaactgtgtgcggctaagtgatgcctctgttatgaaactatctgagcgctgccctaatttaaactacttgagtttacgaaattgtgaacatttgactgcccaaggaattggatatattgtaaacatcttttccttggtatcaatagatctctctggaacagacatctctaatgaggcattctgcaaaagctcactgatcttggaacatttggatgtctcttattgctcccagctgtcagatatgattatcaaagcactggccatttactgcattaacctcacatctctcagcattgctggctgtccaaagattactgactcagcaatggagatgttatcggcaaaatgccattacctgcacattttggatatctctggttgtgtcttgcttactgaccaaatccttgaggaccttcagataggctgcaaacaactccggatccttaagatgcaatactgcacaaatatttccaagaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatacagcagtgaagaccaagcagcgtgaccttcagcctcaagcaggaagaacaaaaaatcaagaacttggcaagttttctccatttgttgcaagtatgtttactagctgaatctcaataacaatgtaaacaagcaacaaa

SEQ ID NO: 3797 - DNA, 2270 bp, Homo sapiens
agaatgcgagaaagtgaagtcaaattcggacttgtaggcgatcagggctgaagacgctgattagagagaaaacagagggtgatggtggctgcacgtggggaatgggtgacatctcccagggggaatgagcacaaggcccagatcggaaaccccaaactcagattttaaggtttggacaagaagtacctgaggagtggaggagtgagaaagaagtgccagagagcctgaggaggaaaatcagcagactggcattatgaagaatgttgtcagaagtagggagtaggcactagtcacctaagataaggagctggattctgcccaaggcactgttatgtggtatacttgttacatgtcctgaggatccgctgaggtatttagagggaatgatcatggttataatcaaaagtggtcttcagaatcttctttgatgactccggaattgatgataaaagcctgtagcttttatactggacatttagtaaagactcatttttgcacttggagagacatagctcgtacaaatgaaaatgtcgtcctggctgaaaaaatgaacagagcagtgacatgctacaatttcagacttcaaaaatctgtatttcatcactggcactcttatatggaagaccagaaagaaaaacttaaaaatattctattgcggatacaacagatcatctattgtcacaagctaaccattatcctaacaaaatggcggaatacagcaagacataagagtaaaaagaaagaagatgagctgatattaaaacatgaacttcaattgaaaaaatggaaaaataggttaatactcaaaagagctgctgcagaagaatccaattttcctgaacgaagttcttctgaagtctttcttgtagatgagactctaaaatgtgacatttcactgttacctgaaagagcaatattacagattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatctgtcagccactgtaggaacttgcaagagttgaatgtctctgactgcccaacattcacagatgaatcaatgagacacatttctgagggctgcccgggggtcctgtgtctcaatctgtctaacacaactatcaccaacaggacgatgcgactcctgccgaggcacttccacaacttacagaatcttagtttggcttattgcagacggttcacagacaaaggcttacagtacctgaacttggggaatggatgccacaagctcatctatctggacctctctggctgcacccagattactgactcagcaatggagatgttatcggcaaaatgccattacctgcacattttggatatctctggttgtgtcttgcttactgaccaaatccttgaggaccttcagataggctgcaaacaactccggatccttaagatgcaatactgcacaaatatttccaagaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatacagcagtgaagaccaagcagcgtgaccttcagcctcaagcaggaagaacaaaaaatcaagaacttggcaagttttctccatttgttgcaagtatgtttactagctgaatctcaataacaatgtaaacaagcaacaaaccatcttctgattcttattccaactacaaatatttccaaacacatcagtagttcttctgtctaaataatcatgatttaaaaaagaagccaggccaggagcggtggctcacacctgtaatcctagcactttggtaggccaaggcgggtggaccataagtcaggagttcaagaccagcctggccaacatggtgaaaccccatctttactaaaaatacaaaaattagccgggtgtggtggtgggcgcctgtaatcccagctactcaggaggctgaggcaggggacttgcttgaacctgagaggcggaggttgcagtgagcctagatcacgtcactgcattccagcctcggcgacagagcaagactccgtctc

SEQ ID NO: 3798 - DNA, 2981 bp, Homo sapiens
agaatgcgagaaagtgaagtcaaattcggacttgtaggcgatcagggctgaagacgctgattagagagaaaacagagggtgatggtggctgcacgtggggaatgggtgacatctcccagggggaatgagcacaaggcccagatcggaaaccccaaactcagattttaaggtttggacaagaagtacctgaggagtggaggagtgagaaagaagtgccagagagcctgaggaggaaaatcagcagactggcattatgaagaatgttgtcagaagtagggagtaggcactagtcacctaagataaggagctggattctgcccaaggcactgttatgtggtatacttgttacatgtcctgaggatccgctgaggtatttagagggaatgatcatggttataatcaaaagtggtcttcagaatcttctttgatgactccggaattgatgataaaagcctgtagcttttatactggacatttagtaaagactcatttttgcacttggagagacatagctcgtacaaatgaaaatgtcgtcctggctgaaaaaatgaacagagcagtgacatgctacaatttcagacttcaaaaatctgtatttcatcactggcactcttatatggaagaccagaaagaaaaacttaaaaatattctattgcggatacaacagatcatctattgtcacaagctaaccattatcctaacaaaatggcggaatacagcaagacataagagtaaaaagaaagaagatgagctgatattaaaacatgaacttcaattgaaaaaatggaaaaataggttaatactcaaaagagctgctgcagaagaatccaattttcctgaacgaagttcttctgaagtctttcttgtagatgagactctaaaatgtgacatttcactgttacctgaaagagcaatattacagattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatctgtcagccactgtaggaacttgcaagagttgaatgtctctgactgcccaacattcacagatgaatcaatgagacacatttctgagggctgcccgggggtcctgtgtctcaatctgtctaacacaactatcaccaacaggacgatgcgactcctgccgaggcacttccacaacttacagaatcttagtttggcttattgcagacggttcacagacaaaggcttacagtacctgaacttggggaatggatgccacaagctcatctatctggacctctctggctgcacccagatttcagtccaaggcttcaggtacattgcaaacagctgcactggaattatgcatcttaccattaatgacatgccaactctgacggacaactgtgtaaaagctttagttgaaaaatgctctcgtattacatcgctggttttcactggtgcaccgcatatctccgattgtactttcagagctctttctgcttgtaaactcagaaagatccgatttgaaggaaataaaagggttactgatgcatccttcaaatttatagacaagaattatccaaatctcagtcacatttatatggctgactgcaagggaataacagacagcagcctcagatccctttcacctttgaagcaactgactgtgttgaatttggcaaattgtgtaagaattggtgatatgggactaaagcaatttcttgatggtcctgcaagcatgaggataagagagctaaatttaagcaactgtgtgcggctaagtgatgcctctgttatgaaactatctgagcgctgccctaatttaaactacttgagtttacgaaattgtgaacatttgactgcccaaggaattggatatattgtaaacatcttttccttggtatcaatagatctctctggaacagacatctctaatgagggtttgaatgtgctttccagacataaaaaattgaaggaactttctgtatctgaatgttatagaatcactgatgatggaattcagattactgactcagcaatggagatgttatcggcaaaatgccattacctgcacattttggatatctctggttgtgtcttgcttactgaccaaatccttgaggaccttcagataggctgcaaacaactccggatccttaagatgcaatactgcacaaatatttccaagaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatacagcagtgaagaccaagcagcgtgaccttcagcctcaagcaggaagaacaaaaaatcaagaacttggcaagttttctccatttgttgcaagtatgtttactagctgaatctcaataacaatgtaaacaagcaacaaaccatcttctgattcttattccaactacaaatatttccaaacacatcagtagttcttctgtctaaataatcatgatttaaaaaagaagccaggccaggagcggtggctcacacctgtaatcctagcactttggtaggccaaggcgggtggaccataagtcaggagttcaagaccagcctggccaacatggtgaaaccccatctttactaaaaatacaaaaattagccgggtgtggtggtgggcgcctgtaatcccagctactcaggaggctgaggcaggggacttgcttgaacctgagaggcggaggttgcagtgagcctagatcacgtcactgcattccagcctcggcgacagagcaagactccgtctc

SEQ ID NO: 3799 - DNA, 3032 bp, Homo sapiens
agaatgcgagaaagtgaagtcaaattcggacttgtaggcgatcagggctgaagacgctgattagagagaaaacagagggtgatggtggctgcacgtggggaatgggtgacatctcccagggggaatgagcacaaggcccagatcggaaaccccaaactcagattttaaggtttggacaagaagtacctgaggagtggaggagtgagaaagaagtgccagagagcctgaggaggaaaatcagcagactggcattatgaagaatgttgtcagaagtagggagtaggcactagtcacctaagataaggagctggattctgcccaaggcactgttatgtggtatacttgttacatgtcctgaggatccgctgaggtatttagagggaatgatcatggttataatcaaaagtggtcttcagaatcttctttgatgactccggaattgatgataaaagcctgtagcttttatactggacatttagtaaagactcatttttgcacttggagagacatagctcgtacaaatgaaaatgtcgtcctggctgaaaaaatgaacagagcagtgacatgctacaatttcagacttcaaaaatctgtatttcatcactggcactcttatatggaagaccagaaagaaaaacttaaaaatattctattgcggatacaacagatcatctattgtcacaagctaaccattatcctaacaaaatggcggaatacagcaagacataagagtaaaaagaaagaagatgagctgatattaaaacatgaacttcaattgaaaaaatggaaaaataggttaatactcaaaagagctgctgcagaagaatccaattttcctgaacgaagttcttctgaagtctttcttgtagatgagactctaaaatgtgacatttcactgttacctgaaagagcaatattacagattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatctgtcagccactgtaggaacttgcaagagttgaatgtctctgactgcccaacattcacagatgaatcaatgagacacatttctgagggctgcccgggggtcctgtgtctcaatctgtctaacacaactatcaccaacaggacgatgcgactcctgccgaggcacttccacaacttacagaatcttagtttggcttattgcagacggttcacagacaaaggcttacagtacctgaacttggggaatggatgccacaagctcatctatctggacctctctggctgcacccagatttcagtccaaggcttcaggtacattgcaaacagctgcactggaattatgcatcttaccattaatgacatgccaactctgacggacaactgtgtaaaagctttagttgaaaaatgctctcgtattacatcgctggttttcactggtgcaccgcatatctccgattgtactttcagagctctttctgcttgtaaactcagaaagatccgatttgaaggaaataaaagggttactgatgcatccttcaaatttatagacaagaattatccaaatctcagtcacatttatatggctgactgcaagggaataacagacagcagcctcagatccctttcacctttgaagcaactgactgtgttgaatttggcaaattgtgtaagaattggtgatatgggactaaagcaatttcttgatggtcctgcaagcatgaggataagagagctaaatttaagcaactgtgtgcggctaagtgatgcctctgttatgaaactatctgagcgctgccctaatttaaactacttgagtttacgaaattgtgaacatttgactgcccaaggaattggatatattgtaaacatcttttccttggtatcaatagatctctctggaacagacatctctaatgaggcattctgcaaaagctcactgatcttggaacatttggatgtctcttattgctcccagctgtcagatatgattatcaaagcactggccatttactgcattaacctcacatctctcagcattgctggctgtccaaagattactgactcagcaatggagatgttatcggcaaaatgccattacctgcacattttggatatctctggttgtgtcttgcttactgaccaaatccttgaggaccttcagataggctgcaaacaactccggatccttaagatgcaatactgcacaaatatttccaagaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatacagcagtgaagaccaagcagcgtgaccttcagcctcaagcaggaagaacaaaaaatcaagaacttggcaagttttctccatttgttgcaagtatgtttactagctgaatctcaataacaatgtaaacaagcaacaaaccatcttctgattcttattccaactacaaatatttccaaacacatcagtagttcttctgtctaaataatcatgatttaaaaaagaagccaggccaggagcggtggctcacacctgtaatcctagcactttggtaggccaaggcgggtggaccataagtcaggagttcaagaccagcctggccaacatggtgaaaccccatctttactaaaaatacaaaaattagccgggtgtggtggtgggcgcctgtaatcccagctactcaggaggctgaggcaggggacttgcttgaacctgagaggcggaggttgcagtgagcctagatcacgtcactgcattccagcctcggcgacagagcaagactccgtctc

SEQ ID NO: 3800 - DNA, 2577 bp, Homo sapiens
ataagcctgttgttcaagacgacccagcaaactgtatattttcaccaggtaaagaaagtttttatggttcaccgaggataatcaactgcttcacagtctagaacctaaagactggatcttttgagaacatcagagaaagactgtgcttgccatccacactgcaacaaaactttggaaccttgaactttaagttcataatctcacaactgagaagggtccctccacactattggaactgtacacccattggaacccttaagatgactccggaattgatgataaaagcctgtagcttttatactggacatttagtaaagactcatttttgcacttggagagacatagctcgtacaaatgaaaatgtcgtcctggctgaaaaaatgaacagagcagtgacatgctacaatttcagacttcaaaaatctgtatttcatcactggcactcttatatggaagaccagaaagaaaaacttaaaaatattctattgcggatacaacagatcatctattgtcacaagctaaccattatcctaacaaaatggcggaatacagcaagacataagagtaaaaagaaagaagatgagctgatattaaaacatgaacttcaattgaaaaaatggaaaaataggttaatactcaaaagagctgctgcagaagaatccaattttcctgaacgaagttcttctgaagtctttcttgtagatgagactctaaaatgtgacatttcactgttacctgaaagagcaatattacagattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatctgtcagccactgtaggaacttgcaagagttgaatgtctctgactgcccaacattcacagatgaatcaatgagacacatttctgagggctgcccgggggtcctgtgtctcaatctgtctaacacaactatcaccaacaggacgatgcgactcctgccgaggcacttccacaacttacagaatcttagtttggcttattgcagacggttcacagacaaaggcttacagtacctgaacttggggaatggatgccacaagctcatctatctggacctctctggctgcacccagatttcagtccaaggcttcaggtacattgcaaacagctgcactggaattatgcatcttaccattaatgacatgccaactctgacggacaactgtgtaaaagctttagttgaaaaatgctctcgtattacatcgctggttttcactggtgcaccgcatatctccgattgtactttcagagctctttctgcttgtaaactcagaaagatccgatttgaaggaaataaaagggttactgatgcatccttcaaatttatagacaagaattatccaaatctcagtcacatttatatggctgactgcaagggaataacagacagcagcctcagatccctttcacctttgaagcaactgactgtgttgaatttggcaaattgtgtaagaattggtgatatgggactaaagcaatttcttgatggtcctgcaagcatgaggataagagagctaaatttaagcaactgtgtgcggctaagtgatgcctctgttatgaaactatctgagcgctgccctaatttaaactacttgagtttacgaaattgtgaacatttgactgcccaaggaattggatatattgtaaacatcttttccttggtatcaatagatctctctggaacagacatctctaatgagggtttgaatgtgctttccagacataaaaaattgaaggaactttctgtatctgaatgttatagaatcactgatgatggaattcaggcattctgcaaaagctcactgatcttggaacatttggatgtctcttattgctcccagctgtcagatatgattatcaaagcactggccatttactgcattaacctcacatctctcagcattgctggctgtccaaagattactgactcagcaatggagatgttatcggcaaaatgccattacctgcacattttggatatctctggttgtgtcttgcttactgaccaaatccttgaggaccttcagataggctgcaaacaactccggatccttaagatgcaatactgcacaaatatttccaagaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatacagcagtgaagaccaagcagcgtgaccttcagcctcaagcaggaagaacaaaaaatcaagaacttggcaagttttctccatttgttgcaagtatgtttactagctgaatctcaataacaatgtaaacaagcaac

SEQ ID NO: 3801 - DNA, 2274 bp, Homo sapiens
aaggagaactacattcctcaggtctgcgaggcactgttatgtggtatacttgttacatgtcctgaggatccgctgaggtatttagagggaatgatcatggttataatcaaaagtggtcttcagaatcttctttgatgactccggaattgatgataaaagcctgtagcttttatactggacatttagtaaagactcatttttgcacttggagagacatagctcgtacaaatgaaaatgtcgtcctggctgaaaaaatgaacagagcagtgacatgctacaatttcagacttcaaaaatctgtatttcatcactggcactcttatatggaagaccagaaagaaaaacttaaaaatattctattgcggatacaacagatcatctattgtcacaagctaaccattatcctaacaaaatggcggaatacagcaagacataagagtaaaaagaaagaagatgagctgatattaaaacatgaacttcaattgaaaaaatggaaaaataggttaatactcaaaagagctgctgcagaagaatccaattttcctgaacgaagttcttctgaagtctttcttgtagatgagactctaaaatgtgacatttcactgttacctgaaagagcaatattacagattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatctgtcagccactgtaggaacttgcaagagttgaatgtctctgactgcccaacattcacagatgaatcaatgagacacatttctgagggctgcccgggggtcctgtgtctcaatctgtctaacacaactatcaccaacaggacgatgcgactcctgccgaggcacttccacaacttacagaatcttagtttggcttattgcagacggttcacagacaaaggcttacagtacctgaacttggggaatggatgccacaagctcatctatctggacctctctggctgcacccagatttcagtccaaggcttcaggtacattgcaaacagctgcactggaattatgcatcttaccattaatgacatgccaactctgacggacaactgtgtaaaagctttagttgaaaaatgctctcgtattacatcgctggttttcactggtgcaccgcatatctccgattgtactttcagagctctttctgcttgtaaactcagaaagatccgatttgaaggaaataaaagggttactgatgcatccttcaaatttatagacaagaattatccaaatctcagtcacatttatatggctgactgcaagggaataacagacagcagcctcagatccctttcacctttgaagcaactgactgtgttgaatttggcaaattgtgtaagaattggtgatatgggactaaagcaatttcttgatggtcctgcaagcatgaggataagagagctaaatttaagcaactgtgtgcggctaagtgatgcctctgttatgaaactatctgagcgctgccctaatttaaactacttgagtttacgaaattgtgaacatttgactgcccaaggaattggatatattgtaaacatcttttccttggtatcaatagatctctctggaacagacatctctaatgagggtttgaatgtgctttccagacataaaaaattgaaggaactttctgtatctgaatgttatagaatcactgatgatggaattcagattactgactcagcaatggagatgttatcggcaaaatgccattacctgcacattttggatatctctggttgtgtcttgcttactgaccaaatccttgaggaccttcagataggctgcaaacaactccggatccttaagatgcaatactgcacaaatatttccaagaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatacagcagtgaagaccaagcagcgtgaccttcagcctcaagcaggaagaacaaaaaatcaagaacttggcaagttttctccatttgttgcaagt

SEQ ID NO: 3802 - DNA, 1605 bp, Homo sapiens
aaggagaactacattcctcaggtctgcgaggcactgttatgtggtatacttgttacatgtcctgaggatccgctgaggtatttagagggaatgatcatggttataatcaaaagtggtcttcagaatcttctttgatgactccggaattgatgataaaagcctgtagcttttatactggacatttagtaaagactcatttttgcacttggagagacatagctcgtacaaatgaaaatgtcgtcctggctgaaaaaatgaacagagcagtgacatgctacaatttcagacttcaaaaatctgtatttcatcactggcactcttatatggaagaccagaaagaaaaacttaaaaatattctattgcggatacaacagatcatctattgtcacaagctaaccattatcctaacaaaatggcggaatacagcaagacataagagtaaaaagaaagaagatgagctgatattaaaacatgaacttcaattgaaaaaatggaaaaataggttaatactcaaaagagctgctgcagaagaatccaattttcctgaacgaagttcttctgaagtctttcttgtagatgagactctaaaatgtgacatttcactgttacctgaaagagcaatattacagattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatctgtcagccactgtaggaacttgcaagagttgaatgtctctgactgcccaacattcacagatgaatcaatgagacacatttctgagggctgcccgggggtcctgtgtctcaatctgtctaacacaactatcaccaacaggacgatgcgactcctgccgaggcacttccacaacttacagaatcttagtttggcttattgcagacggttcacagacaaaggcttacagtacctgaacttggggaatggatgccacaagctcatctatctggacctctctggctgcacccagattactgactcagcaatggagatgttatcggcaaaatgccattacctgcacattttggatatctctggttgtgtcttgcttactgaccaaatccttgaggaccttcagataggctgcaaacaactccggatccttaagatgcaatactgcacaaatatttccaagaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatacagcagtgaagaccaagcagcgtgaccttcagcctcaagcaggaagaacaaaaaatcaagaacttggcaagttttctccatttgttgcaagtatgtttactagctgaatctcaataacaatgtaaacaagcaac

SEQ ID NO: 3803 - DNA, 3400 bp, Homo sapiens
aggggaggaggaggcgcccgcctggttccctgcaaagcggccttatttatctgggcacagcctcagcctccccggtgggaggcttggggcggccgatcctctcccaccggggagctcctttccgtgcgctccccatgacgggaggtcgcccggcggacagcgtggcatgagccaggagcccgggccgagagcgtgccaggaagatgtcgagcccgggcatcgacggcgaccccaagcctccatgcttgcctcgaaacggtctggtgaagctgccgggccagcccaacggcctgggtgcggccagcatcaccaagggcacgccagccaccaagaaccgcccctgccagccaccacccccacccaccctcccaccacccagcctggctgctccactgtcccgggctgccctggctgggggcccgtgcaccccggcaggtggaccagcctcagccttggcacctgggcacccagcggagcggccgccgctggccacggacgagaagatcctcaatgggctcttctggtatttctcggcctgcgagaagtgtgtgctggcccaggtgtgcaaggcctggcggcgcgtgctgtaccagcccaagttctgggcaggcctcacgccggtgctgcatgccaaggagctctacaacgtgctgcctggtggcgagaaggagttcgtgaacctgcagggttttgccgccagaggcttcgagggcttctgcctggttggcgtctccgacctggacatctgtgagttcattgacaactatgcgctctccaagaagggtgtcaaagccatgagcctcaagcgctccaccatcacggacgcaggcctcgaggttatgcttgaacagatgcagggcgtggtgcgtctggagctgtcgggctgcaacgacttcaccgaggccgggctgtggtccagcctgagcgcgcgcatcacctcgctgagcgtgagtgactgcatcaacgtggccgacgacgccatcgcggccatctcgcagctgctgcccaacctggcggagctgagcctgcaggcctaccacgtgacggacacggcgctggcctacttcacggcgcgccagggccacagcacgcacacgctgcgcctgctctcctgctgggagatcaccaaccacggcgtggtcaacgtggtgcacagcctgcccaacctcaccgcgctcagcctctcgggctgctccaaggtcaccgacgacggcgtggagctcgtggccgagaacctgcgcaagctgcgcagccttgacctctcgtggtgcccacgcatcaccgacatggcgctggagtacgtggcctgcgacctgcaccgcctagaggagctcgtgctcgacaggtgtgtacgcatcacggacactggcctcagctatctgtccaccatgtcgtccctccgcagcctctacctgcgatggtgctgccaggtgcaagacttcgggctgaagcacctcctggccctggggagtttgcgcctcctgtctctggcaggctgcccgctgctcaccaccaccgggctgtcgggcctggtgcagctgcaggagctggaggagctggagctgaccaactgccccggggccacccccgagctcttcaagtatttctcgcagcacctgccccgctgcctcgtcattgagtagcgcgaggcccccgccccggtcgcgggaacccggccatgacctgggcgggggcgcggggcgccgccgagccccctcttcccgccttgcgctcgggggagcccccgcgcccccggcccagcgcgggaggcggggcgagccgagggaaagcccctccccgaccttcggtccctccgccctcccagccccgccccgggcaggggggcggcgggtgggcccgccccacgcacgcacgcacactcggggactttgtgcatgcccctcgtgcccgcactgcacgccgccctccgccacgccacagccacagccgccgccatcactcgctcgccctcccgcttggggggcggggctcggtccttgggggggctttgagctctccagactgtgcccttaccgccttccccgccacacccgctctgtcttcccactgtcccccccatcccgggcagggcccagtgggattgagggggctgggtcccccaggacacgggcccagaagagccccacgggcttcctgcatcttccaccgcaccatacctggagccctccgaggggtgtcaggggaaacaggccaccgccaaagccatggcccgccgccgagagcccaggccccacccgcacctcctcacccatccagcctgacccacgcggcctctcctcctccttgccgctgtgtggggcagtcccctgtccgccccaaaacccggccttggtccctggccaggctgagagaattgggcagggagagggcggaagggctggcgatcgcttggagtcattaacgtgatcccagctgactccggtcggcctcaacccaggggtggcgcaggcaccttgcaagcctcgagctgtagccaccctcaggcctgggaagaggcctgggccgacctcacacctcagcccttgcacccggccgggctcagttcaggcctgggcaccgagcttcaccctgggtgggtctcctcaggtggagtctgcagagtggacccagccaagggtcagggtcagcactgggtcagcgactccaatcttccagtggccagcacaccctagacaccccgaggagggagggctcctttctagcctgcccccccacccccacttcacccctccccagcttcccaaacttctgtctgcccaaatgggctctgaccgtgctctgtcggcccgagacatttggaagtcctgggggatgctggcaaatctcagctgttgctgaggagggggctgggaccccttcccatcccaaccttgagccccaggagataccgcgcccacacccaatcttgggacactccctatctggttggaagagagtaaccagtttccagagagccagagagtgagagagagaaagagagtgagagagagagagaaagagagagagagatgctgttgaatcagaaacagatcaacagcccaaagattttcctgtccctggagtgccagccccaggaagctccagggctgagtggtcaggagccagtttctccagcccctcctccccacaacccctagtggggaggggcagctgtccatttgcccaaagtattaatgcaactgaagctgtgatatttccaacgactgtaggaggaaaaattaaggggagagaggaaaacaaaaccaaccaacccctaaaatcattttcttattgtacataacgacctcattctcctgtatatgcggaagatataaccttatatttggtaagtgtttcttgtgctattttatcacgtgacctgtttataaaaatatatatt

SEQ ID NO: 3804 - DNA, 3547 bp, Homo sapiens
cggaggagcgcggggagggcgaggggaggaggaggcgcccgcctggttccctgcaaagcggccttatttatctgggcacagcctcagcctccccggtgggaggcttggggcggccgatcctctcccaccggggagctcctttccgtgcgctgccgagggggcccggccaggacgggacgcggggcgcagggcgcggccgggccctgccggccagtccagcaccccggcggcccccgcgcgccgacgcccatgccgggctccccatgacgggaggtcgcccggcggacagcgtggcatgagccaggagcccgggccgagagcgtgccaggaagatgtcgagcccgggcatcgacggcgaccccaagcctccatgcttgcctcgaaacggtctggtgaagctgccgggccagcccaacggcctgggtgcggccagcatcaccaagggcacgccagccaccaagaaccgcccctgccagccaccacccccacccaccctcccaccacccagcctggctgctccactgtcccgggctgccctggctgggggcccgtgcaccccggcaggtggaccagcctcagccttggcacctgggcacccagcggagcggccgccgctggccacggacgagaagatcctcaatgggctcttctggtatttctcggcctgcgagaagtgtgtgctggcccaggtgtgcaaggcctggcggcgcgtgctgtaccagcccaagttctgggcaggcctcacgccggtgctgcatgccaaggagctctacaacgtgctgcctggtggcgagaaggagttcgtgaacctgcagggttttgccgccagaggcttcgagggcttctgcctggttggcgtctccgacctggacatctgtgagttcattgacaactatgcgctctccaagaagggtgtcaaagccatgagcctcaagcgctccaccatcacggacgcaggcctcgaggttatgcttgaacagatgcagggcgtggtgcgtctggagctgtcgggctgcaacgacttcaccgaggccgggctgtggtccagcctgagcgcgcgcatcacctcgctgagcgtgagtgactgcatcaacgtggccgacgacgccatcgcggccatctcgcagctgctgcccaacctggcggagctgagcctgcaggcctaccacgtgacggacacggcgctggcctacttcacggcgcgccagggccacagcacgcacacgctgcgcctgctctcctgctgggagatcaccaaccacggcgtggtcaacgtggtgcacagcctgcccaacctcaccgcgctcagcctctcgggctgctccaaggtcaccgacgacggcgtggagctcgtggccgagaacctgcgcaagctgcgcagccttgacctctcgtggtgcccacgcatcaccgacatggcgctggagtacgtggcctgcgacctgcaccgcctagaggagctcgtgctcgacaggtgtgtacgcatcacggacactggcctcagctatctgtccaccatgtcgtccctccgcagcctctacctgcgatggtgctgccaggtgcaagacttcgggctgaagcacctcctggccctggggagtttgcgcctcctgtctctggcaggctgcccgctgctcaccaccaccgggctgtcgggcctggtgcagctgcaggagctggaggagctggagctgaccaactgccccggggccacccccgagctcttcaagtatttctcgcagcacctgccccgctgcctcgtcattgagtagcgcgaggcccccgccccggtcgcgggaacccggccatgacctgggcgggggcgcggggcgccgccgagccccctcttcccgccttgcgctcgggggagcccccgcgcccccggcccagcgcgggaggcggggcgagccgagggaaagcccctccccgaccttcggtccctccgccctcccagccccgccccgggcaggggggcggcgggtgggcccgccccacgcacgcacgcacactcggggactttgtgcatgcccctcgtgcccgcactgcacgccgccctccgccacgccacagccacagccgccgccatcactcgctcgccctcccgcttggggggcggggctcggtccttgggggggctttgagctctccagactgtgcccttaccgccttccccgccacacccgctctgtcttcccactgtcccccccatcccgggcagggcccagtgggattgagggggctgggtcccccaggacacgggcccagaagagccccacgggcttcctgcatcttccaccgcaccatacctggagccctccgaggggtgtcaggggaaacaggccaccgccaaagccatggcccgccgccgagagcccaggccccacccgcacctcctcacccatccagcctgacccacgcggcctctcctcctccttgccgctgtgtggggcagtcccctgtccgccccaaaacccggccttggtccctggccaggctgagagaattgggcagggagagggcggaagggctggcgatcgcttggagtcattaacgtgatcccagctgactccggtcggcctcaacccaggggtggcgcaggcaccttgcaagcctcgagctgtagccaccctcaggcctgggaagaggcctgggccgacctcacacctcagcccttgcacccggccgggctcagttcaggcctgggcaccgagcttcaccctgggtgggtctcctcaggtggagtctgcagagtggacccagccaagggtcagggtcagcactgggtcagcgactccaatcttccagtggccagcacaccctagacaccccgaggagggagggctcctttctagcctgcccccccacccccacttcacccctccccagcttcccaaacttctgtctgcccaaatgggctctgaccgtgctctgtcggcccgagacatttggaagtcctgggggatgctggcaaatctcagctgttgctgaggagggggctgggaccccttcccatcccaaccttgagccccaggagataccgcgcccacacccaatcttgggacactccctatctggttggaagagagtaaccagtttccagagagccagagagtgagagagagaaagagagtgagagagagagagaaagagagagagagatgctgttgaatcagaaacagatcaacagcccaaagattttcctgtccctggagtgccagccccaggaagctccagggctgagtggtcaggagccagtttctccagcccctcctccccacaacccctagtggggaggggcagctgtccatttgcccaaagtattaatgcaactgaagctgtgatatttccaacgactgtaggaggaaaaattaaggggagagaggaaaacaaaaccaaccaacccctaaaatcattttcttattgtacataacgacctcattctcctgtatatgcggaagatataaccttatatttggtaagtgtttcttgtgctattttatcacgtgacctgtttataaaaatatatattaaaaaagttgtaaaaaca

SEQ ID NO: 3805 - DNA, 2076 bp, Homo sapiens
gtcgctgactccgcgccgcgcgccgaccgcgcgcccgcccagccggccatgcacgcagtgccgcgcggctttggcaagaaagtgcgtgtgggcgtgcagtcctgtcccccccttctcgggccaggcgtgcccccagccctcctccgtgttctggtctctgctgaagaacctgcccttcctggaacacctcgagctgattgggtccaacttctcctccgccatgccccgcaacgagcccgccatccgcaactcgctcccaccctgcagccgcgcacagagtgtcggggactcggaggtggccgccatcggccagctggccttcctgcggcacctgacgctcgcacagctgcccagcgtccttacgggctccgggctggtcaatatcggcctgcagtgccagcagttgcggtccctgtcgctggccaacctgggcatgatggggaaggtggtgtacatgcccgcgctctcagacatgttgaagcactgcaagcggctgagggacctcaggctggagcagccctacttcagcgccaacgcccagttcttccaggcgctgagccagtgcccctcgctgcagcgcctgtgcctggtctctcgcagcggcaccctccagcccgatgccgtgctggccttcatggctcgctgcctgcaggttgtcatgtgccacctgttcaccggggagtccctcgccacctgcaagagcctgcagcagtcgcttctccgcagcttccaggccgagcggcccgcgttaaacgtcgtcatcttccctctgctccacgagggcctgaccgacgtcatccgggacgtccccctggtgcacctggatgagatcaccttatttaagagcagagtggccgaggaaccgccgaacctgtggtggtgagaggcggagccgccgcccatcggtctcagtcacctcgagaagctgcaggagcctgggacgccagggacccttggtttgtcacaagaggaagggggcctctctcccggccagccacgccccacctggctcctggggctcccggcgtctccacggctctctcatggggactgttgctctgtgaagtttaggtcgaggggatgcgttctgggtgacatgagggggctcgggggacggtcgatgtggggggctggctgaaccaggctgacccttggggcctggctggggggtttgtatactgagccgcaatccctgggggccctgtccacgggcctggagggcccgaaccccctgccacttccgaccgggaagcgtgtcccttggctgttgtgtttgtggtcacctgccaccggggccccgtggatgggcggccacatgctgtccccctgaagtccagtcggccgggctggtcaccgtgtatctgagtgtccccttgcatggtcaagtgtgacatggggaagggcctgccagtttagtggctgcagacttgggactctccatcccattaggacacacttgagcccactcatgtctctggggcttttctagccagatgatgcctgtggccccagagaggtcccctgaggttgggactgctggttggagcctctcctgtgacttttcagcccaaccagcagggcccgtttctaacgagagaggcctcctccccctcccacccaccccacggccttcagcttccctgggaaggtccatgcgcgttcctggggaaatcgatacacattcggctttgttagaataacgcgaaacattaaaacccagaaaggattcttaaggctggagtagcaatcacatgaccccatttcaaatgacttcatttaagactttaaaaatactcagctgggcgcgatggctcacgcctgtaatcccggcactttgggaggctgaggtgggtggatcacgaggtcaggagttcaagaccagcctggccaacatggtgaaaccccatctctactaaaaatacaaaaattagctgggcgtggtggcgggcgcctgtaatcctagctactcaggaggctgaggcaggagaatcgtttgaacctgggaggcggaggttgcagtgagccgagatcacaccattgcactccagcctggacaacagggtgagactccgcctc

SEQ ID NO: 3806 - DNA, 2495 bp, Homo sapiens
ttcgagcatccctagccgggcaggtgggaggcacggggttgcggatcccgcggccgcggttcggacccgccggcgacatggccagctccggagaggacatatccaatgatgatgatgacatgcaccctgcagcagccgggatggcagacggggtccacctcctagggttctctgatgagatcctccttcacatcctgagtcacgtccccagcacagatctgattctgaacgtccggcgtacctgtcggaagcttgcagccctgtgccttgacaagagcctcatccacaccgtgttgctgcaaaaggactatcaggcgagcgaggacaaagtgaggcagctggtgaaggagatcggccgggagatccagcagctgagcatggctggctgctactggctgcctggctccaccgtggaacacgtggcccgctgccgcagcctggtgaaggtgaacctctcgggctgccacctcacttccctgcgcctctccaagatgctctcggccctgcagcacctgcgctcgctggccatcgacgtgagccccggcttcgacgccagccagctgagcagcgagtgcaaggccaccctgagccgcgtgcgggagctcaagcagacgctgttcactccctcctacggcgtggtgccctgctgcaccagcctagagaagctgctgctctacttcgagattctggaccgcacgcgcgagggcgccatcctctcgggccagcttatggtgggccagagcaacgtgccgcactaccagaacctgcgggtcttctatgcgcgcctggcccccggctacatcaaccaggaggtggtgcggctctacctggctgtgcttagcgaccgcactcctcagaacctccacgccttcctcatctccgtccctggcagcttcgcggagagcggcgccaccaagaacctcctggactccatggcgcgcaatgtcgtgctggatgccctgcagctgcccaagtcctggctgaacggctcttccctcctgcagcacatgaaattcaacaacccgttctacttcagtttcagccgctgtaccctgtcaggcggccatctgatccagcaggtcatcaacggcgggaaggacctgcggagcctggccagcttgaacctcagcggctgcgtccactgcctgtccccagactcgctgctccgcaaggcggaggacgacatcgacagcagcatcctggagactctggtggcgtcctgctgcaacctgcgccacctgaacctctcggccgcccaccaccacagctcggagggcctgggccgccacctctgccagctcctggcccggctgcgtcacctgcgctccctctccctgcctgtctgctctgtcgctgactccgcgccgcgcgccgaccgcgcgcccgcccagccggccatgcacgcagtgccgcgcggctttggcaagaaagtgcgtgtgggcgtgcagtcctgtcccagccccttctcgggccaggcgtgcccccagccctcctccgtgttctggtctctgctgaagaacctgcccttcctggaacacctcgagctgattgggtccaacttctcctccgccatgccccgcaacgagcccgccatccgcaactcgctcccaccctgcagccgcgcacagagtgtcggggactcggaggtggccgccatcggccagctggccttcctgcggcacctgacgctcgcacagctgcccagcgtccttacgggctccgggctggtcaatatcggcctgcagtgccagcagttgcggtccctgtcgctggccaacctgggcatgatggggaaggtggtgtacatgcccgcgctctcagacatgttgaagcactgcaagcggctgagggacctcaggctggagcagccctacttcagcgccaacgcccagttcttccaggcgctgagccagtgcccctcgctgcagcgcctgtgcctggtctctcgcagcggcaccctccagcccgatgccgtgctggccttcatggctcgctgcctgcaggttgtcatgtgccacctgttcaccggggagtccctcgccacctgcaagagcctgcagcagtcgcttctccgcaggtggggagaggtgacaggaaggaggccccagctgttcacagagttgcgagaagagccatcagccaggacgtctcgagccactgggcgccgacaaccctgcttgccagactctggggtagtctgttgtccttgcggtcggccgctggctgtctcaggaataatcctggttggggtttccccctctctggttgtaaaaacaacttgtgtttatagagtactttttaaaaatttagactatgcatcaatcttttttcttgtttgtttgtttgagacagagtctcactctgtcgtccaggctggagtgcagtggcgggatctcagctcactgcaacctctgctttctgggttgcaacctcagcctcctgagcagctggagaatgaactggagatagggttctcatattgttttgtaatctga

SEQ ID NO: 3807 - DNA, 3498 bp, Homo sapiens
gagcccgctccttgccggggtctcggttgagcggtggacgcgccggcttcgagcatccctagccgggcaggtgggaggcacggggttgcggatcccgcggccgcggttcggacccgccggcgacatggccagctccggagaggacatatccaatgatgatgatgacatgcaccctgcagcagccgggatggcagacggggtccacctcctagggttctctgatgagatcctccttcacatcctgagtcacgtccccagcacagatctgattctgaacgtccggcgtacctgtcggaagcttgcagccctgtgccttgacaagagcctcatccacaccgtgttgctgcaaaaggactatcaggcgagcgaggacaaagtgaggcagctggtgaaggagatcggccgggagatccagcagctgagcatggctggctgctactggctgcctggctccaccgtggaacacgtggcccgctgccgcagcctggtgaaggtgaacctctcgggctgccacctcacttccctgcgcctctccaagatgctctcggccctgcagcacctgcgctcgctggccatcgacgtgagccccggcttcgacgccagccagctgagcagcgagtgcaaggccaccctgagccgcgtgcgggagctcaagcagacgctgttcactccctcctacggcgtggtgccctgctgcaccagcctagagaagctgctgctctacttcgagattctggaccgcacgcgcgagggcgccatcctctcgggccagcttatggtgggccagagcaacgtgccgcactaccagaacctgcgggtcttctatgcgcgcctggcccccggctacatcaaccaggaggtggtgcggctctacctggctgtgcttagcgaccgcactcctcagaacctccacgccttcctcatctccgtccctggcagcttcgcggagagcggcgccaccaagaacctcctggactccatggcgcgcaatgtcgtgctggatgccctgcagctgcccaagtcctggctgaacggctcttccctcctgcagcacatgaaattcaacaacccgttctacttcagtttcagccgctgtaccctgtcaggcggccatctgatccagcaggtcatcaacggcgggaaggacctgcggagcctggccagcttgaacctcagcggctgcgtccactgcctgtccccagactcgctgctccgcaaggcggaggacgacatcgacagcagcatcctggagactctggtggcgtcctgctgcaacctgcgccacctgaacctctcggccgcccaccaccacagctcggagggcctgggccgccacctctgccagctcctggcccggctgcgtcacctgcgctccctctccctgcctgtctgctctgtcgctgactccgcgccgcgcgccgaccgcgcgcccgcccagccggccatgcacgcagtgccgcgcggctttggcaagaaagtgcgtgtgggcgtgcagtcctgtcccagccccttctcgggccaggcgtgcccccagccctcctccgtgttctggtctctgctgaagaacctgcccttcctggaacacctcgagctgattgggtccaacttctcctccgccatgccccgcaacgagcccgccatccgcaactcgctcccaccctgcagccgcgcacagagtgtcggggactcggaggtggccgccatcggccagctggccttcctgcggcacctgacgctcgcacagctgcccagcgtccttacgggctccgggctggtcaatatcggcctgcagtgccagcagttgcggtccctgtcgctggccaacctgggcatgatggggaaggtggtgtacatgcccgcgctctcagacatgttgaagcactgcaagcggctgagggacctcaggctggagcagccctacttcagcgccaacgcccagttcttccaggcgctgagccagtgcccctcgctgcagcgcctgtgcctggtctctcgcagcggcaccctccagcccgatgccgtgctggccttcatggctcgctgcctgcaggttgtcatgtgccacctgttcaccggggagtccctcgccacctgcaagagcctgcagcagtcgcttctccgcagcttccaggccgagcggcccgcgttaaacgtcgtcatcttccctctgctccacgagggcctgaccgacgtcatccgggacgtccccctggtgcacctggatgagatcaccttatttaagagcagagtggccgaggaaccgccgaacctgtggtggtgagaggcggagccgccgcccatcggtctcagtcacctcgagaagctgcaggagcctgggacgccagggacccttggtttgtcacaagaggaagggggcctctctcccggccagccacgccccacctggctcctggggctcccggcgtctccacggctctctcatggggactgttgctctgtgaagtttaggtcgaggggatgcgttctgggtgacatgagggggctcgggggacggtcgatgtggggggctggctgaaccaggctgacccttggggcctggctggggggtttgtatactgagccgcaatccctgggggccctgtccacgggcctggagggcccgaaccccctgccacttccgaccgggaagcgtgtcccttggctgttgtgtttgtggtcacctgccaccggggccccgtggatgggcggccacatgctgtccccctgaagtccagtcggccgggctggtcaccgtgtatctgagtgtccccttgcatggtcaagtgtgacatggggaagggcctgccagtttagtggctgcagacttgggactctccatcccattaggacacacttgagcccactcatgtctctggggcttttctagccagatgatgcctgtggccccagagaggtcccctgaggttgggactgctggttggagcctctcctgtgacttttcagcccaaccagcagggcccgtttctaacgagagaggcctcctccccctcccacccaccccacggccttcagcttccctgggaaggtccatgcgcgttcctggggaaatcgatacacattcggctttgttagaataacgcgaaacattaaaacccagaaaggattcttaaggctggagtagcaatcacatgaccccatttcaaatgacttcatttaagactttaaaaatactcagctgggcgcgatggctcacgcctgtaatcccggcactttgggaggctgaggtgggtggatcacgaggtcaggagttcaagaccagcctggccaacatggtgaaaccccatctctactaaaaatacaaaaattagctgggcgtggtggcgggcgcctgtaatcctagctactcaggaggctgaggcaggagaatcgtttgaacctgggaggcggaggttgcagtgagccgagatcacaccattgcactccagcctggacaacagggtgagactccgcctcaaaaaaaaaaaaaaaaaaaaaaaa

SEQ ID NO: 3808 - DNA, 2968 bp, Homo sapiens
gctccttgccggggtctcggttgagcggtggacgcgccggcttcgagcatccctagccgggcaggtgggaggcacggggttgcggatcccgcggccgcggttcggacccgccggcgacatggccagctccggagaggacatatccaatgatgatgatgacatgcaccctgcagcagccgggatggcagacggggtccacctcctagggttctctgatgagatcctccttcacatcctgagtcacgtccccagcacagatctgattctgaacgtccggcgtacctgtcggaagcttgcagccctgtgccttgacaagagcctcatccacaccgtgttgctgcaaaaggactatcaggcgagcgaggacaaagtgaggcagctggtgaaggagatcggccgggagatccagcagctgagcatggctggctgctactggctgcctggctccaccgtggaacacgtggcccgctgccgcagcctggtgaaggtgaacctctcgggctgccacctcacttccctgcgcctctccaagatgctctcggccctgcagcacctgcgctcgctggccatcgacgtgagccccggcttcgacgccagccagctgagcagcgagtgcaaggccaccctgagccgcgtgcgggagctcaagcagacgctgttcactccctcctacggcgtggtgccctgctgcaccagcctagagaagctgctgctctacttcgagattctggaccgcacgcgcgagggcgccatcctctcgggccagcttatggtgggccagagcaacgtgccgcactaccagaacctgcgggtcttctatgcgcgcctggcccccggctacatcaaccaggaggtggtgcggctctacctggctgtgcttagcgaccgcactcctcagaacctccacgccttcctcatctccgtccctggcagcttcgcggagagcggcgccaccaagaacctcctggactccatggcgcgcaatgtcgtgctggatgccctgcagctgcccaagtcctggctgaacggctcttccctcctgcagcacatgaaattcaacaacccgttctacttcagtttcagccgctgtaccctgtcaggcggccatctgatccagcaggtcatcaacggcgggaaggacctgcggagcctggccagcttgaacctcagcggctgcgtccactgcctgtccccagactcgctgctccgcaaggcggaggacgacatcgacagcagcatcctggagactctggtggcgtcctgctgcaacctgcgccacctgaacctctcggccgcccaccaccacagctcggagggcctgggccgccacctctgccagctcctggcccggctgcgtcacctgcgctccctctccctgcctgtctgctctgtcgctgactccgcgccgcgcgccgaccgcgcgcccgcccagccggccatgcacgcagtgccgcgcggctttggcaagaaagtgcgtgtgggcgtgcagtcctgtcccagccccttctcgggccaggcgtgcccccagccctcctccgtgttctggtctctgctgaagaacctgcccttcctggaacacctcgagctgattgggtccaacttctcctccgccatgccccgcaacgagcccgccatccgcaactcgctcccaccctgcagccgcgcacagagtgtcggggactcggaggtggccgccatcggccagctggccttcctgcggcacctgacgctcgcacagctgcccagcgtccttacgggctccgggctggtcaatatcggcctgcagtgccagcagttgcggtccctgtcgctggccaacctgggcatgatggggaaggtggtgtacatgcccgcgctctcagacatgttgaagcactgcaagcggctgagggacctcaggctggagcagccctacttcagcgccaacgcccagttcttccaggcgctgagccagtgcccctcgctgcagcgcctgtgcctggtctctcgcagcggcaccctccagcccgatgccgtgctggccttcatggctcgctgcctgcaggttgtcatgtgccacctgttcaccggggagtccctcgccacctgcaagagcctgcagcagtcgcttctccgcaggtggggagaggtgacaggaaggaggccccagctgttcacagagttgcgagaagagccatcagccaggacgtctcgagccactgggcgccgacaaccctgcttgccagactctggggtagtctgttgtccttgcggtcggccgctggctgtctcaggaataatcctggttggggtttccccctctctggttgtaaaaacaacttgtgtttatagagtactttttaaaaatttagactatgcatcaatcttttttcttgtttgtttgtttgagacagagtctcactctgtcgtccaggctggagtgcagtggcgggatctcagctcactgcaacctctgctttctgggttgcaacctcagcctcctgagcagctgggattacaagtgtgcaccactatacctggctaatttttgtatttttctttttttcttttttgagacagagtctcgctctgtcgcccaggctggagtgcagtggcgtgatctcggctcgctgcaagctctgcctcccgggttcacgacattctcctgcctcaacctcccaagtagctgggactacaggcgcccgccaccacacctggctaattttttgtattttttttttttttagtagagacggggtttcactgtgttggccaggatggtctcgatctcctgacctcatgatctgcccacctcggcctcccaaagtgctgggattacaggcgtgagccaccgcgcccggcctaatttttgtatttttagtagagacggggtttcatcatgttgcccaggctggtctctaactcctgacctcaggtgatccgcttacctcagcctcccaaagtgctgggattacaggcgtgagccaca

SEQ ID NO: 3809 - DNA, 1526 bp, Homo sapiens
ggaggcaggtcagccgtcccccggctgcagctgcactcacatgtggccactgctcaccatgcacataacccagctcaaccgggagtgcctgctgcacctcttctccttcctagacaaggacagcaggaagagccttgccaggacctgctcccagctccacgacgtgtttgaggaccccgcactctggtccctgctgcacttccgttccctcactgaactccagaaggacaacttcctcctgggcccggcactccgcagcctctccatctgctggcactccagccgcgtgcaggtgtgcagcattgaggactggctcaagagtgccttccagagaagcatctgcagccggcacgagagcctggtcaatgatttcctcctccgggtgtgcgacaggctttctgctgtgcgctccccacggaggcgggaggcgcctgcaccgtcctcggggactccgatcgccgttggaccgaaatcacctcggtggggaggacctgaccactcggagttcgccgacttgcgctcgggggtgacgggggccagggctgccgcgcgcaggggtctggggagcctccgggcggagcgacccagcgagaccccgccggctcccggagtgtcctggggaccgccacctccaggagccccggtggtgatctcggtgaagcaggaggaggggaagcaggggcgcacgggcagaaggagccaccgagccgctcctccttgcggttttgcccgcacgcgcgtctgcccgcccacctttcctggggcggatgcgttcccgcagtgaccgcactcgcgattgtagaaaattcgctcccaattgttgaatgcttacataaactgcatagttacccatattttctactgttctcataagggaaaaagaaatgatttggaagaaaaaaaaagcctcaaactaaacaaaaacaaaaccagcagccctggctaagcttttgataatggaaccattataagctgacaagctagatttttcacctgttggatttgctggacatgagcacaagcctaggcttccaatttgaatttcagggctgtagtcactgatgtgtcacatttagtgaaggctctcggccccccggcagccgcctggtcctgggtcactggggagaattctgggtgggtggaagaggcgaggagcactgtgatgggcgctgttcacactccggctccacccagcgccagctgcgacaaagccctttacccctcccaggccaggtgtttcttctgtgtgaaagaggagcttgatccctactcacaggttccttaattcattgctcaaatagggaaacggcaaggaaaaagacaaattctgttctcatgaagcttaccttctagtgggggaagagacaacaggtaactggtatataagagggtagaagggccaggtgcggtggctcaatgcctgtaatcccagcactttaggaggccaagatgggcgattcacgaggtcaggagatcgagaccatcctggctaacaaggtgaaacccccgtctgtactaaaaaaaaa

SEQ ID NO: 3810 - DNA, 1785 bp, Homo sapiens
ggttgtcggtctataagcctcgcccgttccgctccctggggcttccccgagcgccgtcggtggtcatggctgccccagcctcccggcaggtccgacgcagagcccgggcagcgccgcggccccgctcggccgaggactggtggtgggaccggctggcgccgaggggctcggggtaccacctgctgcagtccgacagcatgctgctggtgctgtccgaacccggccccgcccggccccgcgcacagcggcgcgcttcccgccgcactccccggcagccgccccggggccccagcgccgcggccaagcccaaggccgggctcaggtccgaggcggcggccgcgcccgcacccgcaccggcacccacgcccacgcccgaggaagggcccgacgcgggctggggagaccgcattcccttggaaatcctggtgcagattttcgggttgttggtggcggcggacggccccatgcccttcctgggcagggctgcgcgcgtgtgccgccgctggcaggaggccgcttcccaacccgcgctctggcacaccgtgaccctgtcgtccccgctggtcggccggcctgccaagggcggggtcaaggcggagaagaagctccttgcttccctggagtggcttatgcccaatcggttttcacagctccagaggctgaccctcatccactggaagtctcaggtacaccccgtgttgaagctggtaggtgagtgctgtcctcggctcactttcctcaagctctccggctgccacggtgtgactgctgacgctctggtcatgctagccaaagcctgctgccagctccatagcctggacctacagcactccatggtggagtccacagctgtggtgagcttcttggaggaggcagggtcccgaatgcgcaagttgtggctgacctacagctcccagacgacagccatcctgggcgcactgctgggcagctgctgcccccagctccaggtcctggaggtgagcaccggcatcaaccgtaatagcattccccttcagctgcctgtcgaggctctgcagaaaggctgccctcagctccaggtgctgcggctgttgaacctgatgtggctgcccaagcctccgggacgaggggtggctcccggaccaggcttccctagcctagaggagctctgcctggcgagctcaacctgcaactttgtgagcaacgaggtcctgggccgcctactccacggctctcccaacctgcgcttactggatcttcgtggctgtgcgcgcatcacgccggctggccttcaggatctgccatgtcgggagctggagcagcttcatctgggcctgtatggcacgtcagaccggctgactctagccaaggagggcagcccctttttgacccagaagtggtgccatacactgcgagaactggacttgagtggccaggggttcagtgagaaggacctggagcaggccctggctgccttcttaagcacccctgggggctcacacccagccctgtgctctcttaacctcaggggcacccgggtcacaccaagcactgtcagctctgtgatcagcagctgcccgggcctgctctacctcaacctggagtcctgccgctgccttccccggggtctgaagcgggcctaccggggcctggaggaagtccagtggtgtctggagcagctgctcaccagcccctcacccagctaggcagccacagacctgggacacctcagccagcttgcccaccctccacctttgcccaatttcagatatttgagcattttgttaaaataaaacatttttagga

SEQ ID NO: 3811 - DNA, 1727 bp, Homo sapiens
gcttccccgagcgccgtcggtggtcatggctgccccagcctcccggcaggtccgacgcagagcccgggcagcgccgcggccccgctcggccgaggactggtggtgggaccggctggcgccgaggggctcggggtaccacctgctgcagtccgacagcatgctgctggtgctgtccgaacccggccccgcccggccccgcgcacagcggcgcgcttcccgccgcactccccggcagccgccccggggccccagcgccgcggccaagcccaaggccgggctcaggtccgaggcggcggccgcgcccgcacccgcaccggcacccacgcccacgcccgaggaagggcccgacgcgggctggggagaccgcattcccttggaaatcctggtgcagattttcgggttgttggtggcggcggacggccccatgcccttcctgggcagggctgcgcgcgtgtgccgccgctggcaggaggccgcttcccaacccgcgctctggcacaccgtgaccctgtcgtccccgctggtcggccggcctgccaagggcggggtcaaggcggagaagaagctccttgcttccctggagtggcttatgcccaatcggttttcacagctccagaggctgaccctcatccactggaagtctcagctggtaggtgagtgctgtcctcggctcactttcctcaagctctccggctgccacggtgtgactgctgacgctctggtcatgctagccaaagcctgctgccagctccatagcctggacctacagcactccatggtggagtccacagctgtggtgagcttcttggaggaggcagggtcccgaatgcgcaagttgtggctgacctacagctcccagacgacagccatcctgggcgcactgctgggcagctgctgcccccagctccaggtcctggaggtgagcaccggcatcaaccgtaatagcattccccttcagctgcctgtcgaggctctgcagaaaggctgccctcagctccaggtgctgcggctgttgaacctgatgtggctgcccaagcctccgggacgaggggtggctcccggaccaggcttccctagcctagaggagctctgcctggcgagctcaacctgcaactttgtgagcaacgaggtcctgggccgcctactccacggctctcccaacctgcgcttactggatcttcgtggctgtgcgcgcatcacgccggctggccttcaggatctgccatgtcgggagctggagcagcttcatctgggcctgtatggcacgtcagaccggctgactctagccaaggagggcagcccctttttgacccagaagtggtgccatacactgcgagaactggacttgagtggccaggggttcagtgagaaggacctggagcaggccctggctgccttcttaagcacccctgggggctcacacccagccctgtgctctcttaacctcaggggcacccgggtcacaccaagcactgtcagctctgtgatcagcagctgcccgggcctgctctacctcaacctggagtcctgccgctgccttccccggggtctgaagcgggcctaccggggcctggaggaagtccagtggtgtctggagcagctgctcaccagcccctcacccagctaggcagccacagacctgggacacctcagccagcttgcccaccctccacctttgcccaatttcagatatttgagcattttgttaaaataaaacatttttagga

SEQ ID NO: 3812 - DNA, 1658 bp, Homo sapiens
cctagcccgagccgccccgtccgcccgcgcgtcccgccccgcgggctcccggtggctgcttcccgtccgctgtcctctgctgccagtcccctgccccgggcaaagcccatctggtccgccgagcaggccggagctattgggagtggcggatcctcccaccccagccggatctgggccatggccgagcctggagagggactgccagaggaggtgctggcactcatcttccgccacctgtccctgagagaccgtgctgccgccgccagggtctgcagggcctgggccgccgctgctacctgcagcgccgtgtggcacgacacaaaaatcagttgcgaatgtgagctggaaggcatgctgccaccttatctgtccgcctgcctcgaccacattcacaacctacggctggaatttgagccatcgaggaagccgagccgccgggcggccatcgagctgctgatggttctggcgggccgtgccccggggctgcgaggcctgcgcctggagtgccgcggagaaaaaccgctcttcgacgcgggccgcgacgtcctggaggctgtgcacgctgtatgcggggcggccagccagctacgccacctcgacctgcggcgcttgtccttcacactggacgacgcgctggtgctgcaggcggcgcgcagctgtcccgagctccacagcctttttctggacaacagtaccctagtgggcagcgtgggtcccggctcagtgctcgagctactggaggcctgcccgcgcctgcgcgctctcggcctgcacctagccagtttgtcgcacgccatcctcgaagcactggcggcgccagaccgagcgcctttcgcgctcttggctctgcggtgcgcgtgccccgaagatgcacgcgcgtccccgctgcccaacgaagcctgggtcgcgttgcgccgccgccaccctgggctggcagtggagctggagctggagcccgcgctgcccgctgagagcgtgacgcgcgtcctgcagccagccgtccccgtggctgcgctgcgcctcaacctctcaggcgacaccgtaggcccagtgcgcttcgcagcacaccactacgccgcaaccctgtgcgcgctcgaggtgcgcgcagccgcttcggccgagctgaacgccgcgctggaggagctggcggcgcgctgcgcggccctgcgcgaggtgcattgtttctgcgtggtgagccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacgtaagcgctctgagagggaacggggggggtgtccaggcgcgccccgagtgctagtgccttcttttgggattgttgccccccgggtctttaccgagttgggaactgtgatggcatcgggaccagtcctgggcgccctgagaccactcgctgctctcaccctctgcagacgccccacccgctcggtcctggacacactgcccccctctcttgcctccacccctctgcggactctgcagctccgcggccccggcgcagggagagggagggcacgggcgcgggccgggcctcaagggtgagtgtgaaataaacaaatcctgcagtgtt

SEQ ID NO: 3813 - DNA, 586 bp, Homo sapiens
aacactttgcgccttcccgacctcagagacgtccgtctctctccaggccggagctattgggagtggcggatcctcccaccccagccggatctgggccatggccgagcctggagagggactgccagaggaggtgctggcactcatcttccgccacctgtccctgagagaccgtgctgccgccgccagggtctgcagggcctgggccgccgctgctacctgcagcgccgtgtggcacgacacaaaaatcagttgcgaatgtgagctggaaggcatgctgccaccttatctgtccgcctgcctcgaccacattcacaacctacggctggaatttgagccatcgaggaagccgagccgccgggcggccatcgagctgctgatggttctggcgggccgtgccccggggctgcgaggcctgcgcctggagtgccgcggagaaaaaccgctcttcgacgcgggccgcgacgtcctggaggctgtgcacgctgtatgcggggcggccagccagctacgccacctcgacctgcggcgcttgtccttcacactggacgacgcgctggtgctgcaggcggcgcgcagctgtcccgag

SEQ ID NO: 3814 - DNA, 1460 bp, Homo sapiens
gtcccgccccgcgggctcccggtggctgcttcccgtccgctgtcctctgctgccagtcccctgccccgggcaaagcccatctggtccgccgagcaggccggagctattgggagtggcggatcctcccaccccagccggatctgggccatggccgagcctggagagggactgccagaggaggtgctggcactcatcttccgccacctgtccctgagagaccgtgctgccgccgccagggtctgcagggcctgggccgccgctgctacctgcagcgccgtgtggcacgacacaaaaatcagttgcgaatgtgagctggaaggcatgctgccaccttatctgtccgcctgcctcgaccacattcacaacctacggctggaatttgagccatcgaggaagccgagccgccgggcggccatcgagctgctgatggttctggcgggccgtgccccggggctgcgaggcctgcgcctggagtgccgcggagaaaaaccgctcttcgacgcgggccgcgacgtcctggaggctgtgcacgctgtatgcggggcggccagccagctacgccacctcgacctgcggcgcttgtccttcacactggacgacgcgctggtgctgcaggcggcgcgcagctgtcccgagctccacagcctttttctggacaacagtaccctagtgggcagcgtgggtcccggctcagtgctcgagctactggaggcctgcccgcgcctgcgcgctctcggcctgcacctagccagtttgtcgcacgccatcctcgaagcactggcggcgccagaccgagcgcctttcgcgctcttggctctgcggtgcgcgtgccccgaagatgcacgcgcgtccccgctgcccaacgaagcctgggtcgcgttgcgccgccgccaccctgggctggcagtggagctggagctggagcccgcgctgcccgctgagagcgtgacgcgcgtcctgcagccagccgtccccgtggctgcgctgcgcctcaacctctcaggcgacaccgtaggcccagtgcgcttcgcagcacaccactacgccgcaaccctgtgcgcgctcgaggtgcgcgcagccgcttcggccgagctgaacgccgcgctggaggagctggcggcgcgctgcgcggccctgcgcgaggtgcattgtttctgcgtggtgagccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacacgccccacccgctcggtcctggacacactgcccccctctcttgcctccacccctctgcggactctgcagctccgcggccccggcgcagggagagggagggcacgggcgcgggccgggcctcaagggtgagtgtgaaataaacaaatcctgcagtg

SEQ ID NO: 3815 - DNA, 559 bp, Homo sapiens
actttctactaaccggcggggttaagatggggtttctcaggccgggcgcggtggctcatgcccgtaatcccagcactttgggaggcccaggcgggccgatcgcttgagcctaggagttcgaggccggagctattgggagtggcggatcctcccaccccagccggatctgggccatggccgagcctggagagggactgccagaggaggtgctggcactcatcttccgccacctgtccctgagagaccgtgctgccgccgccagggtctgcagggcctgggccgccgctgctacctgcagcgccgtgtggcacgacacaaaaatcagttgcgaatgtgagctggaaggcatgctgccaccttatctgtccgcctgcctcgaccacattcacaacctacggctggaatttgagccatcgaggaagccgagccgccgggcggccatcgagctgctgatggttctggcgggccgtgccccggggctgcgaggcctgcgcctggagtgccgcggagaaaaaccgctcttcgacgcgggccgcgacgtcctggaggctgtgcacgc

SEQ ID NO: 3816 - DNA, 2274 bp, Homo sapiens
ggaagcgggtccgggtcgcgcagggcgggggcggcgcagcgggcggaggcggccgtgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagca

SEQ ID NO: 3817 - DNA, 718 bp, Homo sapiens
gttgggcgggggcggcggtccgagcggctgcggcagcggaagcgggtccgggtcgcgcagggcgggggcggcgcagcgggcggaggcggccgtgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaaggcgatcactacagccgcccctgccgaacagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacg

SEQ ID NO: 3818 - DNA, 802 bp, Homo sapiens
gacagcctgtccagccccggcctccccacagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgacc

SEQ ID NO: 3819 - DNA, 839 bp, Homo sapiens
gtgcaggagccccgaggccgcccgtgcgctcgtccccgccgtccgccccgagcccgccgggcagagctgctccagggccgcagggcggaggccactgcctggccgccccgagcttcctctcggcggaagcccgtccccggacggcgcctggtgtccccgtgcctcgcgtgcggcggtccgggccctggcgggctgaggggcgcccgctgccggccgcaggaggccgggggatgacgcggcggagaggggccggcccggcccgcccggagctgccgggtccttggttgggcggcggtacccgggcgtcccctgcagacacgcagccccgtggaactcccggcgggacggttggggctggaggaacaggacgcccgctctcggcctcccttcccgggcctgggctgagggcagccgttggtgggtttcagggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcaca

SEQ ID NO: 3820 - DNA, 1803 bp, Homo sapiens
gacaagacgcgaggccggcagcgcccacccggtcgcaatggagcttcccctagggcggtgcgatgattcccgcacctgggacgatgactcggacccagagtcagagacagacccagacgcgcaggccaaggcctacgtggcccgcgttctcagtccgccaaaatccgggctggcgttctcgcgcccctcgcagctatccacacccgccgcgtccccgagcgcttcggagcctcgggccgcgtccagggtttcggccgtaagtgagccgggccttctgagccttcccccggagctgctgctcgagatctgctcctacctggacgcccgcctcgtgctccacgtcctgtcgcgggtgtgccacgcgctccgcgacctcgtgtctgaccatgtcacctggaggctacgcgcgctacgccgcgtacgcgcgccctacccagtggtggaagagaagaactttgactggccggcagcctgcattgcgctggagcagcacctgtcccgctgggcagaggatgggcgctgggtcgaatacttctgcctggccgaaggccacgtggcttccgttgactcagtgctgctgctccagggtgggtcactctgtctgtcgggctcccgagatcgcaacgtcaacttgtgggacctgcggcagctggggacggagtccaaccaggttctgatcaagaccttaggcactaagcgaaatagtacccatgagggctgggtgtggtcactggcagcgcaggaccaccgcgtgtgctccggctcctgggacagcacagtgaagctctgggacatggcagcggatgggcagcagttcggcgagataaaggccagctcagccgtgctgtgcctctcctacctgcctgacatcctggtgactggcacctatgacaagaaggtgaccatctacgaccccagagacaggatggagacccgggatgctctcatgggctggggggggccttcgaggggctctgatatccctcctcaccggcccatcacccatgaagccggcccagccctgttgaagcaccagcaactacactccagacccgtgctgaccctgctggcggatgaccggcacatcatctcaggcagcgaggaccacaccctggtggtggtggaccgccgagccaacagcgtcctgcagcgtctgcagctggactcctacctgctctgcatgtcctaccaggaaccccagctctgggctggtgacaaccagggcctgctgcacgtcttcgccaaccgcaacggctgcttccagcttatccggtcctttgatgtgggccacagctttcccatcactgggatccagtactccgtgggagccttgtacaccacatccactgacaagaccatccgggtgcacgtgcccacagacccaccaaggaccatttgcacccgaaggcatgacaatgggctcaatagggtctgtgctgagggcaacctggtggtggccggctctggagacctgtcgctagaggtctggaggctgcaggcctgagcaggtgggcgtggatgtggatactgcctgccggaggctgggcttcctcctctgttcttgggggaccatccccaatgttggtgctgcctccgccccgtgggcctagggcacaaggagtcccagccacattcgggtgagcgtcctggcctgggccctatgcccgggggaagggtgaaattggggttcaggcccacccagggggccgcttcccactcttgggccctggttttgttatgatttggatgccccgctctcagttgagagcgaaggagaaataaacctgacatgttggtgcttgg

SEQ ID NO: 3821 - DNA, 1738 bp, Homo sapiens
ggaagtgccctcgtgctgcctaggagacaagacgcgaggccggcagcgcccacccggtcgcaatggagcttcccctagggcggtgcgatgattcccgcacctgggacgatgactcggacccagagtcagagacagacccagacgcgcaggccaaggcctacgtggcccgcgttctcagtccgccaaaatccgggctggcgttctcgcgcccctcgcagctatccacacccgccgcgtccccgagcgcttcggagcctcgggccgcgtccagggtttcggccgtaagtgagccgggccttctgagccttcccccggagctgctgctcgagatctgctcctacctggacgcccgcctcgtgctccacgtcctgtcgcgggtgtgccacgcgctccgcgacctcgtgtctgaccatgtcacctggaggctacgcgcgctacgccgcgtacgcgcgccctacccagtggtggaagagaagaactttgactggccggcagcctgcattgcgctggagcagcacctgtcccgctgggcagaggatgggcgctgggtcgaatacttctgcctggccgaaggccacgtggcttccgttgactcagtgctgctgctccagggtgggtcactctgtctgtcgggctcccgagatcgcaacgtcaacttgtgggacctgcggcagctggggacggagtccaaccaggttctgatcaagaccttaggcactaagcgaaatagtacccatgagggctgggtgtggtcactggcagcgcaggaccaccgcgtgtgctccggctcctgggacagcacagtgaagctctgggacatggcagcggatgggcagcagttcggcgagataaaggccagctcagccgtgctgtgcctctcctacctgcctgacatcctggtgactggcacctatgacaagaaggtgaccatctacgaccccagagccggcccagccctgttgaagcaccagcaactacactccagacccgtgctgaccctgctggcggatgaccggcacatcatctcaggcagcgaggaccacaccctggtggtggtggaccgccgagccaacagcgtcctgcagcgtctgcagctggactcctacctgctctgcatgtcctaccaggaaccccagctctgggctggtgacaaccagggcctgctgcacgtcttcgccaaccgcaacggctgcttccagcttatccggtcctttgatgtgggccacagctttcccatcactgggatccagtactccgtgggagccttgtacaccacatccactgacaagaccatccgggtgcacgtgcccacagacccaccaaggaccatttgcacccgaaggcatgacaatgggctcaatagggtctgtgctgagggcaacctggtggtggccggctctggagacctgtcgctagaggtctggaggctgcaggcctgagcaggtgggcgtggatgtggatactgcctgccggaggctgggcttcctcctctgttcttgggggaccatccccaatgttggtgctgcctccgccccgtgggcctagggcacaaggagtcccagccacattcgggtgagcgtcctggcctgggccctatgcccgggggaagggtgaaattggggttcaggcccacccagggggccgcttcccactcttgggccctggttttgttatgatttggatgccccgctctcagttgagagcgaaggagaaataaacctgacatgttggtgcttgg

SEQ ID NO: 3822 - DNA, 1327 bp, Homo sapiens
agacaagacgcgaggccggcagcgcccacccggtcgcaatggagcttcccctagggcggtgcgatgattcccgcacctgggacgatgactcggacccagagtcagagacagacccagacgcgcaggccaaggcctacgtggcccgcgttctcagtccgccaaaatccgggctggcgttctcgcgcccctcgcagctatccacacccgccgcgtccccgagcgcttcggagcctcgggccgcgtccagggtttcggccgtaagtgagccgggccttctgagccttcccccggagctgctgctcgagatctgctcctacctggacgcccgcctcgtgctccacgtcctgtcgcgggtgtgccacgcgctccgcgacctcgtgtctgaccatgtcacctggaggctacgcgcgctacgccgcgtacgcgcgccctacccagtggtggaagggtgggtcactctgtctgtcgggctcccgagatcgcaacgtcaacttgtgggacctgcggcagctggggacggagtccaaccaggttctgatcaagaccttaggcactaagcgaaatagtacccatgagggccagctcagccgtgctgtgcctctcctacctgcctgacatcctggtgactggcacctatgacaagaaggtgaccatctacgaccccagagccggcccagccctgttgaagcaccagcaactacactccagacccgtgctgaccctgctggcggatgaccggcacatcatctcaggcagcgaggaccacaccctggtggtggtggaccgccgagccaacagcgtcctgcagcgtctgcagctggactcctacctgctctgcatgtcctaccaggaaccccagctctgggctggtgacaaccagggcctgctgcacgtcttcgccaaccgcaacggctgcttccagcttatccggtcctttgatgtgggccacagctttcccatcactgggatccagtactccgtgggagccttgtacaccacatccactgacaagaccatccgggtgcacgtgcccacagacccaccaaggaccatttgcacccgaaggcatgacaatgggctcaatagggtctgtgctgagggcaacctggtggtggccggctctggagacctgtcgctagaggtctggaggctgcaggcctgagcaggtgggcgtggatgtggatactgcctgccggaggctgggcttcctcctctgttcttgggggaccatccccaatgttggtgctgcctccgccccgtgggcctagggcacaaggagtcccagccacattcgggagttggtggcggccgggatgcccacaaggaa

SEQ ID NO: 3823 - DNA, 2731 bp, Homo sapiens
cgaattccggtggatttaaatcgcgggaggagaagctaccgcggcctaaagacctctgttgaacacagactgcagttccagccaccacagctaatctggatcatgaatgggagccaccgtggtcttggcaagtccgaaaacatagctgagtagctcgtctagaaaagagatttgtgttcagctgagttaaaagaagtatttacctcaaacctctcctcttgcacaaccaacccccgttataaaaggaagtgcaaaatggaataaactgattttaagtgaatacaagctgtctttatatacaaaagtaactcaaggatggtgatgtacccagtcatgctttcaactgatttgggaagcctacaccattcaccttaggttacatatgaggataacttaaaacattaagctatgcataaaaactccaagagaaacaataatttaagagtttctcacacagaagcgaactctgtggatgctgagaaggaaaaaaatgagagtcaaaacaacttttttgaactgctgcctgcagaaatcacttttaaaattttcagtcagctggacattcggagtctgtgcagggcttcattgacatgcaggagctggaatgacacaataagaaacagtgactctttatggaaacctcactgcatgactgtaagagctgtgtgccgaagagaaatagatgatgatctagaaagtggttattcctggagggtgatactgctgaggaattaccagaagagtaaagtgaaacacgaatggctaagtggcagatacagcaacatttgttctcccattagcctaccagaaaaaatcatgtacccaatggatgcagatacatggggggaaattctagaagcagaactggaaagataaggggaaaaaaaatcacaaatctcaggtctttgaaagtttaaaacttaaatgactcttaggttgcaaaagcgatatctttattcgttcattttgttgttcacctttttaaaagaaaatgaaatggaactattataaaagtaaagctttatttttgttttgcactttagtaaaatttttctggttttattgtaatgtggaaaaatcatgaaatgttatttttataagaaataatatactgatagagtgatttccaaatacaatgtttcatgtatttgtgttaatatatttgcaatactaaatgtaagagtgatttgtatgttcagcttaatgataattcaaaatttcaggaagccactttaaactgacttaaagattcattaagtggtggttataactaggctcatgggaagactagctaagtgaaattaatagcaatacatttaaattaatacattgacattttaatgactttaacatttctatttcagtggaatcagattgaaatgtcaaatagtgaaactatttttaatgtgttaagcctgtggtttagttttaagttaatgtcatctcagggctaaagtttgtccaattgagattcccattaattttatataaacctggaacggctctcaggagctgaaagtaagtggaaagtttccagaacactttaccatcagaatgccacactagcctggtaaaactctctttctgacagccttatagcaccatctagtgtgctattcttagatagcaagacaaaggactttcagctcctttttgttttctccatattaaaaagaaaactgttattctaaagaatccttaacacttgtctttgttaaagtttataactttttaggaacctttattttaacttttaaaaacttttgtttctcttttttcataaaaacagattatatgctactcactataacaaattgtttattctgaatctgtggttaccaccatagtaaaaaagtgtctacaaactgctttagttagtgtggggttttcttcttaaaaactgttctctatagcattaaatataagaatccaggaaaccaatatttaacaaataggcaaatattagaaagatgccccactatatgcaaattctgtatgttgaatcaagcagtagataattaattgtctcctactatcttcttagagttggaagagtccttgaaaatcaggcagtcaagtgtccaggactattcagtaattttctcaataggaacactgtcagtcagccagcccaagctgaaatcctgtacttctactaatagcatctctgttatgtcacagaacagtccagttgtagtctaggcttgcactgaagaccacctctctgtaacgtttgccttctagccccacttccaccctctagaaccaggctgattcagtccttcctgtctatgattgccagatatttgaagactgatagcctgtctcttcctatgtcttctctccaattccactgatgatcatagagtataatttctagacccaacaacattctcttctgcccatttactcttaacaaaagaaaggggctgtgcgccatggctcacgcctgtaatcccagcactttgggagaccaaggtgggtggatcacctcaggtcagaagttcaagaccagcctggtcaacatggtgaaaccctgtctctactaaatatacaaaaattagccgggcgtggtggcaggtgcctgtaatcccagctacttgggaggctgaggcaggagaatcgcttaaacctggcaggcagaggttgcagtgagcagagatcacgccactgcgctccagcctgggcaacaagagtgaaacttcgtctcaaaaaaaaaggaagaaagaaa

SEQ ID NO: 3824 - DNA, 744 bp, Homo sapiens
atgtggccactgctcaccatgcacataacccagctcaaccgggagtgcctgctgcacctcttctccttcctagacaaggacagcaggaagagccttgccaggacctgctcccagctccacgacgtgtttgaggaccccgcactctggtccctgctgcacttccgttccctcactgaactccagaaggacaacttcctcctgggcccggcactccgcagcctctccatctgctggcactccagccgcgtgcaggtgtgcagcattgaggactggctcaagagtgccttccagagaagcatctgcagccggcacgagagcctggtcaatgatttcctcctccgggtgtgcgacaggctttctgctgtgcgctccccacggaggcgggaggcgcctgcaccgtcctcggggactccgatcgccgttggaccgaaatcacctcggtggggaggacctgaccactcggagttcgccgacttgcgctcgggggtgacgggggccagggctgccgcgcgcaggggtctggggagcctccgggcggagcgacccagcgagaccccgccggctcccggagtgtcctggggaccgccacctccaggagccccggtggtgatctcggtgaagcaggaggaggggaagcaggggcgcacgggcagaaggagccaccgagccgctcctccttgcggttttgcccgcacgcgcgtctgcccgcccacctttcctggggcggatgcgttcccgcagtga

SEQ ID NO: 3825 - DNA, 457 bp, Homo sapiens
ccaattccactgatcctgtgaaggctgcccaatttgagatgagtaatcccagccatctccttttcttcctgccttgtcccttctctcctgtttcctctctttttgcctttgttaatgcaaaattaaaatggagactgggcctgaaaactcctgagcaaacaaagccacccgggccttagaaatagccttatcattgcttaaactgcaaacataagtgaaactcaagttggattgtaactaaaaataggtaatacttaacttggatcatttctggtaaatatttatgttagacagaaataagatttaaccctagccaatcgtaagcagccaactaacataattatgtgactaagaacacttcaataaggtacctcacccaaaagacaattatgtaactgcaaacctatcaaatttctttattttgcttccacattttcccaataaatacttgcctgtg

SEQ ID NO: 3826 - DNA, 4320 bp, Homo sapiens
ggcttcctccagttccggagtccagtggctgaccgccttgctggagcggagatgcagccgccgccccgaaaagtgaagccggcccaggaggtgaagcttcgcttcctggaacagctgagcatccttcagacctggcagcagagggaggcggatctgctggaggacatcagatcctacagcaagcagagggcagccattgaacgggagtatgggcaggcactccagaaactggctggcccattcctgaagagggaagggcaccggagcggtgagatggacagcaggggcaggacagtgttcggtgcctggcgctgcctgctggatgccaccgtggctgggggccaaacccgactccaggcgtctgaccgataccgtgacctagcagggggtacagggcggagcgccaaggagcaggtgcttaggaagggaacagagaacctccagagggcgcaggctgaggtgctgcagtctgtccgggagctgagccgaagtcggaagctgtatgggcagcgggaacgtgtgtgggccttggcacaggagaaggcggctgatgtccaggccaggctaaaccgaagtgaccatgggatcttccactctcggaccagtctccagaaactgagcaccaagctgtccgcccagtcagcccagtactcccagcagctgcaagcagcccgcaatgagtacctgcttaacttggtggctaccaatgcccacctcgaccattactaccaggaggaactgccagctctgctcaaggccctggtcagtgagctgtcagagcacttgagggaccccctgacctccctgagccacactgagctggaagccgcagaggtcatcctggagcatgcccaccgcggggagcagacaacctcccaggtaagctgggagcaagacctgaagctgtttcttcaggagcctggtgtattttcccccaccccacctcagcagtttcagccagcagggactgatcaggtgtgtgtcctggagtggggagcagaaggcgtggctggcaagagtggcctggagaaagaggttcagcgcttgaccagccgagctgcccgtgactacaagatccagaaccatgggcatcgggtactgcaacgactggagcagaggcggcagcaggcttcagagcgggaggctccaagcatagaacagaggttacaggaagtgcgagagagcatccgccgggcacaggtgagccaggtgaagggggctgcccggctggccctgctgcagggggctggcttagatgtggagcgctggctgaagccagccatgacccaggcccaggatgaggtggagcaggagcggcggctcagtgaggctcggctgtcccagagggacctctctccaaccgctgaggatgctgagctttctgactttgaggaatgtgaggagacgggagagctctttgaggagcctgccccccaagccctggccacgagggccctcccctgccctgcacacgtggtatttcgctatcaggcagggcgtgaggatgagctgacaatcacggagggtgagtggctggaggtcatagaggagggagatgctgacgaatgggtcaaggctcggaaccagcacggcgaggtaggctttgtccctgagcgatatctcaacttcccggacctctccctcccagagagcagccaagacagtgacaatccctgcggggcagagcccacagcattcctggcacaggccctgtacagctacaccggacagagtgcagaggagctgagcttccctgagggggcactcatccgtctgctgccccgggcccaagatggagtagatgacggcttctggaggggagaatttgggggccgtgttggggtcttcccctccctgctggtggaagagctgcttggccccccagggccacctgaactctctgaccctgaacagatgctgccgtccccttctcctcccagcttctccccacctgcacctacctctgtgttggatgggccccctgcacctgtcctgcctggggacaaagccctggacttccctgggttcctggacatgatggcacctcgactcaggccgatgcgtccaccacctcccccgccggctaaagccccggatcctggccacccagatcccctcacctgaaggccagggaagccttgacccccagtgatgctgctgtccctatcttcaagctgtcagaccacaccatcaatgatccagagcaacacagccaaaagctggaatcgcccttatttccaccctcacctccaagggtggaaacttgccccttcccatttctagagctggaacccactcctttttttcccattgttctatcatctctaggaccggaactaccttctcttctgtcatgaccctatctagggtggtgaaatgcctgaaatctctggggctggaaaccatccatcaaggtctctagtagttctggcccacctctttccccaccctggctccatgacccaccccactctggatgccagggtcactggggttgggctggggagaggaacaggccttgggaatcaggagctggagccaggatgcgaagcagctgtaatggtctgagcggatttattgacaatgaataaagggcacgaaggccaggccagggcctgggcctcttgtgctaagagggcagggggcctacggtgctattgctttaggggcccaccacgggcaggggcctgctcccagctgccacgctctatcatatggagcgaggtgttggggaaggcggggcaggcagcctgttgcaggcaggggaaggagaagagactgaggggctgtgacctctcctgaggcccccagcctgagactgtgcaactccaggtggaagtagagctggtccctcagctggggggcagtgctgtccagtggaggggagggctttcacgcccacccaccccctggccctgccagctggtagtccatcagcacaatgaaggagacttggagaagaggaagaataacactgttgcttcctgttcaagctgtgtccagcttttcccctggggctccaggaccttccctacctccaccaccaaaccaagggatttatagcaaaggctaagcctgcagtttactcggggggttcagggagccgaaaggcttaaatagtttaagtaggtgatgggaagatgagattacctcatttagggctcaggcagactcacctcacatactccctgctccctgtggtagagacacctgagagaaaggggaggggtcaacaatgagagaccaggagtaggtcctatcagtgccccccagagtagagagcaataagagcccagcccagtgcagtcccggctgtgttttcctacctggtgatcagaagtgtctggtttgcttggctgcccatttgcctcttgagtgggcagccctgggcttgggcccctccctccggccctcagtgttggctctgcagaagctctggggttcccttcaagtgcacgaggggttaggctgctgtccctgagtcctccattctgtactggggggctggctaggacctggggctgtggcctctcagggggcagcctctccatggcaggcatccctgccttgggctgccctcccccagacccctgaccaccccctgggtcctgtcccccaccagagccccagctcctgtctgtgggggagccatcacggtgttcgtgcagtccatagcgcttctcaatgtgtgtcacccggaacctgggaggggagggaacactggggtttaggaccacaactcagaggctgcttggccctcccctctgaccagggacatcctgagtttggtggctacttccctctggcctaaggtaggggaggccttctcagattgtggggcacattgtgtagcctgacttctgccggagctcccagtccaggaggaaagagccaaggcccacttttgggatcaggtgcctgatcactgggccccctacctcagcccccctttccctggagcacctgccccacctgcccacagagaacacagtggtctcccctgtccgggggcggctttttccttccttggagcgtccctgacggacaagtggaggcctcttgctgcggctgcaatggaggcaaggggctgcagagcccaggtgcactgtgtgatgatgggagggggctccgtcctgcaggctggaggtggcatccacactggacagcagggaggaggggagtgagggtaacatttccatttcccttcatgttttgtttcttacgttctttcagcatgctccttaaaaccccagaagccccaatttccccaagccccattttttcttgtctttatctaataaactcaatattaagatgtta

SEQ ID NO: 3827 - DNA, 4340 bp, Homo sapiens
gtccgcctgccgcccgctggcctgctccctccggggcaagtcttgcttcttaagcgctcctttcacacacgcgcgcgctcgctgggccgtcccctcctctccggccctcctcctcctcctggtccttgctaacgctgccgtcggggaggattgatgtcccttcagcatcatgcagccgccgccgaggaaggacattcagtcagaagaaggctgctattgaaagagagtatgcacagggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccctgcacaagtacagattgaccaggaaaagacaagtgtcttctgtgtgtcacagggaaagccaggagtggccttctctgcaggccagcaagcctgcagcagcaggtgcccccacgtcaggtgctgactgtctgctgtccgctcctgtagaaggtagggagcacaatacctagggactaagggatgttcgccggttgtggtttgttttttttttttttccttggttaagaaatcaaatttgcagaatttaatctacaagttgtattatgctttgaaaactccatccctcctaagaatcttaaaaaacttgaaatgctcgccaaatgtccccatgggatttttgaccaaaagtaaggtgataactgaagaaatttttagttctttgatcacttcagtgacaatacccattaatgaatcttctccatgatttggggttttttttcgttgttgttttttacacttcttaacctgttgatctatttgaggtcttttgtgtttatcaaacttattcttaagtttaaaaaagaaattaaaagggtggtttttttaagattttaaagtttgctaacatattaaaaatcttcaaatgcttattaaatagagcagttcttgccacccagtcttgtattctgtctttagctagccaaattgtccttgaatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaatta

SEQ ID NO: 3828 - DNA, 3154 bp, Homo sapiens
ggcggcgcaggcggccgaccgggagcgcggacaacgcggctgcggctaacccgccgcccggccggctgagaccctcgcgcccctgctcctggggcccccgccccctcgccgtctccgcctccttcctcacacacccccgggccgcccgggccgcccgggccccaagccttcccggtgctcctccctcgtctcctcacactcgctctctggctggggtccgcctgccgcccgctggcctgctccctccggggcaagtcttgcttcttaagcgctcctttcacacacgcgcgcgctcgctgggccgtcccctcctctccggccctcctcctcctcctggtccttgctaacgctgccgtcggggaggattgatgtcccttcagcatcatgcagccgccgccgaggaaggtgaaagttacacaagaactgaaaaacattcaagttgagcagatgacaaaacttcaagccaaacatcaagcagaatgtgatttgcttgaagatatgaggacattcagtcagaagaaggctgctattgaaagagagtatgcacagggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtgtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcagatctctccttcccccaagccacacgcctccctgcctccactgccgttgtacgaccagcctcccagcagcccctaccccagcccagataagaggagctccctgtactttccccggtctccttcagcaaacgaaaaaagccttcatgctgagtcaccaggattctcacaggcatcaaggcatactcctgagacctcatatggcaaactgcgacctgtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaa

SEQ ID NO: 3829 - DNA, 1867 bp, Homo sapiens
aagcagaatgtgatttgcttgaagatatgaggacattcagtcagaagaaggctgctattgaaagagagtatgcacagtattccattgtatggatataccacagtttatccattttcctgttgatggacatggtatgcagaagttggctagtcaatacctgaagagagattggcctggagtaaaagctgatgatcggaatgattacaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaaggtgtgtggaccagttgacaaagatccaaactgaattacaagagacagtgaaagatttagctaaaggcaaaaagaaatactttgagactgaacagatggctcatgcagtacgagagaaagctgacatcgaggcaaaatctaaacttagtctttttcaatcaagaatcagtttacagaaggcaagtgtaaagttaaaagcccggcgatctgagtgtaattccaaagctacccacgcaaggaatgattatcttcttaccctagcggcagcaaatgcacatcaggatcgctactatcaaacagatttagttaacattatgaaggctcttgatggaaatgtgtatgatcatctcaaggattatttaatagccttcagccggactgagctagaaacatgccaagctgtgcagaacacattccagtttttattagaaaactccagcaaggtggtccgggactacaatcttcagctgtttttgcaagaaaacgctgtatttcacaaaccccagcccttccagttccagccttgtgacagtgatactagccgacagttagaatcagaaactgggaccacagaggagcacagtctaaataaggaagctcgaaaatgggccacacgtgtggcacgtgagcataaaaacattgttcaccaacaacgggttctaaatgatctggagtgtcatggagctgctgtatcagaacaaagccgagcagagctagaacagaaaatagatgaagctagagaaaatattcgtaaagcagagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcgcttaatgcagataccgaaagagaagaaggcgaagagtttgaagataacatggatgttttcgatgacagcagttccagcccttctggcaccttaagaaattatccactcacctgcaaagttgtttattcctacaaggcttctcaaccagatgagttgaccattgaggaacatgaggtgttagaagtgattgaagatggagatatggaagactgggtaaaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtggtaaagactgaaacaaggcactctttatttggtcacgtttgacctaaactgtattgccctggagtaagccttcagtaggataaaaagcacaactttcctcctgtcctataatatgcttttctttatatggtcacgtttgtcctgcacagtagaaccctaaagttaatcattcatcagtgagtaaaaaaattacaact

SEQ ID NO: 3830 - DNA, 5813 bp, Homo sapiens
ccgccccgcgcctaggctgttgctggccgcggccgccgccctcccccggcccaatggcgtggcggcacagtcagtgatgtgacgctcaggcttgtccggcccccggctcgcagcccattacaccatccgtcgcagcagtcgctgcagccgctgcagtccgagccgactaagggcgggaggcagctcgggtggcggggcgtggcgaacagcgcggccggattcattcctttggggcgcggagcatggaggagctgtgcggccgcaggcggagcagggcggcccgggcggcggtggggacaacggtttccctttgaaggggacggacaaagcccgagtgaccagcggcggcggggaggactagtccccgggcagtttggtgccctggttgtcagatgttggaaagcagtaggacggaacatactcttcgtggttgtgtatccgttctggggtgcagcaattaacattggactttggttcctgtgactcttgcctgtgtcgatagagttaaactggagctctgctttgaaagataaataaagcacagcctctcaactggacataaatggatctaaagacagcagtatttaacgcagctcgggatggcaaactccggcttctcaccaaattgttggcaagcaaatccaaagaggaggtttcctccttgatctctgaaaaaacaaatggggccacgccactcttgatggccgccaggtatgggcaccttgacatggtggaattcctcctagagcaatgcagtgcctccatagaagttgggggctccgtcaattttgatggcgaaaccattgagggggctccccctttatgggccgcttctgcagcaggacatctgaaggtggtccagtccttgttaaatcatggagcatctgtcaacaacacgactttaaccaattcaactcctcttcgagctgcgtgtttcgatggccatttggaaatagtgaagtaccttgtagaacacaaagctgatttggaagtgtcaaaccgacatgggcatacgtgcttgatgatttcatgttacaaaggacataaagagattgctcagtatttacttgaaaagggggcagatgttaatagaaaaagtgtcaaaggtaatactgcattgcatgattgtgcagaatctggaagtttggacatcatgaagatgcttcttatgtattgtgccaagatggaaaaggatggttatggaatgactccccttctctcagcaagtgtgactggtcacacaaatattgtggattttctgacacaccatgcacagaccagcaagacagaacgtattaatgctctagagcttctgggagctacatttgtagacaaaaaaagagatctgcttggggctttgaaatactggaaaaaggcaatgaacatgaggtacagtgataggactaatattattagtaaaccagtgccacagacactaataatggcttatgattatgccaaggaagtgaacagtgcagaagagctagaaggtcttattgctgatcctgatgagatgagaatgcaggcactattaatcagagaacgtattcttggtccttctcatcctgatacctcttactatattagatatagaggcgctgtctatgcagactctggaaatttcaaacgatgcatcaacctatggaagtatgctttggatatgcagcagagcaatttggatcctttaagcccaatgaccgccagcagcttattatcttttgcagaactattctcctttatgctacaggatagggctaaaggcctgctgggtactactgttacatttgatgatcttatgggcatactttgcaaaagcgtccttgaaatagagcgagctatcaaacaaactcagtgtccagctgacccattacagttaaataaggccctttctattattttgcacttaatttgcttgttagagaaagttccttgtactctagaacaagaccatttcaaaaagcagactatatacaggtttcttaagctgcatccaaggggaaagaataacttcagccctcttcatctggctgtggacaagaatactacatgtgtagggcggtaccctgtttgtaaatttccatctctacaagttactgcaatactgatagaatgtggtgctgatgtgaacgtcagagactcggatgacaacagtcccctgcatatcgctgctcttaacaaccatccagacatcatgaatctccttattaaatcaggtgcacattttgatgccacaaacttgcacaaacaaactgctagtgacttgctggatgagaaggaaatagctaaaaatttaatccagcctataaatcataccacattgcagtgtcttgctgctcgtgtcatagtgaatcatagaatatattataaagggcatatcccagaaaagctagagacttttgtttcccttcatagatgataacttgactgtattttagcactgttaaagcacgaattggtaacagttgtttcataaatgagcactgttgtgataacaccagcattcatttagcttgattgatatcattgtgctctcattggctaaagcattataagcatcaaatttacaacattggtttcccaatatttaatataaatataccatataatatattgtttgtgaattattgagaaatgtaacattcaaatttctaaaattgtctgccaaaggcttattcattctggttttgtttgctgttgggtgtttggggcagagttaaccatttctccatggtgtctttatactttactggtttgtgaattttatacaattgaaagtctttttttcttgcttctttcttctcttctcaagtttcccccctgtttctactttattgtttgtcctaaccatttctactacagttttttccttatggacccatactaggttgtacaaaccttaaggactcgttaccatttgcagttaccataagtgctttatcttctctatgcacaggcttaaacttgactgttgtatgttagcatattttctatgcagcagttggtcaacttcaactcaaaacactgttttcttatgtttgttacaaacttaattttttgaaagtactctgtagcatgacaatttttagagctgcaggttagctattatagctcaagcttttttgtttgtttttttcttcactttcttcacatctgaggtttctttctctaatccactgaaattattgtgtgctaaatttgggaaacagatctattctaactcattaacccagttgaaatttaggtctgtcatcttaatatatcatgcagtaaaaggaagaatctttttaaagtgacccacctttcatgctgctccagcattgtcctgcttgtgctgatggtgtgattaggtgtagagaatttgcttaaatttaacttcaaagttcatcacacagcttaatgagtcacattgaaatactcagtaattgaactgcaaatcacttttagttacaaaaagagctaaagcatgtcagtggcatgatgcttgccaagccagatctaggcatctaggataattaaggtattttagtatgcaatttactgccataatatcaaaggtcagtaacagtgttctttctttcttcaagcttatgtatacctttaaagataacttgcatgaattactttgattactttggtctcaattatttgtcaccccagttaaacatgaaaggttgcagtgcttcctgttcccttactggaagttagctttttcttttctctttcttcctttctttctctcactctttctttctctttctctttctctctctctctctctctcactcactcactcacagatttgctaatgccacagaaagggctcttttaacttaagataagtgaaaagtactaaaaaagattcaggtaattatcattcagcactttattgtaattcagaataaaatttatgatggcatatttgccctgcaaatgtcttaatgaagttgttctcaataaaaagctccttattgatttgagaaaaactcagtttacctgtgagttcaatgagctggatcactcacttggatttttgtgttgacattttattctgagggttgatgttacactatttaaggagtcatcaatgcaaacagtcacattaggtatgtcatcatctttagtcagtaaaaaccttgtaatgaggagtagtaaataaacaagagaacattagactttttggttaaataattgagatttaatttttaaaagatattcttactcatttgctaggttgtaaatttgatttcaccattaagaaaaggtaaattggatataaatgaacgatctccaactttttgatgaagaggttttactatctctcactgtgggaaaatttgatgaaatatttgaactgtcacatatattaagaatactttatgatttagaccaatattctagaaatatcaaatgtcagtatcttgaaatcatctgcctctaactttgtggtataagaattatatatgaataagctattatttttataaaggaaaactttgccattatagtaaattacattagttgatctcgataatttgaggataacagatgacaattgaatttttaattgatttagtatttcctcctcctctttgggggctgggtgggagggcttacatgctcttatagtgaggcacatctcactgttttgcagcagaatttgaattgtgcaactcctgtgtaaagtaaggatttctttaaatagcatttttgcaccagtaaaaatagataacttagaactcagtcttgataactgaaatgacttatttcacttagaatacatttctcccttctctgccatctccacaaatgccattgggaggttttgaaaaaccagttaatttaatagctcaaaattgtccctgattttattttcttttagggaaaattgtttcataaatgtgacactgataaagcctttgtcagaaagtattctcacaattatgagatggattataataaaatacttaaatttgtgttattttttgaaccacagatgagtaaatttaataatgaaccaattacactcttgagtctaactaaactgtacactgtagcacggtgttattgactggagttaatgtgtaagttattaacatttctatgaaaatgcccttttggggcctcctgaattttagatgttccactgttttgatcatttctataaaagaaatggtcattttacttagatgccagtctactttataaagacaaatggattatagacttaaaaatagtcatttttcttattcataaatctgacaggcataaacccaaatcaaagataatttggtgcccattatgaatttgaagttaagtgatagctcacttgtaaagtgactaccttaatgtgtatagagaccccagtctactattatttgggaaaattgtttaggttatatgggaaaagtagctctttaaaaatcatattgcccaacagaaaccttaggctgaatttacaggtatgataatttttgtaattaattttcttagaattgtgcaggctggatgagataatgacatactcttttacactgtaacagcagcattattgcctagaactttaaccattttagagttagatactaaggaaacaaactaattggtcatcatcattttctttttttctttttcttttttttttttttgcccttatgtgtcactaaacaactagtttctctcccttttgtcagttcccattgtgtattttttcaaaagaagtactgtattcggatgccagctaataaattgtcacacaatggaaaatcatatgccacaacattcattgtaaggtttaataaaattaaatttgcacc

SEQ ID NO: 3831 - DNA, 5433 bp, Homo sapiens
atggagactctggatagccagagggtccaggaccgcctgctggcagccccaggatgcagctccccttctggccaacaggaactcttttccagtcatgtgatgcaggaagagagcgcaaatgatatggaatgtgagcagctgccagcagagatactgcgacaagtgaccgttcaccgagaccctatatatggctttggcttcgtggctggcagtgagaggcctgtggtggttcgatctgtgaggccaggaggcccctctgagaacaagctcctggctggtgaccagattgtggctattaatgaggaagacgtgagtgaagccccgagggagagactcatagaacttatcaggagcgctaaggaattcatcgttcttacagttctgcacactcatcagtcccccaaatctgctttcatcagtgctgcgaagaaggccaagttgaggtccaatcctgtgaaggttcgattttctgagcaggtggcagttggagaaacagatgcaaaaatgatgaagaaggaagctctcctcctcatccctaatgtcctgaaggttttcttagaaaatgggcagatcaagtcattcacatttgatggtcggaccactgttaaggatgtgatgttgacattacaggaccgcctttccctgaggttcattgagcactttgctcttgtccttgagtatgccgggccagaacagaatcacaagtttctgcttcttcaggacaagcaacccctggcttatgtggtacagcggacacactatcatggaatgaaatgcctcttccgaataagcttctttcccaaagaccctgtggagctgctgcgtcgggatcctgctgcttttgagtacctatacatccagagtcggaatgatgttattcgagaacgctttggaatggatcccaagccagagatgcttttgggccttgctgcgctccacatctatatcactgtctcagccactcgacctagtcagaagatctcgctcaagaatgtggagaaggagtggggcctggaaccctttcttcccccctccctcctgcaggtcatcaaagagaagaacctccggaaatctctctctcagcaactgaaggctcaccaaacacatccttcctgcggcaccaagggctctgcaattcaggcaaagctccagtatctacgaattctgaatgaacttcctaccttcacgggcgttttgttcaacactgtaggcctggatgagaagcagtcggccaccacgctcctggtgggaccccgtcatggcatcagccatgttattgacctcaaaaccaacctcaccactgtgctgtccgagttcagcaagatcagcaagatccagctgttccgggagaaccagggcgtggcccgggtggagaccagcatcatggatgccaagcctctggtgctgttgatggagtggcctgaagccaccaactttgcctgcctgatcgcggggtactgccgcctcttgctggattccaggaagatggtcttctccaggcctgccagccagccacttccacctccaatgatcaaggcagattacatgcacagcgcccaccgccctgtcactgggggccacctggggaaaaaggagagtagttatgtgggcagcgtgggcaccagccccaggaaatcgagccgctgcacgcccccacctgccgactctgagcttgtcagcttctgctacctccatatgcgggaacaaaggaaggagcaggaaagccggacagatgtcaacgagaacctaatcttctttgaggagaccaggccccgaaccaagtctgaccccacatccaaaagctctggccaaggttatgaggtagtccctgatgactttgatgcagctagcctagaccacgagccttgtgccagcagggcccggtcctacaccttggacaattcccttggggctgaagccctgaatttctactgtgactcttgcaaagccaaacttcaggagcagctgggccctcgcaaaggtgggaagcctggctcctctcgtgacaatatagtagatttgatgtccctcccaccacctgggagtgaggaggaggaggaggaggaagatgagacaacttctctgttgccagccattgctgccccaccccctggtttccgagacaacagctctgatgaggatgaccccaagcgccgggctgtccagagccaggaacaaggacgccacctgcgtgggcttctgtacgatgagattccagtgacattgattgacagtgtgcagacccggacagttcgagatcatgcccaggagctagatgatgccctggtgtccactctgcaggctctagaagccctggctgcatccgaggatggaccacacccaccacccccacagactgcaggtctgattgtgctggccacaatcactcctgaatcatcgctggactcaggtcatgaaaccaactcttcagagctcacagacatgtcagagatgatgtcggccatgaagcagcaccagaacaccacctacttcctggcccagcacctcaacaaggacagcctccttgcccgcaaggacctgcccttccggatccagagctgtgcagcccaggccgttcttacggccccttactctcttgggcgcccggatcccaacccatctctccaacccattgccacaggccagagtcctggcccccctggcgctcggaggaagctgccccagtcagagggccaggtacagggagaacgaacatactccttggcagtgcacccagcactgtccccacagcttagtgaacagaagaatctgagtctgctgtccccagttcctgaggacaaagggcctggccacactagggcaggcctagaaatgtcactgagggcagccacatcatccctcagtgaagagcaggtctctgagctgagggacaacctgcccaaggaggtcaggttgagccccaagcttatcctcgacccaaagagcagtgtgacccctgccatcatctcggccgccctacagcaagtggttcacaataagagtctagtcactgctggtggggctttggggaacccccccagcaggggtgagagaaggctggaggccagcatggggaggccagaggttagcatgatgagcagcagtgccagtaagaatctgaagttcaaaattagccccagtgctccagagacctcatggaattctcaacatcagctgggtgcagaggtctcttccagccccagagcacccacaggcagccgggctgacagcctgcacctctcccaacaagaggacagtctgcctgttcaaaatttccctcccaaaagctatcttttgcgaacaagccgagagtcagtgggcaagcaagctacaggggaggtggcaggcaaaggcgggccagtgggtggtaagcccaccctgcagaagcagggcaccatctccagccaaggggagaaggcgcagctggagagcacacccaaaagaagcaagctcgaagagaccagcctggttccccgagctacctaccccatggctctgcagagccccagctgccagtcaagaagccacagccccagctgccagcctcatggccacagccccagcagccagtctcgaggtcagagccccagctgccaacctcgaggccagagcccactgaggtctcaggctgccagccggcaggtgagcaccatgccctctaggaagcttgaaacaactctcaatggagcccactcgacctctgaaggccctgccaaacccaagtcatcccgaggtcctttccggctacgcaatttattctctgccaccttcccaacccgccagaagaaggagacagatgagcggcaggcccaactgcagaaggtaaagcagtatgaactggagttccttgaggaacttctaaagccaccaagccagggggagctgccaggcaccgagtacctgcaacctccagcacctggccgctgcagctgccagctccgcagcagccctgtgcagcaggggcctggcatgtcccgtgagcagaggcgcagctgtgactgcaagcgcatctgccgggggggccggccacaagccacccagacaccagtgcccagcctccgggggagggaaagggacagagtcctccctagccagaggcagccagaggctggcccaggcgtgagcctcagcagccccatcaatgtccagcgcattcgttctaccagcctggagtcccgagagtgccgatcggaccctgagagtggtgtttcgtgcctgaccacgtgtgcctcggggggcgagtgtctgggagctcccaattacaggaaactgatgcgccgctacagtatcagtgagctggaccagggtgacagggcctcgctgacctcggatgtctacccacatcctcccctgggcatgctgcccagggaggccaaggaggtagaggcaagcctccccatagccttgggtcccaaaagcaggtctctggagtcaccgacgctgggagacccctcctacgtccaggttgccccagagaccaaaggccccagacagatggccgtgttctcactgcccgaggaggtgtaccggaagcctgccgagctagacgaggacagtgagagcagcaagtgctgctccatccgctactgcttctactaccgcaagtgtgacatggcagatgatgccagtgatggcaaggatgagctctcctactctatccccatgaagatcctgcctggcatgaagctggacgagcaggtggtgcctgtggtgagcaggaccctgcaggtgctggatgctgctacctgcagcagcagcagccctgaggcctcccgcactcaggagattgacctccgtgtgtccaccttcgaggggagcctggccaagatcaatgccctgcgggcccatgcctatggcctccctgatggcttcctggctgcccggctggacaccaacgagctgctgacagtcctgcggcagtgtgtggccagccccgaggcccgtgcccccaagccctatgtgtctcagatctccgagtataagcttgagctagctctcaagttcaaggagctccgggcctcctgccgccgtgtggccaatgtggacaagagcccaactcacatgctggcagccatcacgggcagcttccaggtgctgagcagcctcattgagaccttcgtgcggctggtgttcattgtgcgctccgaggcccagcgccaagagctgctggccaaggtagaagaggtggtgaggaactacaccttcctgctgcgtgcagctgaggagtccacagcccgtaaccttaaccagcagcagcagcaacaacaacagcagcagcagcaacaacaacagcagcagcaacaacaacagcagcagcagcagcagcaggtggcagcagctgcaggggcagccacagagcatccaccaggctccccaacttcggcgactgttatgagcacattcacccactccttaaaaacccttattaagtag

SEQ ID NO: 3832 - DNA, 3067 bp, Homo sapiens
gtgatctgggaggtgctgagcacccacctgcgacccatggcgggggagggccgagtaacgacagcatggcggtgcccccgagagggaggggcatagaccccgcccggacaaaccctgacacgttccctccttcaggggcgcgatgtatggaacccagtcctgagaggcctgcatgcagtcagcaggagccgaccctgggaatggacgcgatggcctcggaacacagggatgtcctcgtgctgctgcccagccgggagcaactgcggctggccgtgggggtgaaggctactggccgcgagcttttccagcaagtgtgcaacgtggcgagcatcagagacgcgcagttctttggcctctgtgtggtcagaaacaatgagtatatatttatggatttggagcaaaagctcagcaagtacttctcaaaagattggaagaaagaaagaaatgaaggaaatgagaaacccagagcccccttcgtggccttcctccgagtgcagcactacgtggaaaacggaagggtcataagcgaccacagggcacggcacctgtactactgccacttgaaggagcgcgtgctgaggtcacagtgcgctcaccgggaggaagcctacttcctgctggctgcctgcgcgctgcaggctgacctgggcgagcaccgggagtcggcccatgccgggaggtacttcgagccacactcctacttcccacagtggatcatcaccaagagggggattgactacatcctccggcacatgcctaccctgcaccgtgagcgccagggcctgagccccaaggaggccatgctgtgcttcatccaggaggcctgccggctggaggacgtgcccgtgcacttcttcaggctgcacaaggataagaaggaaggtcgtcccaccgtgatcctgggactggccctcaggggagtgcacatctaccagggaaagaagctggagatccagctggatgggctgcccgcagcacagaagctggtttactacacggggtgcacctggcggtccaggcacctgctgcacctgctgcgcgccagccaccagctccacctccgcgtgcggcccactctgcaacagctgcggcagcgggaggaggcagaagagaagcagcactaccgggagtcctatatcagcgatgagctggagctggacctggccagcaggagcttcccgggcagtggggtcagcagccagcactgcccccactgcctctcacgccactccgccgacagccacggcagttcctacacgtcaggcatcaaggccaactcctggctcagggaatccagagagatgtctgtggacgtgcccttggaggtccacgggctccatgagaaggagccgtcctccagccccaggaccagccgcagccaccccagcacacgtggtgacagccaagccactcgtcaggagccctgcacccaggtcaggaccagaggccagagcgccgaggccgtgcaccagatccaggaaatgacagccggggtcagtgaggagcagcacagccatggcctggacgacatgcagctgcaccagctggccctgcacccagcgcccacctcactcagccataccttccaccgcgccctggactgcaggctggcaggcccctgcgagaccagggccactctccccagcaagaggtccagcaactgtctcgccctggacctgttcggagaggctccaccacaggagtttgtggtgtaggcaccacccacccagcagtaccgtccgcaccgccaggctcagcccctgcccaccccacttccacatggccctcgtcccttcctgcccgccagatgctgcctgcacttccgcagccagcacgctccacaggttcacctgtaagaggtgtggagctggctctgacatcaacctgggaggtaacaaacaggtcccgcacctcatgcctgtctgccatacacccgggagctctttccctcagggtctcagggagccagttcaaggtctggctgtcaagtgtccagagagccatggtgttggcccctgaggcagcctgtcacccatcctaatctgggagagaaggtgacacagctgggcccagaccctggagagacagctctgcagtttcccacactgtcagctccccaagagacagtcctgatgggcacaggctgccagagctcccaagccggagttcacagtcatcactgtgcaggacccaggttcctcccagacctgaacccctctctgcaactcctgtttgcaagcgctgggcctgccagacagaggcccctcttgtggtgcaagcccagctctgtcacctgagatccagccagagaccctcctccaccatccacagtcaatggctgtgctttcccttccaagccagggcttccaaagaccccactgccccggagctgaagccgactctgctcccatctcagccatgaggcctcaggacccactctgctcacaggtggcttccttaagccattgccctggctggggttgggctggtgcagcccagctggcggaggggcgaagctttggtgacagacggagagtgggggactagctgtgcatggcacctgctctgatccggtgggctccacgggtagtgcgacctcggttctgtgggctctggaaggccaccagggtagggtctccccagggctcctccccctgcacaacactcctgcacacgtgcaaacctgctgtcctctgcatttagaggaatggcccgtgcatccctgctagtctcaggcccatcccagagcactgagaggccacaatcgttcagccctgtgccctgaacaccactgcccccttcactgtctgtgtgtggtgaagaccacgccacaccaccctccagctcactggagacaagcatgagcttgagccccatggcctggtgcagggctgcgtgcattgaggccgcctctttgacgggtccatccagggggaccctctcctttctgtgaaagggaatcgtgtgtgtgccccaggcacgtgtaataaagaacccgagcagatgcctcctgcttgaaccaggaccagcctgcctggggggctggtgagatgccggctgtaactca

SEQ ID NO: 3833 - DNA, 2857 bp, Homo sapiens
ggaaatgtggacacgggacgccggaaacagggacacgcaccagacgctgggtgtttagaggctgccgtgagaggctcagctgtaggaacactgttgggatcactcgcatcagttgggcgatggatgatgtgaaggctactggccgcgagcttttccagcaagtgtgcaacgtggcgagcatcagagacgcgcagttctttggcctctgtgtggtcagaaacaatgagtatatatttatggatttggagcaaaagctcagcaagtacttctcaaaagattggaagaaagaaagaaatgaaggaaatgagaaacccagagcccccttcgtggccttcctccgagtgcagcactacgtggaaaacggaagggtcataagcgaccacagggcacggcacctgtactactgccacttgaaggagcgcgtgctgaggtcacagtgcgctcaccgggaggaagcctacttcctgctggctgcctgcgcgctgcaggctgacctgggcgagcaccgggagtcggcccatgccgggaggtacttcgagccacactcctacttcccacagtggatcatcaccaagagggggattgactacatcctccggcacatgcctaccctgcaccgtgagcgccagggcctgagccccaaggaggccatgctgtgcttcatccaggaggcctgccggctggaggacgtgcccgtgcacttcttcaggctgcacaaggataagaaggaaggtcgtcccaccgtgatcctgggactggccctcaggggagtgcacatctaccagggaaagaagctggagatccagctggatgggctgcccgcagcacagaagctggtttactacacggggtgcacctggcggtccaggcacctgctgcacctgctgcgcgccagccaccagctccacctccgcgtgcggcccactctgcaacagctgcggcagcgggaggaggcagaagagaagcagcactaccgggagtcctatatcagcgatgagctggagctggacctggccagcaggagcttcccgggcagtggggtcagcagccagcactgcccccactgcctctcacgccactccgccgacagccacggcagttcctacacgtcaggcatcaaggccaactcctggctcagggaatccagagagatgtctgtggacgtgcccttggaggtccacgggctccatgagaaggagccgtcctccagccccaggaccagccgcagccaccccagcacacgtggtgacagccaagccactcgtcaggagccctgcacccaggtcaggaccagaggccagagcgccgaggccgtgcaccagatccaggaaatgacagccggggtcagtgaggagcagcacagccatggcctggacgacatgcagctgcaccagctggccctgcacccagcgcccacctcactcagccataccttccaccgcgccctggactgcaggctggcaggcccctgcgagaccagggccactctccccagcaagaggtccagcaactgtctcgccctggacctgttcggagaggctccaccacaggagtttgtggtgtaggcaccacccacccagcagtaccgtccgcaccgccaggctcagcccctgcccaccccacttccacatggccctcgtcccttcctgcccgccagatgctgcctgcacttccgcagccagcacgctccacaggttcacctgtaagaggtgtggagctggctctgacatcaacctgggaggtaacaaacaggtcccgcacctcatgcctgtctgccatacacccgggagctctttccctcagggtctcagggagccagttcaaggtctggctgtcaagtgtccagagagccatggtgttggcccctgaggcagcctgtcacccatcctaatctgggagagaaggtgacacagctgggcccagaccctggagagacagctctgcagtttcccacactgtcagctccccaagagacagtcctgatgggcacaggctgccagagctcccaagccggagttcacagtcatcactgtgcaggacccaggttcctcccagacctgaacccctctctgcaactcctgtttgcaagcgctgggcctgccagacagaggcccctcttgtggtgcaagcccagctctgtcacctgagatccagccagagaccctcctccaccatccacagtcaatggctgtgctttcccttccaagccagggcttccaaagaccccactgccccggagctgaagccgactctgctcccatctcagccatgaggcctcaggacccactctgctcacaggtggcttccttaagccattgccctggctggggttgggctggtgcagcccagctggcggaggggcgaagctttggtgacagacggagagtgggggactagctgtgcatggcacctgctctgatccggtgggctccacgggtagtgcgacctcggttctgtgggctctggaaggccaccagggtagggtctccccagggctcctccccctgcacaacactcctgcacacgtgcaaacctgctgtcctctgcatttagaggaatggcccgtgcatccctgctagtctcaggcccatcccagagcactgagaggccacaatcgttcagccctgtgccctgaacaccactgcccccttcactgtctgtgtgtggtgaagaccacgccacaccaccctccagctcactggagacaagcatgagcttgagccccatggcctggtgcagggctgcgtgcattgaggccgcctctttgacgggtccatccagggggaccctctcctttctgtgaaagggaatcgtgtgtgtgccccaggcacgtgtaataaagaacccgagcagatgc

SEQ ID NO: 3834 - DNA, 1649 bp, Homo sapiens
agcaagtacttctcaaaagattggaagaaagaaagaaatgaactgctccgtccagaggggctgtccgcagggggactgtggtgagccctgaggctgcaagcagggaaatgagaaacccagagcccccttcgtggccttcctccgagtgcagcactacgtggaaaacggaagggtcataagcgaccacagggcacggcacctgtactactgccacttgaaggagcgcgtgctgaggtcacagtgcgctcaccgggaggaagcctacttcctgctggctgcctgcgcgctgcaggctgacctgggcgagcaccgggagtcggcccatgccgggaggtacttcgagccacactcctacttcccacagtggatcatcaccaagagggggattgactacatcctccggcacatgcctaccctgcaccgtgagcgccagggcctgagccccaaggaggccatgctgtgcttcatccaggaggcctgccggctggaggacgtgcccgtgcacttcttcaggctgcacaaggataagaaggaaggtcgtcccaccgtgatcctgggactggccctcaggggagtgcacatctaccagggaaagaagctggagatccagctggatgggctgcccgcagcacagaagctggtttactacacggggtgcacctggcggtccaggcacctgctgcacctgctgcgcgccagccaccagctccacctccgcgtgcggcccactctgcaacagctgcggcagcgggaggaggcagaagagaagcagcactaccgggagtcctatatcagcgatgagctggagctggacctggccagcaggagcttcccgggcagtggggtcagcagccagcactgcccccactgcctctcacgccactccgccgacagccacggcagttcctacacgtcaggcatcaaggccaactcctggctcagggaatccagagagatgtctgtggacgtgcccttggaggtccacgggctccatgagaaggagccgtcctccagccccaggaccagccgcagccaccccagcacacgtggtgacagccaagccactcgtcaggagccctgcacccaggtcaggaccagaggccagagcgccgaggccgtgcaccagatccaggaaatgacagccggggtcagtgaggagcagcacagccatggcctggacgacatgcagctgcaccagctggccctgcacccagcgcccacctcactcagccataccttccaccgcgccctggactgcaggctggcaggcccctgcgagaccagggccactctccccagcaagaggtccagcaactgtctcgccctggacctgttcggagaggctccaccacaggagtttgtggtgtaggcaccacccacccagcagtaccgtccgcaccgccaggctcagcccctgcccaccccacttccacatggccctcgtcccttcctgcccgccagatgctgcctgcacttccgcagccagcacgctccacaggttcacctgtaagaggtgtggagctggctctgacatcaacctgggaggtaacaaacaggtcccgcacctcatgcctgtctgccatacacccgggagctctttccctcagggtctcagggagccagttcaaggtctggctgtcaagtgtcca

SEQ ID NO: 3835 - DNA, 3723 bp, Homo sapiens
gcctcgggcgccgcgcttcctcccgccgtggcttccgcgtcgcttcccggtcagctgcgtccttagcgggagcccgagtgcgggcggtggcgggcttggcggcggggcaggattccaggcaggagccttgcctctcaggtggcgggctctgcgaccctgcgagatggacgggacagaaggcagtgccgggcagcccggccccgctgagcgatcccaccgaagcagcgtgtcctccgtgggagcccgagcggctgacgtgctggtatacctagcggatgacacggtggtgcccctggctgtggagaacctgccctcgctcagtgcccatgagctgcaccgcgctgtccgcgaggtcctgcagcttccagacatcgccctggatgtcttcgcgctctggctggtctcccctctgctggaggtgcagctgaaacccaagcaccagccctacaagctgggacgccagtggccggagctgctgctgcgcttcaccagtgccccagacgatgacgtggccatggatgagcctttcctgcagttccgaaggaacgtgttcttcccaaagcggcgggagctccagatccatgacgaggaggtcctgcggctgctctatgaggaggccaagggcaacgtgctggctgcacggtacccgtgcgacgtggaggactgcgaggctctgggcgccctggtgtgccgcgtgcagcttgggccctaccagcccggccggccggcagcctgcgacctgagggagaagctggactccttcctccctgcccacctctgtaagcggggccagagtctctttgctgccctccggggccgtggggccagggccgggccgggcgagcagggcctgctgaacgcctaccgccaggtgcaggaggtcagcagcgacggcgggtgcgaggccgccctgggcacccactaccgcgcctatctcctcaagtgccacgagctgccgttttatgggtgtgccttcttccacggtgaggttgacaagccggcccaaggctttttgcaccggggtgggcgcaagccagtttctgtggccatcagtctggaaggcgtgcacgtcatcgatagcagagagaagcatgtcctgctgggcctgcgcttccaggagctgtcgtgggaccacacctcccccgaggaggaggagcccatcttgtggctggagttcgacggggacagcgagggcacacctgtcaacaagctcctcaagatctactccaagcaggccgaactgatgagcagtctcattgagtactgcatcgaactgagccaggcggcggagcccgcaggcccccaggacagtgcgactggctcgccctcggaccccagctcctcactggctcctgttcagcgccccaagctgcggaggcagggcagtgtggtgtccagccggatccagcatctctccaccatcgactacgtggaggacggcaaggggatcaggcgagtgaagccgaagcgcaccacatccttcttcagccggcagctgtccttgggccaggggagctacaccgtggtgcagcccggcgacagcctggagcagggctgaggacgctgcacccggcaggaggagggcgactgggggccctggcccggcactgtcctcctgaggggcaggcgccggctgcaacagtctcatgggtcaccacgtggggagggctgcctcagcaggtttctcagaccacggagaagtgacttttgggcccggggccatgcccgggctgtgcaaagctggccagggcctcctgtagggctcctctgcagcctgccctcccttcccccggatgctgggccctgctgctctctcaggaccatccgatcaagctgcagctgccaccctcacctagaaacatgcctttgtgcccacctcaagatgggcagtgtccctgttctgaagtgcccagtggcagctccagtggtagaggaccaaggattgaggtttgggacctgaagctccagtgtgtgcctttggcctcttccctggacttgggtgaccagtctccgtcttcctcctgctagtgctccaccccccggacttggatgaccagtttcccaccttcctcctgctggtgctccatcccccaataccaggctgggccaccactctgaggagggtaggaggggcctccctggattgaaccgggacagaaacacggtgagggcccccaccacacctccctggttgaatcaggaatggagggagccaggcagggccctacctggggtcctgtgcccctcgttctggtctcctttgcaggcacgagataccagaaagagcatgcctttctgatagcctttggtgatgtcactgctgggaggtggctatcctgtggaccacctggcctccagacccacactcacagtctgtgaaaaactgaaaatcccctggtgggcactccctggagcccaagcagctcccctaggggactgaccggacctgacctcccctccctgtgtctgggtcttcaggttttagtttggtctttgttcatctgagttgtgctggggcaacgccaggaagtgccctgggtacctctgctgtgcgctccttcccaggtggcgccatggattcctctgggggctggcgcatgcccaggaaagcctgggccacacgggacactctcttctttatcgaggacacttggaaaggtgactgatatgggtgcttggcttctctggtcccagcttgccctccggggagcaggggctctgtcttgtcccagatgagctgagagcccctgagaggagggctttcccagccctgggaccctccgaggtgggtgtgcgggtctcacaggtgcttcctgggacttcctgtggctgcacagggcttggctttgtcttcgttcccggtggaaaaccgtgggagaggaagcttgggcctctactccaagtatcagagcctgttcaccctcctccctttggtagcttgtgaatgtgccaggtgtttcgaggtaggcttgccttctggcagcatggactttgttaaaataataggcggaaagaagaggcctgggaagggcccccagtcttttggaatgtcctggtcacagggtcatgtcagctgccagttctcgtctcccgtcctggagttgctcggtcttgcggagctgcccgcctgcctgttctggcggctccagcgcaggctgtccctgctgctttgattccaggtgattttattttttttatttttttattttttttgagacggagtcttgctctgttgcccaggcaggagtgcagtggcgcatctcggctcactgcaacctctgtctcaagcgattctcctgcctcagcctcctgagtagctgggattacaggtgcatgccaccaggccccgctgatttttgtatttttagtagagatagggtttcaccatgttggtcaggctggtcgtgaactcctgacctcatgatctgcccgcctcaacctcccaaagtgctgggattataggcgtgagccaccgcccccagctgattccaggcgaattcttctctgatgggcgggcgagggtgtgttcgtgtgatgggttggagtgtgtgtgtctgagtacacagatgatgtgttttcccttcagcttcttacgttttctgagcatccattgtgccttaacattttctgcttgtcctttgggacaaagcagtattttactcattctttgaatgttctcattcttttgtatcatgtgacttattaaaatcagtttctaacaaa

SEQ ID NO: 3836 - DNA, 1818 bp, Homo sapiens
gtccttagcgggagcccgagtgcgggcggtggcgggcttggcggcggggcaggattccaggcaggagccttgcctctcaggtggcgggctctgcgaccctgcgagatggacgggacagaaggcagtgccgggcagcccggccccgctgagcgatcccaccgaagcagcgtgtcctccgtgggagcccgagcggctgacgtgctggtatacctagcggatgacacggtggtgcccctggctgtggagaacctgccctcgctcagtgcccatgagctgcaccgcgctgtccgcgaggtcctgcagcttccagacatcgccctggatgtcttcgcgctctggctggtctcccctctgctggatgagcctttcctgcagttccgaaggaacgtgttcttcccaaagcggcgggagctccagatccatgacgaggaggtcctgcggctgctctatgaggaggccaagggcaacgtgctggctgcacggtacccgtgcgacgtggaggactgcgaggctctgggcgccctggtgtgccgcgtgcagcttgggccctaccagcccggccggccggcagcctgcgacctgagggagaagctggactccttcctccctgcccacctctgtaagcggggccagagtctctttgctgccctccggggccgtggggccagggccgggccgggcgagcagggcctgctgaacgcctaccgccaggtgcaggaggtcagcagcgacggcgggtgcgaggccgccctgggcacccactaccgcgcctatctcctcaagtgccacgagctgccgttttatgggtgtgccttcttccacggtgaggttgacaagccggcccaaggctttttgcaccggggtgggcgcaagccagtttctgtggccatcagtctggaaggcgtgcacgtcatcgatagcagagagaagcatgtcctgctgggcctgcgcttccaggagctgtcgtgggaccacacctcccccgaggaggaggagcccatcttgtggctggagttcgacggggacagcgagggcacacctgtcaacaagctcctcaagatctactccaagcaggccgaactgatgagcagtctcattgagtactgcatcgaactgagccaggcggcggagcccgcaggcccccaggacagtgcgactggctcgccctcggaccccagctcctcactggctcctgttcagcgccccaagctgcggaggcagggcagtgtggtgtccagccggatccagcatctctccaccatcgactacgtggaggacggcaaggggatcaggcgagtgaagccgaagcgcaccacatccttcttcagccggcagctgtccttgggccaggggagctacaccgtggtgcagcccggcgacagcctggagcagggctgaggacgctgcacccggcaggaggagggcgactgggggccctggcccggcactgtcctcctgaggggcaggcgccggctgcaacagtctcatgggtcaccacgtggggagggctgcctcagcaggtttctcagaccacggagaagtgacttttgggcccggggccatgcccgggctgtgcaaagctggccagggcctcctgtagggctcctctgcagcctgccctcccttcccccggatgctgggccctgctgctctctcaggaccatccgatcaagctgcagctgccaccctcacctagaaacatgcctttgtgcccacctcaagatgggcagtgtccctgttctgaagtgcccagtggcagctccagtggtagaggaccaaggattgaggtttgggacctgaagctccagtgtgtgcctt

SEQ ID NO: 3837 - DNA, 380 bp, Homo sapiens
cttgcggacccagcctgggatcccttaccgtactcaccgagagcttgaggagacctccagccccccatccctggctcccggtaactgctgtttctctttgcctttgcagatggacgggacagaaggcagtgccgggcagcccggccccgctgagcgatcccaccgaagcagcgtgtcctccgtgggagcccgagcggctgacgtgctggtatacctagcggatgacacggtggtgcccctggctgtggagaacctgccctcgctcagtgcccatgagctgcaccgcgctgtccgcgaggtcctgcagcttccagacatcgccctggatgtcttcgcgctctggctggtctcccctctgctggaggtgcagctgaaaccca

SEQ ID NO: 3838 - DNA, 2789 bp, Homo sapiens
cgtaaaacgagcgccacagagaacgcgagccgggagtccgtggaggccatggcccctcggcgcctcctgttggttggggaggggaatttctccttcgccgccgctctgagcgaaaccctggatcagagcactcaacttaccgccacctgcctccagcgcccggccgagttggctcgggatccactggcctgggagaatctgcagtgcctgcgcgagcgaggtatcgatgtacgtttcggtgtggactgcacccagctggcagatgtctttgaactgcacgagagagaatttgatcaaatttatttcatcttcccgcattgtggacgcaaagctggcgtagctaagaacagggaactgcttgccaaatttttccaaagctgtgcagacgttcttgcagaggaaggagaagtccacgtggcattatgtagaggacaaggtggaactcctgcggataagccccagagagaatggcacaacagttggcaagtggttgccatggcagccctgggggggctcattttaagcgacgtgtatccattcagctgtaaggctgtggcagggtacaagtgcactggatataggagtcaagataagtcctttcatgtagaaggtgctttgaaccatatcttcaccaggagcttaccttttgaaggttctcaacccagaatcttcaggatcaaactgggtaaccagtggttttcctttccagaaccagaagcacttgtaggaaagttgaacaggggtttcctggaagcaccttcatgtcatcctatcaaaaccataaatgagaaactcattgctgaattaggcaaagttttcccgctaaaaaggctgaagtgttcctaccctttgctgccacaggaaggtaccagtgttcttcctttctggaattgtgactttctgtcagctgctttttggattagtctccatgaagataactcaaattctgagtccctgactggtgggacatcacaagatgtggaagactttctagtgtcattttcagaacttagccttctcaagaatcctggaagagatggtaaagaagaagcttgtgaaggaacctgtggccaggccaagatctgccttagaccttctctcctagtgcatgttcaggatgtcatcgaagtaccagacttcctctcaggttctctgcacatcctcagtggacctgtctttcagaagtgccacattttgcctttcacaatgccagcatttcatgaaactttatttatccttggggttaatcaaaatctgaaggatggctgtcttcaatcactgctggatcatctgaagggcattctagatagcctgctgacccagacattgccggagagctctaagctgagcagtttagtcaaatttgtccttcagtcaaatggaaaggattatatgattcgtgtgaagactcataattttagcccagattgtactgaggatctaattattgggtctgttatcacatctgccactagtgttatacataaagaccagtgttttgtgtttgtgtctatgaacttggacttattagccatgcttgtctggtgtatctctgactggagaatgttgtggacgtttgataaccgtttcctgaaaaattttgtccctggcaaaatagaaccctttaaaagtcattctctgtatcctccatgttatgtgcatgatgttagtttttggatagatcagaagaaaggatttgatgaactagagtttcacactgtggcccgagcagtgtctcaggacactattatatccatacagtttcttagccgtttccagcatccaaagactcaacaggtcagtctctgctatagattgacctaccagacctgtgacaaggccctcacccagcagcaagtagcatcaatgcagtcccagtttaggaaggagattcaacaacacctatatgttatacctcggtagtttggtaaatccttttctgcagtgtgatccttcattgcgggggatgtggaggaaaattaccaacttgcaaccagtagtcctttctggatttttgtttttgtaaaatcttttactttgtgaccatagctactgttcgttgatctttttttttttttttttttgagacggagtcttgctctgccgcccaggcgggagtgcagtggcagtggcatgatatcagctcactataagctccacctcccaggttcatgccattctcctgcctcagcctcccgagtagctgggactacaggcacctgccaccacgcctggctaatttttttttttgtatttttagtagagacgaggtttcaccgtgttagccaggatggtctcaatctcccggcctcgtgatctgcctgcgtcggcctcccaaagtgctgggattatagatgtgagccaccgcgcccggcctactgttagttgatcttaaagataccttgactctattactgaaacttatagattataatgtgattggtgacatttggagttgtgtaatattttggtcccgagaagtgactaaaacaataaacaaaacagcatcttgtactttagatgctctattgttgaacaggcagtagaacttaagtgtctcatcaaatataaatatgttttccacactgtcaattactcttcccttaactttgttgtatcatttcattaaatcaccttatgagagtagtttttggcatcagactaacatttattagcttgggaaattgcaaatattccacattaattttggtattattattataatcatcaccattttaattctgtggttgaaagtcatggaacgaataaagtgtcagatttagggttaa

SEQ ID NO: 3839 - DNA, 1836 bp, Homo sapiens
ttcgccgccgctctgagcgaaaccctggatcagagcactcaacttaccgccacctgcctccagcgcccggccgagttggctcgggatccactggcctgggagaatctgcagtgcctgcgcgagcgagctgtgcagacgttcttgcagaggaaggagaagtccacgtggcattatgtagaggacaaggtggaactcctgcggataagccccagagagaatggcacaacagttggcaagtggttgccatggcagccctgggggggctcattttaagcgacgtgtatccattcagctgtaaggctgtggcagggtacaagtgcactggatataggagtcaagataagtcctttcatgtagaaggtgctttgaaccatatcttcaccaggagcttaccttttgaaggttctcaacccagaatcttcaggatcaaactgggtaaccagtggttttcctttccagaaccagaagcacttgtaggaaagttgaacaggggtttcctggaagcaccttcatgtcatcctatcaaaaccataaatgagaaactcattgctgaattaggcaaagttttcccgctaaaaaggctgaagtgttcctaccctttgctgccacaggaaggtaccagtgttcttcctttctggaattgtgactttctgtcagctgctttttggattagtctccatgaagataactcaaattctgagtccctgactggtgggacatcacaagatgtggaagactttctagtgtcattttcagaacttagccttctcaagaatcctggaagagatggtaaagaagaagcttgtgaaggaacctgtggccaggccaagatctgccttagaccttctctcctagtgcatgttcaggatgtcatcgaagtaccagacttcctctcaggttctctgcacatcctcagtggacctgtctttcagaagtgccacattttgcctttcacaatgccagcatttcatgaaactttatttatccttggggttaatcaaaatctgaaggatggctgtcttcaatcactgctggatcatctgaagggcattctagatagcctgctgacccagacattgccggagagctctaagctgagcagtttagtcaaatttgtccttcagtcaaatggaaaggattatatgattcgtgtgaagactcataattttagcccagattgtactgaggatctaattattgggtctgttatcacatctgccactagtgttatacataaagaccagtgttttgtgtttgtgtctatgaacttggacttattagccatgcttgtctggtgtatctctgactggagaatgttgtggacgtttgataaccgtttcctgaaaaattttgtccctggcaaaatagaaccctttaaaagtcattctctgtatcctccatgttatgtgcatgatgttagtttttggatagatcagaagaaaggatttgatgaactagagtttcacactgtggcccgagcagtgtctcaggacactattatatccatacagtttcttagccgtttccagcatccaaagactcaacaggtcagtctctgctatagattgacctaccagacctgtgacaaggccctcacccagcagcaagtagcatcaatgcagtcccagtttaggaaggagattcaacaacacctatatgttatacctcggtagtttggtaaatccttttctgcagtgtgatccttcattgcgggggatgtggaggaaaattaccaacttgcaaccagtagtcctttctggatttttgtttttgtaaaatcttttactttgtgaccatagctactgttcgttgatctttttttttttttttttttga

SEQ ID NO: 3840 - DNA, 1976 bp, Homo sapiens
ggcttctccaacccggcccggcccttccttcccctttcccgcagtcgttgcctcctcctcccctgcctcctcctccccttcctcctcctggccgcttagtctcacacccgccgggccgttgttcccgagacgttgttgagtcccctgtgtcctcttctgggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgaggtattgtttcatcatttctgtattgtctttcaataaagaaaacaaacatgtgcaaccagaa

SEQ ID NO: 3841 - DNA, 681 bp, Homo sapiens
caaggcggggctgtagccgccccgggaccgccctgctcaggcgccgtggggttcggcgcggctacgtgcagaatccgtctagctaaaatgtaatttcagattggacaagtactgtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacg

SEQ ID NO: 3842 - DNA, 1640 bp, Homo sapiens
atgatcgcatggagaatggattttgttgctttatctgatattgtcctcagctcctcctgaatttgccgagatcttacagcagtcagtaaggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgaggtattgtttcatcatttctgtattgtctttcaataaagaaaacaaacatgtgcaaccag

SEQ ID NO: 3843 - DNA, 2052 bp, Homo sapiens
cccagaaagaggcttctccaacccggcccggcccttccttcccctttcccgcagtcgttgcctcctcctcccctgcctcctcctccccttcctcctcctggccgcttagtctcacacccgccgggccgttgttcccgagacgttgttgagtcccctgtgtcctcttctgggtggaggaactgcaatgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatgagaaccactggatatctgtatattccggctttggcagcgttgcactctcccagttctctactctcccctcaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacaggaagcaatggcaaaaatgagcaaagttgggaaagttgtgttcccgagactacaggataaaaaatactatgataagaaataccaagtattcctgaagctggttgaacaccagaaggagtatttggcgatcatgaatgatgactgaacagggcttgcaggtgctgatgccagaagcttctgtgccattgcattaaagacttgtcatttgatccatgttcaagacccttgaggtattgtttcatcatttctgtattgtctttcaataaagaaaacaaacatgtgcaa

SEQ ID NO: 3844 - DNA, 6480 bp, Homo sapiens
agtgctacacaagtttgatgtttgtgtcttcttctccaaggccaagaaattatctccataggaggcaacagtactatgcatgttatgaattgtgtctccttggtcagtgataaagaaaatgggaatattgccacagcacctggattcatgattgggcagacacctcctccagcacctcctccacctcctcctccaccccctccatctccaccatgttcatgttcaagggaagagtgtccttcctcccctcctccacccccaccacctccacttcctggggagcctcccatcccacctcccccaccaggcctacccccaactactcacatgaacggctacagccaccttggtaagaaaaagcggatgagaagctttttttggaaaactattccggaggagcaagttcgaggcaaaaccaacatctggaccttggcagccaggcaggaacatcactaccaaattgatacaaagaccattgaggagctctttgggcagcaggaagacaccaccaagtcttcccttcctaggagaggaagaactttaaattcatccttcagagaagctcgagaagagattactattttggatgcaaaacggagcatgaacattgggatatttcttaagcaatttaagaagtctcctcggtccattgtagaagatattcatcaaggaaaaagtgagcattatggatcagagaccttgcgagaatttcttaagtttttgccagagtcagaagaggtaaagaagttaaaagcgtttagtggcgacgtgtcgaagctgtctctggcagattcctttctgtatggcttaattcaggtgccaaactattcacttcggattgaagccatggtgctaaagaaggaatttctaccttcttgctcttctctatatacagatataacagttttaagaactgctataaaagaactgatgtcatgtgaagagctacattcaatattacacttggtgctccaggctgggaatatcatgaatgcaggagggtatgccggcaatgcagtaggatttaaactgtcttctttgctcaaattggcagacacaaaagcaaacaaacctgggatgaatctcctgcactttgttgcacaggaagcccaaaagaaagataccattcttctaaacttttcagaaaaattgcatcatgttcagaagactgctagattatctctggagaacacggaggcagaactgcacttgctgtttgtcaggacaaaatcactaaaagaaaacatccagcgggatggtgaactttgtcagcagatggaagattttcttcagtttgccatagaaaagctgagggaactggaatgctggaaacaagagctccaggatgaggcctacacccttatagattttttctgtgaagacaaaaaaaccatgaaactggatgaatgctttcagatatttagagatttctgtaccaaattcaacaaagcagttaaggacaaccacgaccgggaggcgcaggagctgaggcagctgcagaggctgaaggagcaggagcagaagcagcgctcctgggcaactggggagctgggggcatttggccggagcagcagtgagaatgatgtggagctgctgaccaagaagggtgcagagggcctgctccctttcctgcaccccaggcccatcagcccctccagcccctcctaccggcccccgaacacccgccgctcccgcctctccctgggtccctctgctgaccgggagctgctgaccttcttggagagctccaccggcagccctgaggagcccaataagttccacagcctgccccggagcagcccccggcaggcccggcccacgatagcctgcctggagcctgcagaagtgaggcaccaggactccagctttgcacacaaacctcaggcctcggggggccaggaggaggcccccaacccaccctcagcacaggcgcaccagcttgcagccgcccagcctgagaaccatgcctctgccttccccagagctcggcgccagggcgtcagtgtcctccgaaagaggtacagtgagccggtgagcctgggctcagcacagtcccctcctctctcgccattggctctgggaattaaggagcatgagctggtgacagggctggcccagttcaacctccagggttcccagggcatggaggagacctcccagctgactctgagtgacttcagcccgatggagctagagtctgtggggcataggggcccgcagtccctcagtgccagcagcagcagcctgacacccatgggcagagatgccctggggagtctcagcccagcgctggaggatggcaaggctgcccccgatgagcctggaagtgcagctttgggatctgtgggtagcagcgaccctgagaacaaagatcctagacctctgttctgcatctcggacaccaccgactgctcactgaccctggactgctcagagggaaccgactccagacccagaggcggggacccggaggaaggcggggaaggggatggctccatgtcctctggggttggagaaatgggggacagccaagtctcctccaaccctacatccagcccccctggggaggctcctgcccccgtctctgtggatagtgagcccagctgcaagggcggcctgcccagggacaaacccaccaaaaggaaagatgttgtagcaccaaagagaggctccctgaaagaggcgtctcccggggcctccaagcccgggagcgcccggcggagccagggggcagtggccaagtctgtgcggaccctgaccgcctcagagaacgagagcatgcgcaaggtcatgcccatcaccaagtccagcagaggcgccggctggaggcgaccagagctgtcatcccgggggccctcccagaatccccccagcagcacagatactgtgtggtcacgccagaactccgtgcggagggcctccacaggcgccgaagagcagaggctgccgcgggggagcagcggctccagcagcacccgtccggggagggacgttcccctgcagcccaggggttctttcaagaagcccagtgccaaaccactcaggaacctccccagacagaagcctgaggaaaataagacctgccgcgcccactccgagggccctgagagtcccaaagaagagcccaagaccccgtcagtgcccagcgtcccccacgaactaccccgtgtcccgagctttgcccggaacacagtggcctcctcctctcgaagcatgagaacagatcttcctcccgtggccaaagcccccggcatcactcggacagtgtcgcagcggcagctgagggtgaaaggggaccccgaggatgccgctcccaaggacagcagcactttgaggcgagccagcagtgcccgggcccccaagaagcgcccagagtctgcggagggtcccagtgccaacacggaggcccctctgaaggccagaggggctggggaaagggcctccctccgtcggaaggactccagtcggaccacgctggggagaatcctcaatcccttacggaagtgatgggtgcctgtcctctcctgcctcctgggattcagacggtgaagactgacttctgggacgaggatggggaaagaggcagcatgtctttgttacagataaagcagccactggtgccactgctagtgacgctgttgggatggcacagtccaggaggcctgtggactgcagcctgctgtgctgagccctgctgcagtccagcgtccagatggatgcacgttcactactgtgacggccgcacctcccccatgcaccccaccctcccccaaagcccggatcccgagaaagatttagtaggagtgtaaagtgacattcttatgaaacaagtcaaaaaagtttttttcaggccagtttttatatatcaaagactttctttttaatataaaaattagctaggtgcagtggttcatgcctgtaatccagcactttgggaggctaagatgagtggattgcttgagcctaggagttcgagaccagcctaggcaacatggagaaaccccgtctctatcagaaatacaaaatttagccgagtgtggtggcacatgcctgtggccccagccactctgaacgctgagatgggaaggtcacttgagcccaggaccccaccactgcactccagcctggatgacagagtgagaccttgtctcaaacaaaacaaaacaaaaatgaaatgttctagttttggttccttttgcagagtgaaatgcctcccaggaaaaaaatacatatgtatttttttgcgacagggtcgtgctcttgtctcccagactggactgcagtggcacaatcatagctcactgcagctttgacctcccagacccaagtgatcctcccacctcagcctccctcagagctgggactacaggcgtgcaccaccacgcctggttaattgtttttttttaatttatcttttgtagagatgggatctcactatgttgctcaggctgatctcgagctcctgggctcaagtgatcctcccacctcagcctcccaaagtgctgggattacaggtgtgagccaccacacttggccagtatatcctcagtatgaagatatttttatcttcctgtgttctctggcttcagagtttcacctgcccacacagggtccgttgctggcaactggacttccccataagccttgggtatcctgtgatgggctgtgtctccctgaagattgtctggcttgcccacttctccgtgcatgactctgggtgtgagtctgtctaggaacaggagggaaagttggactcagacagaaatcagatgcttccatgtattcagggcgcgcattgtgagcagtggagtatgagccttgagggcctcatggttgcagggcaggcttccctgcagatgggtggcagcccctggtagaatgctggatttctctggaatctagaagtgccatattttagtggaaaggcatcagggctgtttgacagtgtgcgtctttccaatcccatgttcctccattcgtgtgtctgttataaaactgagtgaaggctgctatgacctgtgttcactctggttacagggaggtgcaaaccattctgtctcccagcctttcttctctctttgtgtgctcccagcacttccttcttttctaacatggcctggagagagtctctctctccttgtctctgtctcttaataatagtttttaacgtggacatctcttccttggtacagtggtttttaaatactgagaagaaccaagtcaggttttttaaagcagactaaaagcatgaaattgctttcagaagaatgtatatcatcgggaaaagttcgggggcagagtgggggaatcaggctttattcaaaagaaacagttgaaaacatgggactttttctacccaatgcccatttcacgactcctctgagactaattgggaaacggggaaattcttggaattttttttttaagaaacttttttgtgttttttttaattttaggtcacttattagtgaaacctcattttagatctgacattggtagatagatggatttaggcaaatatgatgcgtttgtggggaatccacgtggttgacgttagaacctcccttctgcagactgttgcctgtcatctaagcgaattggaaatgctgagcttccataagtcagctgagttttaaaggtaaacgttatggctgaaatagtaaagcacctgaccacaaaacctcttgtaaaaacagccctgagtaggtatttccagggctccacaaagttgcttatgggaatcctgagctgcttttcaccatctcaagaagcctaagaagttatatatttaatcaggtagacaaaacagttcaaagcataaggtccatggtggtggaaaatggatgcaagtgattctaagtttgtggatttgtggatagcagagggatcgggacctcttggaggaaccctgggtaccaagctcccaggcccttcctctatcatggatgctgggtgactttgggaagtcaccacctcttcccaagcctgtttcccatatcacagatgtggggccatggcctcgatgatggtctccacaggtctttccacctctgtgagtccaagtcaggtcaatcagcaaggacccatctctgccctgggtcagctcctcagaaccaacccccagcatctctaaagcaaaagcctcacctcaagggctgctcagaagagagcaccttcagcatgagttgttgctggaagatctaataagctgtgtttcctgggaagtggtgctttacttagccctgtggacaacttctctatgcatctgtgtgagcagatgatcattgtattaccttttatcggtagtaagcttggaaaaataatttaagaatacaatggagaaatgtaaataagtatctatgtaaatttgtttaaaataaactgaatgtatttaatggtccatttatatgttcttttatgtaacatgtagtttaataaagttcctgtttatgagagtcatgtttcatctcagcttcttcc

SEQ ID NO: 3845 - DNA, 6583 bp, Homo sapiens
acaacggcgggaggctgcagcggtctgcgcgccgggagcgggggcgcgctggccgcgggtttggaagaggacagttgccctttattctggcggcagatagcagcaggtgaaaaagtgctacacaagtttgatgtttgtgtcttcttctccaaggccaagaaattatctccataggaggcaacagtactatgcatgttatgaattgtgtctccttggtcagtgataaagaaaatgggaatattgccacagcacctggattcatgattgggcagacacctcctccagcacctcctccacctcctcctccaccccctccatctccaccatgttcatgttcaagggaagagtgtccttcctcccctcctccacccccaccacctccacttcctggggagcctcccatcccacctcccccaccaggcctacccccaactactcacatgaacggctacagccaccttggtaagaaaaagcggatgagaagctttttttggaaaactattccggaggagcaagttcgaggcaaaaccaacatctggaccttggcagccaggcaggaacatcactaccaaattgatacaaagaccattgaggagctctttgggcagcaggaagacaccaccaagtcttcccttcctaggagaggaagaactttaaattcatccttcagagaagctcgagaagagattactattttggatgcaaaacggagcatgaacattgggatatttcttaagcaatttaagaagtctcctcggtccattgtagaagatattcatcaaggaaaaagtgagcattatggatcagagaccttgcgagaatttcttaagtttttgccagagtcagaagaggtaaagaagttaaaagcgtttagtggcgacgtgtcgaagctgtctctggcagattcctttctgtatggcttaattcaggtgccaaactattcacttcggattgaagccatggtgctaaagaaggaatttctaccttcttgctcttctctatatacagatataacagttttaagaactgctataaaagaactgatgtcatgtgaagagctacattcaatattacacttggtgctccaggctgggaatatcatgaatgcaggagggtatgccggcaatgcagtaggatttaaactgtcttctttgctcaaattggcagacacaaaagcaaacaaacctgggatgaatctcctgcactttgttgcacaggaagcccaaaagaaagataccattcttctaaacttttcagaaaaattgcatcatgttcagaagactgctagattatctctggagaacacggaggcagaactgcacttgctgtttgtcaggacaaaatcactaaaagaaaacatccagcgggatggtgaactttgtcagcagatggaagattttcttcagtttgccatagaaaagctgagggaactggaatgctggaaacaagagctccaggatgaggcctacacccttatagattttttctgtgaagacaaaaaaaccatgaaactggatgaatgctttcagatatttagagatttctgtaccaaattcaacaaagcagttaaggacaaccacgaccgggaggcgcaggagctgaggcagctgcagaggctgaaggagcaggagcagaagcagcgctcctgggcaactggggagctgggggcatttggccggagcagcagtgagaatgatgtggagctgctgaccaagaagggtgcagagggcctgctccctttcctgcaccccaggcccatcagcccctccagcccctcctaccggcccccgaacacccgccgctcccgcctctccctgggtccctctgctgaccgggagctgctgaccttcttggagagctccaccggcagccctgaggagcccaataagttccacagcctgccccggagcagcccccggcaggcccggcccacgatagcctgcctggagcctgcagaagtgaggcaccaggactccagctttgcacacaaacctcaggcctcggggggccaggaggaggcccccaacccaccctcagcacaggcgcaccagcttgcagccgcccagcctgagaaccatgcctctgccttccccagagctcggcgccagggcgtcagtgtcctccgaaagaggtacagtgagccggtgagcctgggctcagcacagtcccctcctctctcgccattggctctgggaattaaggagcatgagctggtgacagggctggcccagttcaacctccagggttcccagggcatggaggagacctcccagctgactctgagtgacttcagcccgatggagctagagtctgtggggcataggggcccgcagtccctcagtgccagcagcagcagcctgacacccatgggcagagatgccctggggagtctcagcccagcgctggaggatggcaaggctgcccccgatgagcctggaagtgcagctttgggatctgtgggtagcagcgaccctgagaacaaagatcctagacctctgttctgcatctcggacaccaccgactgctcactgaccctggactgctcagagggaaccgactccagacccagaggcggggacccggaggaaggcggggaaggggatggctccatgtcctctggggttggagaaatgggggacagccaagtctcctccaaccctacatccagcccccctggggaggctcctgcccccgtctctgtggatagtgagcccagctgcaagggcggcctgcccagggacaaacccaccaaaaggaaagatgttgtagcaccaaagagaggctccctgaaagaggcgtctcccggggcctccaagcccgggagcgcccggcggagccagggggcagtggccaagtctgtgcggaccctgaccgcctcagagaacgagagcatgcgcaaggtcatgcccatcaccaagtccagcagaggcgccggctggaggcgaccagagctgtcatcccgggggccctcccagaatccccccagcagcacagatactgtgtggtcacgccagaactccgtgcggagggcctccacaggcgccgaagagcagaggctgccgcgggggagcagcggctccagcagcacccgtccggggagggacgttcccctgcagcccaggggttctttcaagaagcccagtgccaaaccactcaggaacctccccagacagaagcctgaggaaaataagacctgccgcgcccactccgagggccctgagagtcccaaagaagagcccaagaccccgtcagtgcccagcgtcccccacgaactaccccgtgtcccgagctttgcccggaacacagtggcctcctcctctcgaagcatgagaacagatcttcctcccgtggccaaagcccccggcatcactcggacagtgtcgcagcggcagctgagggtgaaaggggaccccgaggatgccgctcccaaggacagcagcactttgaggcgagccagcagtgcccgggcccccaagaagcgcccagagtctgcggagggtcccagtgccaacacggaggcccctctgaaggccagaggggctggggaaagggcctccctccgtcggaaggactccagtcggaccacgctggggagaatcctcaatcccttacggaagtgatgggtgcctgtcctctcctgcctcctgggattcagacggtgaagactgacttctgggacgaggatggggaaagaggcagcatgtctttgttacagataaagcagccactggtgccactgctagtgacgctgttgggatggcacagtccaggaggcctgtggactgcagcctgctgtgctgagccctgctgcagtccagcgtccagatggatgcacgttcactactgtgacggccgcacctcccccatgcaccccaccctcccccaaagcccggatcccgagaaagatttagtaggagtgtaaagtgacattcttatgaaacaagtcaaaaaagtttttttcaggccagtttttatatatcaaagactttctttttaatataaaaattagctaggtgcagtggttcatgcctgtaatccagcactttgggaggctaagatgagtggattgcttgagcctaggagttcgagaccagcctaggcaacatggagaaaccccgtctctatcagaaatacaaaatttagccgagtgtggtggcacatgcctgtggccccagccactctgaacgctgagatgggaaggtcacttgagcccaggaccccaccactgcactccagcctggatgacagagtgagaccttgtctcaaacaaaacaaaacaaaaatgaaatgttctagttttggttccttttgcagagtgaaatgcctcccaggaaaaaaatacatatgtatttttttgcgacagggtcgtgctcttgtctcccagactggactgcagtggcacaatcatagctcactgcagctttgacctcccagacccaagtgatcctcccacctcagcctccctcagagctgggactacaggcgtgcaccaccacgcctggttaattgtttttttttaatttatcttttgtagagatgggatctcactatgttgctcaggctgatctcgagctcctgggctcaagtgatcctcccacctcagcctcccaaagtgctgggattacaggtgtgagccaccacacttggccagtatatcctcagtatgaagatatttttatcttcctgtgttctctggcttcagagtttcacctgcccacacagggtccgttgctggcaactggacttccccataagccttgggtatcctgtgatgggctgtgtctccctgaagattgtctggcttgcccacttctccgtgcatgactctgggtgtgagtctgtctaggaacaggagggaaagttggactcagacagaaatcagatgcttccatgtattcagggcgcgcattgtgagcagtggagtatgagccttgagggcctcatggttgcagggcaggcttccctgcagatgggtggcagcccctggtagaatgctggatttctctggaatctagaagtgccatattttagtggaaaggcatcagggctgtttgacagtgtgcgtctttccaatcccatgttcctccattcgtgtgtctgttataaaactgagtgaaggctgctatgacctgtgttcactctggttacagggaggtgcaaaccattctgtctcccagcctttcttctctctttgtgtgctcccagcacttccttcttttctaacatggcctggagagagtctctctctccttgtctctgtctcttaataatagtttttaacgtggacatctcttccttggtacagtggtttttaaatactgagaagaaccaagtcaggttttttaaagcagactaaaagcatgaaattgctttcagaagaatgtatatcatcgggaaaagttcgggggcagagtgggggaatcaggctttattcaaaagaaacagttgaaaacatgggactttttctacccaatgcccatttcacgactcctctgagactaattgggaaacggggaaattcttggaattttttttttaagaaacttttttgtgttttttttaattttaggtcacttattagtgaaacctcattttagatctgacattggtagatagatggatttaggcaaatatgatgcgtttgtggggaatccacgtggttgacgttagaacctcccttctgcagactgttgcctgtcatctaagcgaattggaaatgctgagcttccataagtcagctgagttttaaaggtaaacgttatggctgaaatagtaaagcacctgaccacaaaacctcttgtaaaaacagccctgagtaggtatttccagggctccacaaagttgcttatgggaatcctgagctgcttttcaccatctcaagaagcctaagaagttatatatttaatcaggtagacaaaacagttcaaagcataaggtccatggtggtggaaaatggatgcaagtgattctaagtttgtggatttgtggatagcagagggatcgggacctcttggaggaaccctgggtaccaagctcccaggcccttcctctatcatggatgctgggtgactttgggaagtcaccacctcttcccaagcctgtttcccatatcacagatgtggggccatggcctcgatgatggtctccacaggtctttccacctctgtgagtccaagtcaggtcaatcagcaaggacccatctctgccctgggtcagctcctcagaaccaacccccagcatctctaaagcaaaagcctcacctcaagggctgctcagaagagagcaccttcagcatgagttgttgctggaagatctaataagctgtgtttcctgggaagtggtgctttacttagccctgtggacaacttctctatgcatctgtgtgagcagatgatcattgtattaccttttatcggtagtaagcttggaaaaataatttaagaatacaatggagaaatgtaaataagtatctatgtaaatttgtttaaaataaactgaatgtatttaatggtccatttatatgttcttttatgtaacatgtagtttaataaagttcctgtttatgagagtcatgtttcatctc

SEQ ID NO: 3846 - DNA, 6418 bp, Homo sapiens
atgcagaggtcactaggaaggaaagcctgctgaacacagattcaattttctagcagaactccaggtcctctgagttaaaggaagcatttatggacgcttagcagggcccagatattcactattaagtgtccaggaaggatctttcttatataaaggtgcttctgaggacttccagagttacaatggaggaggaatcgggggaggaactggggctggacaggtctactcccaaggatttccacttttaccacatggacctgtatgactctgaagacagactgcacctctttccagaagagaacactaggatgaggaaagtagtccaagctgaaatggccaatgagtcaagaggagcaggggatggtaaggctcaaagagaccttcaagaggaagtggatgaacttgtccacttatatggacttgaagatgatcatgaattaggggatgagtttgttgatgaaaacatacccagaacaggggtttcagaatatcctccttatatgatgaagaggagagacccagccagggagcagagagactggagacttagtggagaggcagcggaggccgaggacctgggcttcggagggtggggctcagcaggccagtgccaggacttgcgggaagcctataggtacacacacggccgtgccagcgaggagtatgaatgctatgtcatccccgaggaagaggatgaagaagaagctgctgatgtcttctgtgtcacttgtaagactccaataagagcttttcagaaggtttttgatgaacataaggagcatgaagtgatcccactcaatgaagcactggaaagtgccaaggatgaaattcacaaaaacatgtacaaattggaaaagcagataattgagatggaaaactttgcaaatcatttggaggaggttttcatcactgtggaggagaattttggaaaacaagaacaaaactttgagtcacattacaacgagatcttggaaacacttgctcaaaaatatgaggaaaaaatacaagctctaggggagaaaaagaaagagaagctggaagccttatatggacaactggtcagctgtggagaaaacctagatacttgcaaagaactgatggaaacaatagaggagatgtgtcacgaggagaaggtggatttcataaaggatgcagtggctatggctgacagactcgggaaattcctgaaaacaaaaacagacgtggaaatctctgcacagcctgagtttgaagaccagaccttggatttctctgatgtggagcagctgatgggctccattaacaccattccagctccttctgctccagtcataaatccacaggtccctaactcagccacaggttcctcagtccgagtgtgctggagcttatactccgacgacactgtggagagctatcagctgtcctaccggccagtgcaggacagctcacctgggacggaccaagcagagtttacagtgactgtcaaagaaacatattgctcagtgacaaaccttgtgccaaatacccagtatgaattttgggtcacagctcacaacagggctggccccagcccctctagcgagcgtgcagtgtacatgacagcaccttctccccccattattaaaaccaaagagataaggagctgtgaagaggctgtgctgatttgctgggagtctgggaacctgaatcctgtggactcgtacactgtggagctgacccaggctgaaagtccagaagcctcgggtgtaactgagtctgttgtgggcatcccgacctgcgagtccgtggtgcagctgcagccggggcggagctacattatctatgtgcgagccctcaatatggggggccccagcgtgaggagcgagccagctacagtccacaccataggaagctactttcgcctaaacaaggacacttgccatccctggctgaccatttctgaagacggacttacggctgtacgaagtgaaaggagaacccccgccagggagctgtcacccagcgacactcacttcaccaggtgtgttgctgtcatgggaaatctaattccagtccgagggcaccattactgggaggtggaggtggatgagcatttggactacagagttggtgtggcctttgcagatgtccgtaaacaggaggatctgggagcaaattgcctctcctggtgcatgaggcacacatttgcatcatcaaggcataagtatgaatttctgcacaacagaacaactccagatataagaataacagttccaccaaagaagattggcattctattagactatgaacattcaaagttgtcatttttcaatgtggacctttctcagcatctatatacatttagttgtcagcttcacgaatttgtgcatccctgtttttctttggaaaagcctgggtgtctaaaggtacataatggcatttcaatgccaaaacatgtcactttctattagaacattctgatgtccagtttcctgtcttccatgcctacccctctcgcagctgctcacgccttagctggctgaacctggcacttaagcaccatgtgcccagcacaatttatggctcatgctattatctgactggtgtgctagcgctcatttcacccaacctggattctagtcctgtgtgctgctacctgtgtgctgctaggatagtcattaccaggcccagctgtaaaataaaggctcagactaaacgaactcaaaagtctttgaagctgtcaaactatattcgtgtatatgcaaaatatcttgagtttccaagacctagagagcttgggagaggacgagggtagtcttaatggctccagcagcaccagtacacccatgcatttcatgagtcagccaagaatacacttgagaaggcgagaggctgtctgtagagaaccagggaagctgtgtgcccttctcaatgtcttctaccctcgttttcccaatagtgagcagcactgtggtgaggtcccttccactgtgtactctgcatacagggtattccctgttccactcctacacagtatgcaccactctctaattttgaaattacctctataatgcctaattccatgaagggagggacagtgcctgttttgttcattgctagatcaccaagggctaacacataacagctgtcaccaagtatttgttgaataaattagtatcttcttcagccactgctctttggcctcttactgctctccatgtgaaggatggcagggctctttcaaaactacagcaaaggacctatggccaagaaatgggaaaaaacctagaatggaggcagcgtgaaagaacagaagggcatctgtggcatattagcaaatgcacaacaattttttaaaagaaattaacagcccaccaaagggcaaagctgagcacgggaaggaagactgatctctagctaggcagctttcaggcatcctgcctcactgcccccaggccattctgtgagctcaatgcccaactccatcagctacattcctggttctcctgttcaagtttccagttgccacttaagctctgcacacacagcattttcaaagcttgtgagtgaagctgcagaataattccatttgtgaagcaattacaattcagtatcatgtcccacagatgcctctaaacccagatatgccctaatctcatcatttaaggttttgtgtttaaaaaaaaaaagtccacttttcttttttctggcgaaaccccgtctctactaaaaatacaaaaaattagccgggcatggtggtgggcgcctgtaatcccagctactcaggaggctgaggcaggagaattgcttgaacccgggggcagaggctgcagtgagccgagattgtgccactgcactccagccttggcaacaagagcgcaactctgtctcaaaaacaaacaaacaaacaaacaaaaaacctctgatgttttccagcacctgcaaagtctgacaaactgaaagactctcatctcctactaaactctgcctactcgtataaatggcagctcagattcctgaattaacaattcacactgacaatttaataactcgttatacacacacacacctatcctgccaagctggactgtctactctgaaacaagggacagcagatgtaagcacagaaatagttccagttataaacaattaaaagatacatatcatgtatatttaaaaatgttctcggccgggcgcggtggctcacgcctgtaatcccagcactttggggggccaaggtggatggatcacaaggtcaggagatcgagaccatcctggctaatacggtgaaaccccgtctctactaaaaatacaaaaaaattagccgggactggtggcgggcgcctgtagtcccagctactcgggaggctgaggcaggagaatggcgtgaacccgggaggtggagcttgcagtgagccgagatggctcacagatcaagactccatctcaaaaaaaaaaaaaaaaaaagttctcagctactgaaatagaaactaccaagtaagaaacaggatatcacagagaaggcaagtttgaattcagggttctaataggctttatggaatactacacgttagtatgaacacggataaatggattaaaaactcaacacgtataaagttttaattaaatttttatttgaccaagaaaaaactgtctagaattgcctgacatttaaaatccacttaaagcagattagcaacttcaagcatcacaattattcagcataaagagcctttgttgaaacatctttctcatttatttagaagaaaacatctagaacagaaccaagcaaaacttttgtatttttgtaaaaaatctcaattcctgaaactactataaacaatctactgaaactgtattcagcaagggacagatttacctcaaggccatgttcacctgcaacctgctgataagtctgttaaaaaacaaagcaaaaaaaagagtttttaaaaattagaccactgtagccacaatccctaacactggacagttaaaacaaaagttatcaaaatctgttcttttcttagctttacctgtatcactttataactcctgagaaagtcattcacataagctgtggcctccccaccttaacaaaggggaaaaagaatatgtaaaaccaccacagaatcttggcgtaaactaacatgggtttagtaatacagagtacagtattcaggatttaaggcacccttacaagtcagaattggaaagttggtttgagacttgcaatctaaaatgacactgatttctgataaaattaaatgacttttatttagaaaagtgtgtttaataaattacttcctgctggttcaaatgacacacaatcactttgtatacatccaataagatatttctgaagtgtatacttggtcaaaagtaaaaagcagagcaaatgcatggacagtggggccttcttcttaatacttctcatcctccaaaatctgttaaaatcatcatcttccacaactcacacactggaagctgtccacagcacaattcactgtgatgtggcattctgtaaataagactacattggtcttgatgcaaggcggttcagctaccagactgcactataagaaaagtcctctcctcaacttaccaagaaaacttcgccaatttctagtcaccttcctatcaattagtagagcaagattctcacatgttcactatgtctttctccagttttctcatctataagtgtactactcctattttctataggaagacaatggaaagcgtgtaattgctgttggtagataagtaggtcttgaatttattttgcaaacaagacctgttctatctaccttttcatttaggaggctaaaagcagagtcagcttgatttcaaggactctattttcttagtctccagaagaacataaccaaatccagcttttaaaacactgtcctttaacaagtcaagatactcaaataaagatcatgtataacttcaagctataggagattaactctgtacatatgcttgtttcactgtaaccaatggttaattaatctaaatgcaagagaaaagttatttggaaagaagaccccagctggtcagcatcttttctgtcatcaggaagtctcctggaaggagtatgactatgacctgggcacaacaactgcccctaagttagtacttattttagagttgctactgaacaggtggtggttcttgtcaagtatatcatgtctgactactttactgcttgttttctgctatcaccagttccagaaaaaaaaaaaaaaaaaattaagcccaactcactaattgattgctttttcattttcccagactgtgacagaatcatggtttttagctctattttcaccttactcaaatcctggaggaattaaactatcatttatttgaaatgttacaaattagcctgcagttgattcaaacaacatgtagtcactcagacatagcaaataaaaatgttttggtatatgaa

SEQ ID NO: 3847 - DNA, 603 bp, Homo sapiens
catgcagaggtcactaggaaggaaagcctgctgaacacagattcaattttctagcagaactccaggtcctctgagttaaaggaagcatttatggacgcttagcagccactggggaccagctctggccaggacaattccgtttgccatgatgtgggttgaaatcacaacttctcccgggcgcagtggctcacgcctctaatcccagcactttgggaggccaagggcccagatattcactattaagtgtccaggaaggatctttcttatataaaggtgcttctgaggacttccagagttacaatggaggaggaatcgggggaggaactggggctggacaggtctactcccaaggatttccacttttaccacatggacctgtatgactctgaagacagactgcacctctttccagaagagaacactaggatgaggaaagtagtccaagctgaaatggccaatgagtcaagaggagcaggggatggtaaggctcaaagagaccttcaagaggaagtggatgaacttgtccacttatatggacttgaagatgatcatgaattaggggatgagtttgttgatgaaaacatacccagaacaggggtttca

SEQ ID NO: 3848 - DNA, 1336 bp, Homo sapiens
ctctctgcttctggtcagctgggttgtcctgcatggtgacgggtgtcatcccgaacaaatcagatggcatcagaggcactccatcaagtgggagatggggaggaggctgtactgaagaaagaaaacttcaacatgatgaatgcccttgaccaactgccaaaacccttttcaaaccccaagtctatgaaccggaccgtcactaccaaaggactcccactagcctcaaagggcaatttggtcaacttcttggaggatgataccatcaacctactgaagccgctgccagtagaggattcagactgcagctctgatgagaccagcatctctgccttctcatccaccttgctgaaccccatcaaattagctgtgacccagcccaacagcagcttctttgcagggatgctggagggggagctgaacaaactcagcttctccccaatggccaagaatgcagaaaatgaggacctggcgctcggcccctgcccatgcccatcgaagtcccagatggccacaaggggcctgctggaccttgacaaccctgagctggagacagaaacctcctcaacgcactcagaatcttctgtggttgtggacctgccggacacccccttcatctttgagcacaccgtcaacaattccacagctgtgatttcctggacctacgccttgggcaagcagccggtcagtttctaccagctcctgttacaggaggtggccaagacacaggagaatgagttgcccgaggcaaagaatcgtccatggatcttcaacaagattttgggcactactgtcaagctgatggagctaaagcctaacacgtgttactgcctcagtgtccgtgcagccaacacagctggggtggggaagtggtgcaagccctacaaatttgcaaccctggccactgacttcagcagctttcctgagaactaccccatccagatcaccgtgcggcgcaaggaaccccggcaaaagatcgtgtccatcgggccggaggagatgcggaggctggaggatctggaatacctatttccctgttaagggggagggccccaggacacccctcacctactttcagcttcaaccccaggccctcagaaaccagagccatgagacctaccataccaccagcaccctgcgggcccggggtctggcagagtggtatgggcaccccacccctgggctggggccaaggctacataggggccccattcacctggaggcatctcaggccaggccatgccaggctcagccactgcccacagctgctagactccctcctcctccaaatctgggctgggtctaggtccctcattaaagaactgcaggtcatccagca

SEQ ID NO: 3849 - DNA, 2811 bp, Homo sapiens
ccccacccctgctgcaggtgccagggcaccctggggcctcagccgctaacgccctttctgagcaggacctgatcggccaggacctgaactctcgctacctgaatgcccagggtggccctgaggtggtgggggcagggggctcggcccggcccctggccttccagttccaccagcacaaccaccagcaccagcacacccaccagcacacccaccagcacttcaccccttatcccccgggcctgctgccaccccacggcccccacatgtttgagaaatatccaggaaagatggaaggccttttccgacataatccgtacacggccttccctcccgcagtgcccgggctgcctccgggcctcccgccggccgtctcctttggctccctgcagggggccttccagcccaagagcacgaaccctgagctgccaccacgactggggccggtgccgagcgggctctcccagaaggggacacagatccccgaccatttccggccacctttgaggaaaccagggaagtggtgtgccatgcacgtgcgtgtggcttacatgatcctgagacaccaggagaaaatgaagggtgactcccacaagcttgactttcggaatgacctcctgccctgccttccggggccctatggggccctgccccctgggcaggagctctcccacccggcctccctcttcactgcgactggtgccgtccacgctgcagccaaccctttcacggcagctcccggggcccacggacccttcctgagccccagcacccacattgatccctttgggcgtcccacaagcttcgcctctttggctgccctctccaacggggcctttggaggcctgggcagccccacattcaactccggcgccgtctttgcccagaaagaaagcccaggggccccaccagccttcgcctccccaccggacccatggggccgcctgcaccgcagtcctctgacctttcctgcctgggtccggccccctgaggccgcccggactccaggctcagacaaggagcggcctgtggagcggagggagccctccatcaccaaggaggagaaggacagggacctccccttctcacggccccagctccgagtttctcctgctactcccaaggcccgggctggtgaggaggggcctcggccaaccaaggaatctgtgcgggtaaaggaagagcggaaggaggaggctgccgccgccgctgccgctgctgctgccgccgccgctgccgccgccgcagcagccactgggccccagggccttcacctgctgtttgagaggccccggccgcccccgtttctgggccctagcccaccagatcgctgtgctggcttcctggagccaacctggttggcagcacccccacgcctggcaaggccaccccgcttctatgaggcgggtgaggagctaactggacccggggccgtggccgctgcccgcctctacggtctggaacctgctcaccccttgctctacagccgcttggctcctccaccaccacctgctgcggccccgggaacccctcaccttctcagcaagaccccaccgggagcccttttgggggcaccacctccgcttgtgcccgccccccggcccagttccccacctaggggccctggcccagctcgggctgacaggtgaggggaacgggggggggtcggggcaaagctccatctccccttcctttaaccaggtcctagggctgaggttttaagccagggctggagggcaaaggtcataacctcaccagccacctctgaggtcatggaacctgggaacagaagcctcaacccccacaagaccaagcatcacatggagtgtagggtcactgggagagcagaggtcacagcctctagagaagggagaggggcgtgtgcatgggagtgtggctcatctcgggggccatggggcctcctgaggtacacctttgcccctgtaagggcctctaggccctgggcctgcctccccaagggctcactaagccagaggccaaagtgccccctcccgttcacctaccacccaagtcctcatgccctccgagggctgggggaggaggggctcaaggaaggggggttccatgtacatatttatcacccctttcacatagccccaagaccttttgtacatttttacaggggtgcccctcccaacagttcccttcctggttaattaaaccctcagactggtgctgtgttcctagcctctggcctctctgtggggaaaggggactgcagggggaagagccgggaagggacagtcaggcttctccctgggaaggtggggccagcaggagatgaccaacagggggcaggacctggggacctgggctggagggaagggcagaagcttcctacttggctgacagccccggttcccccaacatgttcccgttcactctgcccccacccccaaaggctcagcctctaaatctcagactccaccacctcttaatggctcagtccccttcaccccatttccaagtgcccccaggactcctgggccctgcttccctgaaccctgttctccaaaaccctgccccaggctaagggtggccagagaaggtcaccatgtaccacacaccaaagaagggggtcggcccaggggtgggcgacacaggcagcttcttcggcagcctcacggcagcaaccccagccttcccaaagcagcaggcgcctccaggctggggcccaacctagaaggcaggggtcaatctaacaaaaccctaacgttgacttttttccctggtggggcttcttctgtaacatgacttgcgaatatttatataaaaacgagtgttacaatgaga

SEQ ID NO: 3850 - DNA, 1727 bp, Homo sapiens
ccccacccctgctgcaggtgccagggcaccctggggcctcagccgctaacgccctttctgagcaggacctgatcggccaggacctgaactctcgctacctgaatgcccagggtggccctgaggtggtgggggcagggggctcggcccggcccctggccttccagttccaccagcacaaccaccagcaccagcacacccaccagcacacccaccagcacttcaccccttatcccccgggcctgctgccaccccacggcccccacatgtttgagaaatatccaggaaagatggaaggccttttccgacataatccgtacacggccttccctcccgcagtgcccgggctgcctccgggcctcccgccggccgtctcctttggctccctgcagggggccttccagcccaagagcacgaaccctgagctgccaccacgactggggccggtgccgagcgggctctcccagaaggggacacagatccccgaccatttccggccacctttgaggaaaccagggaagtggtgtgccatgcacgtgcgtgtggcttacatgatcctgagacaccaggagaaaatgaagggtgactcccacaagcttgactttcggaatgacctcctgccctgccttccggggccctatggggccctgccccctgggcaggagctctcccacccggcctccctcttcactgcgactggtgccgtccacgctgcagccaaccctttcacggcagctcccggggcccacggacccttcctgagccccagcacccacattgatccctttgggcgtcccacaagcttcgcctctttggctgccctctccaacggggcctttggaggcctgggcagccccacattcaactccggcgccgtctttgcccagaaagaaagcccaggggccccaccagccttcgcctccccaccggacccatggggccgcctgcaccgcagtcctctgacctttcctgcctgggtccggccccctgaggccgcccggactccaggctcagacaaggagcggcctgtggagcggagggagccctccatcaccaaggaggagaaggacagggacctccccttctcacggccccagctccgagtttctcctgctactcccaaggcccgggctggtgaggaggggcctcggccaaccaaggaatctgtgcgggtaaaggaagagcggaaggaggaggctgccgccgccgctgccgctgctgctgccgccgccgctgccgccgccgcagcagccactgggccccagggccttcacctgctgtttgagaggccccggccgcccccgtttctgggccctagcccaccagatcgctgtgctggcttcctggagccaacctggttggcagcacccccacgcctggcaaggccaccccgcttctatgaggcgggtgaggagctaactggacccggggccgtggccgctgcccgcctctacggtctggaacctgctcaccccttgctctacagccgcttggctcctccaccaccacctgctgcggccccgggaacccctcaccttctcagcaagaccttttgtacatttttacaggggtgcccctcccaacagttcccttcctggttaattaaaccctcagactggtgctgtgttcctagcctctggcctctctgtggggaaaggggactgcagggggaagagccgggaagggacagtcaggcttctccctgggaaggtggggccagcaggagatga

SEQ ID NO: 3851 - DNA, 2919 bp, Homo sapiens
atggaggccaaggaggaggaggtcatcgacggcttcgccatcgccagcttcagcaccctggaggccctggagaaggatatggccctgaagccacatgagcggaaggagaagtgggagcgtcgtctcatcaagaagccccgggagtcggaaacctgcccccctgcggagcccagtgagaacaggcggcccctggaggcaggcagccccgggcaggacctcgaacccgcctgcgatggggcgagaaaggtcccactgcagccctccaagcagatgaaggtcaccgtgtccaaagggggcgaccgggacagtgacgacgacagcgtcctcgaagccaccagctcccgggacccgctcagcgatagctctgcgcatgcggtctcggggagaggctactcttgtgacagcgagagcggcccggacgacaaggcatccgtgggctctgagaagctctttgcgccgggaaccgataaaggcccagcgcttgagaagtcggaggccaaggccgggccggtgcccaaggtgtcaggcctggagcgcagccgcgagctcagcgccgagagcttcctgcccactgccagccccgcgccccatgccgcgccctgcccggggcccccgcccggctcccgcgccaatcccttggtgaagaaggaaccccccgccccgcaccgccacaccccgcagccgccacccccgcagccccgcggcctgctcccgacacacgtgcctgcatccctgggcgccttcgcgggccacagccaggcggcagccaacggcctgcacggcctcagcaggagcagcagcgcccccctgggcctggggaagcacgtgtcgctgtcgccacacgggccgggcccccacctgtctacctcacacctggcgctccggtcccaggcgcagcaccagctccacgcggccatgtttgccgcacccccgacactgcccccgcccccggcgctgccggccagcagcctggtcctcccaggacacccggccgatcacgagctgctcaggcaagagctgaacacgcggtttctggtgcagagcgccgagcggcctggcgcctccctgggcccgggggctctgctgcgggcggagttccatcagcaccagcacacacaccagcacacgcaccaacacacacaccagcaccaacacacattcgcccccttccccgcagggctgcccccgacgccgcccgccgcacccccgccgtttgacaagtatgcgcccaagctggacagcccctacttccgacattccagcgtgagtttcttcccgtccttccctcctgccatcccgggactgcccaccctgctcccacaccccggccccttcgggtccctgcagggcgcttttcagcctaaggtgtctgacccgtaccgggcggtggtcaaggtgagcacgtgttgggaaggcccgtggcaagggaggactctggtgcccccggggcggcctcggggggcccgtgacagcaggagtctgcagaaaacatgggtgggggtggcaccagccccactgagcgcttccatcctgtcgcagaagccggggaggtggtgtgccgtgcacgtgcagatcgcctggcagatctaccgtcaccagcagaagataaaggagatgcagctggacccccacaagctggaggtgggtgcaaagctggacctgttcggcagaccccctgccccgggcgtgtttgcaggcttccactacccacaggacctggcccggcccctcttccccagcacaggtgccgcccatcctgcctccaacccatttggaccctcagcccatcctggcagcttcctgcccactggccccctgacagaccctttcagcagaccgagcacctttgggggcctgggcagcctgagcagccacgcctttgggggcctgggcagccatgcactggctcccggtggcagcatctttgcccccaaggagggctcctccgtgcacggcctgcccagcccccatgaggcctggaaccgactgcaccgggcaccgccctccttcccggctccgcccccgtggcccaagtccgtggacgcggagcgggtgtcagccctgaccaaccatgaccgagagccggacaatggcaaggaggagcaggaacgggacctcctggagaagacgcgcctgctgagccgggcctcgcccgccacccccgctggccaccccgtcagcggcctcctgctccgggcccagagcgagctgggccggtccggggcccccgcggagcgcgaggccgaacctcgggtcaaggagagccgctccccggccaaggaggaggccgccaagatgcccgcgcgcgcatccccgccccacagcaaggcggcccctggagacgtgaaggtcaaggaggagcgcggggaggacgaggcctccgagcccccggcgggcggcctgcaccccgcgcccctgcagctcggcctgggccgcgagcgcctgggcgcgccgggcttcgcgtgggagcctttccgcggcctggagctgccacgtcgcgccttccccgctgccgcccccgccccgggctccgccgccctcttggagcccccggagcgcccctaccgcgaccgcgagccccacggctacagccccgagcgcctgcgcggggagctggagcgcgcgcgggccccgcacctgccgcccgccgcccccgccttggacggcgcgctgctgccctcgctgggagccctgcacttcccgcgcctctcgcccgccgcgctgcacaatgggctcctggcgcggaccccgcccgccgccgccgccctcggcgcaccgccccccctggtgacggcggccgggccccccacgccccccgggccgccgcggagccggactactccgctggggggcctcgggccgggcgaggcgcgcgactactccccgtcccgaaatcccccggaggtggaggcgcggtag

SEQ ID NO: 3852 - DNA, 5568 bp, Homo sapiens
ctggccgaggaccctcccccggtcctccccgccccttccccgtcccttccacgctcgccgagggcaggacttcggttccgcgagaccggaggcccctcgtcctcctcggaagccgcccgcggccggggaccccagtcccgcagaggagggcggcgctgcccccgcctcccgcttggagagcgccgcccgcaggtgcccacggaggggccgcggcatcccagcgccctcccaggaaggagccgagcggatcaccgccggctgcagcggaggtcggggcgccggggaggggcgcggctagggggcgaggtcgaagggcgggcacctgcgggtggggcggggcctgaattagcgggagcgcccgggaggggcggggccggggcctgcgtgagcgggtcggggagggggcggagcctgcggggggcggggcctgcgtgaatggggcggggaggggccggagccttgtgagcggggcgggccgcgtgtgcggggtgggggcggagccttatgagcggggcggggcaggggcgtggtcggggcggggcgcgcgggcgcccgcggcggccctcacttcctctggcgagcgcagccgggcggaagtgcgtcagttgttatctgttcggggcgccgccgccgcctcacgagcccggtgcccaggagcccggccgcctcccgcctgccgcctgccgcgcccgcccggccccgcccgctcggcccgatcgccgcgccgcgcgcatggggcgcgcccccgggggggcggccgagggccgctgagcgccgggcccgcccccgccgatgcgcccagccgcccgcgccgggggtcccaggccgcgccgggcccggggctgagccgccccccgcgcccggcatgcccggcccggcccgccgcccgccgccgcccagggcccgagcccgcgcggcgcacactcagcccggcggcgccgcgtagccgagggagcccgcctgctgcgagccaggcgcggggcgtcaaggtcaccggcccgacggggcgcacgcgcggccatggaggccaaggtccgcccgagccggcgctcgcgcgcgcagcgggaccgtggccggcgccgggaggccgcccgcgacgcccgcgcccagagtccgtcgtcgggcgacgagcccgagcccagccccggcaaggagaacgcgggcctccgcggcgcgcccccccgaggcgccgcccccgcgccccgcaccgcgcgtcccccgcgccgccgccgccgcgagtccagctcgcaggaggaggaggtcatcgacggcttcgccatcgccagcttcagcaccctggaggccctggagaaggatatggccctgaagccacatgagcggaaggagaagtgggagcgtcgtctcatcaagaagccccgggagtcggaaacctgcccccctgcggagcccagtgagaacaggcggcccctggaggcaggcagccccgggcaggacctcgaacccgcctgcgatggggcgagaaaggtcccactgcagccctccaagcagatgaaggtcaccgtgtccaaagggggcgaccgggacagtgacgacgacagcgtcctcgaagccaccagctcccgggacccgctcagcgatagctctgcgcatgcggtctcggggagaggctactcttgtgacagcgagagcggcccggacgacaaggcatccgtgggctctgagaagctctttgcgccgggaaccgataaaggcccagcgcttgagaagtcggaggccaaggccgggccggtgcccaaggtgtcaggcctggagcgcagccgcgagctcagcgccgagagcttcctgcccactgccagccccgcgccccatgccgcgccctgcccggggcccccgcccggctcccgcgccaatcccttggtgaagaaggaaccccccgccccgcaccgccacaccccgcagccgccacccccgcagccccgcggcctgctcccgacacacgtgcctgcatccctgggcgccttcgcgggccacagccaggcggcagccaacggcctgcacggcctcagcaggagcagcagcgcccccctgggcctggggaagcacgtgtcgctgtcgccacacgggccgggcccccacctgtctacctcacacctggcgctccggtcccaggcgcagcaccagctccacgcggccatgtttgccgcacccccgacactgcccccgcccccggcgctgccggccagcagcctggtcctcccaggacacccggccgatcacgagctgctcaggcaagagctgaacacgcggtttctggtgcagagcgccgagcggcctggcgcctccctgggcccgggggctctgctgcgggcggagttccatcagcaccagcacacacaccagcacacgcaccaacacacacaccagcaccaacacacattcgcccccttccccgcagggctgcccccgacgccgcccgccgcacccccgccgtttgacaagtatgcgcccaagctggacagcccctacttccgacattccagcgtgagtttcttcccgtccttccctcctgccatcccgggactgcccaccctgctcccacaccccggccccttcgggtccctgcagggcgcttttcagcctaaggtgtctgacccgtaccgggcggtggtcaaggtgagcacgtgttgggaaggcccgtggcaagggaggactctggtgcccccggggcggcctcggggggcccgtgacagcaggagtctgcagaaaacatgggtgggggtggcaccagccccactgagcgcttccatcctgtcgcagaagccggggaggtggtgtgccgtgcacgtgcagatcgcctggcagatctaccgtcaccagcagaagataaaggagatgcagctggacccccacaagctggaggtgggtgcaaagctggacctgttcggcagaccccctgccccgggcgtgtttgcaggcttccactacccacaggacctggcccggcccctcttccccagcacaggtgccgcccatcctgcctccaacccatttggaccctcagcccatcctggcagcttcctgcccactggccccctgacagaccctttcagcagaccgagcacctttgggggcctgggcagcctgagcagccacgcctttgggggcctgggcagccatgcactggctcccggtggcagcatctttgcccccaaggagggctcctccgtgcacggcctgcccagcccccatgaggcctggaaccgactgcaccgggcaccgccctccttcccggctccgcccccgtggcccaagtccgtggacgcggagcgggtgtcagccctgaccaaccatgaccgagagccggacaatggcaaggaggagcaggaacgggacctcctggagaagacgcgcctgctgagccgggcctcgcccgccacccccgctggccaccccgtcagcggcctcctgctccgggcccagagcgagctgggccggtccggggcccccgcggagcgcgaggccgaacctcgggtcaaggagagccgctccccggccaaggaggaggccgccaagatgcccgcgcgcgcatccccgccccacagcaaggcggcccctggagacgtgaaggtcaaggaggagcgcggggaggacgaggcctccgagcccccggcgggcggcctgcaccccgcgcccctgcagctcggcctgggccgcgagcgcctgggcgcgccgggcttcgcgtgggagcctttccgcggcctggagctgccacgtcgcgccttccccgctgccgcccccgccccgggctccgccgccctcttggagcccccggagcgcccctaccgcgaccgcgagccccacggctacagccccgagcgcctgcgcggggagctggagcgcgcgcgggccccgcacctgccgcccgccgcccccgccttggacggcgcgctgctgccctcgctgggagccctgcacttcccgcgcctctcgcccgccgcgctgcacaatgggctcctggcgcggaccccgcccgccgccgccgccctcggcgcaccgccccccctggtgacggcggccgggccccccacgccccccgggccgccgcggagccggactactccgctggggggcctcgggccgggcgaggcgcgcgactactccccgtcccgaaatcccccggaggtggaggcgcggtagccccggggccgcagacgcctctccgagcggagcgcaccgctgtccgtctctccatcagttcctagaactcaagcacagctcccgccgatcctggggcggcgccgcctctccacccgcagcctgcggaggcggggacttgggtgtcggcttttctgagggtgatcttttgttttccgagtttgggattcggctgttgggaaaaaaaaatcgcgtttgtaccttttccccccacagatgagaagtgtttgtaatggatttgtatttttcttaattttatgctctttagacgtttaaaagaaccaaaaaagaaacttttgcttcttcgttttcggttgggatttgcagtttaatggcctcagatccttctccagatccccagggtttctttgtcttatttatggagaaaaaccggtcactttgtccagcgcactgtgaggcccccactcaggccagccctggcccccccttggtacttggaaccgaagttacagattatattaaaataataatgtacaaaactttgtttttttgccttattatgcagaagtgtaatttcttttttggtttgtttttttaaaagcaaacgaaacgtgtaaatagtctgttgatataaatatatgacgttactaaattcttaatctagatagactttataaaaaccgtttccagaaacccctctggttgtttgtctaacatggtcacaaaaacccaggcgctgctggctgtaaacattatcagaagtttaatggcagcaactttccttcaactatgcaagcgcttcccggcggctctgctggttgggggaggaaggttccgccagcgacctcccagcccctgggtccgtggaggggttgggtcccccagcagagcccctgggccagcagaacagcactcctgggcggctcctgtgggcttcaggactggccggctccagccgcaagggcgatgctgtggacgtttgtgtggatggtgcagtgttcttggaatctgtagaccagatcggtggaggtatagaagtgcaagagtctaaaggctgattttacacacacacacacacacacacacacacacacaaaatcactgctgtgtgttttcttccgcctgaggcatcagcgtcacctcggtgtggtcgtcgcctcccaggcccttggcctggcctcctctcagtttgggttttgccctcacccacatgagcccccccatgccctgccccccttgcggccttttgtgttccccgatgtctgggctgtgtccctgccgggattcccagccttcggggtcagccgtcgagccacttgctttgctcagttctgtgtttcagccacatttccacggtggaccctgtttgttttaaatattctgttcccatgtcaatcagtgacgataaatacagccttgatttggatgaaa

SEQ ID NO: 3853 - DNA, 2805 bp, Homo sapiens
ggttgccagggaaacagcggtcccacaggcaggagggatctggaccggcggcttcttccactaccagagaggctgaggtggcgggagagacccctctcctctgggggtaagtggctggcgcggcgagtgtctgcggcgcgcttctgcggccatctgcgccctgactgacggcggccagttcctcgaggaggcccggcgggaaggatttcaatggatattataaagggaaacctagatggaatttcaaaaccagcttcaaattcaagaatacgccctgggagcagaagttcaaatgcttctttggaggtgctctcaacagaaccaggatccttcaaggtcgatactgcaagcaacttgaactctggtaaagaggaccactccgaaagcagtaatacagagaacagaagaactagtaatgatgataagcaggaaagctgctctgagaaaataaaattggctgaagagggatcagatgaagatctggatttggttcaacatcagataatctctgagtgttcagatgaacccaaattaaaagaattagattctcaacttcaagatgctattcagaagatgaaaaaacttgataaaatattggcaaagaaacaacgcagagaaaaagaaattaagaagcaaggtctagaaatgagaataaagctgtgggaagaaattaagtctgcaaaatatagtgaagcttggcaaagtaaagaggagatggaaaatacaaaaaaatttttatctttgactgctgtttctgaagaaactgttggtccttctcatgaggaggaagacaccttttcctcagtgtttcatactcaaatccctccagaagaatatgaaatgcagatgcagaaactcaataaagattttacctgtgatgtggaaagaaatgagtcattgatcaaatcaggaaagaaacctttctcgaatacagaaaagattgagctcaggggtaaacacaaccaggattttattaagagaaacattgagttggccaaggaatcaagaaacccagtggttatggttgacagagagaagaaaaggctggttgagcttttgaaggacttggatgagaaagattccgggctctccagttctgagggtgatcagtctggctgggtggtcccagtaaaaggatatgaacttgcagtcacccagcatcagcagcttgctgaaattgatataaaactccaagaactctctgcagcctcccctacaatttccagtttttctccaagacttgaaaatcggaataatcagaaacctgaccgtgatggtgaaagaaatatggaagtaactccaggagaaaagatacttaggaacaccaaagagcaacgcgatctgcataatcggctgagagagattgatgaaaagctgaaaatgatgaaggaaaatgtgttagagtccacatcatgtctctctgaagaacagttaaagtgtcttctggatgaatgcatacttaaacaaaaatccatcattaaactttcttcagaaagaaaaaaggaagacattgaggacgtaacacctgtgttcccccagctttccaggtccatcatctctaaattgctaaatgaatcagaaacaaaggtccagaaaactgaggtagaagatgcagatatgcttgagagtgaagaatgtgaagcttctaaaggctactatctcactaaagccttgactggacataacatgtcagaagctcttgtcactgaagcagagaatatgaaatgccttcaattttccaaggacgttattattagtgacacaaaagactattttatgtcgaagactcttggcattgggagactgaaaaggccctccttcttagatgatccactgtatggtatcagtgtgagcctttcatcagaagaccaacatctgaaactcagttctccagagaatacaatagcagatgagcaggagactaaagatgcagcagaagaatgtaaagaaccctaatcaaggacttgctgggtgtgcttttcagaaagttggtaatgaagttaaattaaatttcttattgaattatttgaattcaatgaatgcactgcagagactattctttattgattttgacatttggagtcgctctttgtggattatatttccttgatatttttgagacttggggtgtaattgttcagtggtttttgctcattaaaatttctgggaccattgtttataaatttattgctaatcttacagtattaggattcattataaaaaccaacattttaatgtatacgtgttagggtaaaactcgttgaagtgctgtgattgtcctgtattcaattttgtatgtttcacctctactgtgattcagacagatcatggtggtcactgggaatttttgctgtggccctgcttttccttcttcccacttgtctcatgtctgtgaaactggtacaacctgccataagatgaaatgaattgtctcaacaaagcaatattagaagagcctttactatcttattggtgatgacacgtttcttaagtaggagtttgagtgaattatttgatatattactttgttaataatagttaacaatagtttcttattttctttcagagtttgggccttttagattgcatcaaataaagatgagctactttaaaagacagtctgcggtactatttgaagagagatggtttagttacaagtcagtaacttagattcatgagaaaattttgtgttgacattccataagatgagttggcattagaattggaagtccagtttatttctgaatcaaaaaatgagcgggctattgtgctgcctttaataaaatttgagtgatgtatacataa

SEQ ID NO: 3854 - DNA, 103 bp, Homo sapiens
atgagcaggagactaaagatgcagcagaagaatgtaaagaaccctaatcaaggacttgctgggtgtgcttttcagaaagttgagtttgggccttttagattgc

SEQ ID NO: 3855 - DNA, 8486 bp, Homo sapiens
attcgcgtggaggcgcgtcgcgcgcagcggacgccgacagaatccccgaggcgcctggcgcgggcgcgggcgcgaaggcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccatt

SEQ ID NO: 3856 - DNA, 4580 bp, Homo sapiens
acccaacaacacctagcaacagtagaaaaaacttttaaacaaaagtctgggtgggagatatacaacaacttccaatttctgctgatcgggatttcagggagaagaagctgctttccctcctctctactctgtttcctgcatgacttcagctattggctggtcctgggaaagaaagtgggaaaagctttttcctctgtattcttttgggctggatagtttttgagaactcgaatctgtcttgggctgtgagacaagccactgggttcttcaaaggataaactacctacatagaggacatacctttggttaaaggagctgccgtcaggtgggaatgagatctcgaaaccaaggtggtgaaagtgcatctgatgggcatatctcctgtcccaagccctccatcatcggcaatgctggtgaaaaaagtctctcagaagatgcaaaaaagaagaagaaatcaaataggaaggaggatgatgtcatggcctcaggaactgtcaaacgacacctaaaaacatctggagaatgtgaacgaaaaactaagaaatccctggagttatccaaagaagacctcatccaactactcagtataatggaaggggagttgcaggccagagaagatgtgatccacatgctgaagacagagaaaaccaagcctgaggttctggaggctcattacgggtctgcggagccagagaaagtgctgcgggtcctgcaccgagatgccattcttgcccaggagaaatccataggagaagatgtctatgagaaaccgatttcagagctggacagacttgaggaaaaacagaaagaaacctaccggcgcatgctagagcagctgttgctggccgagaagtgtcataggcgcaccgtatacgagttagagaacgagaagcataaacacactgactacatgaacaagagcgacgacttcaccaacctgctggagcaggagcgggagaggttaaaaaagctccttgaacaagaaaaggcttatcaagcccgcaaagaaaaggaaaatgctaaacgactcaataaactaagagatgagcttgttaaactcaaatcctttgcactcatgctggtggatgaaagacaaatgcacattgaacaacttggcctgcaaagccagaaagtacaggatcttactcagaagctgagggaagaagaagagaagctcaaagccattacttccaaatccaaagaagacagacagaaattgctcaagttagaagtggactttgaacacaaggcttcgaggttttctcaagagcatgaagagatgaacgctaaactggctaatcaagagtctcacaataggcaacttagactcaagctggttggcttaacccaaagaatcgaggagctagaagagaccaacaaaaatctgcagaaggcagaggaagaacttcaagaattaagagataaaattgccaaaggagaatgtggaaactctagcctcatggcagaagtggaaaatcttcgaaagcgtgtgcttgaaatggaaggtaaagatgaggagatcactaaaactgaatcccagtgtagggaattgaggaagaagctgcaagaggaagaacaccatagtaaggagctcagacttgaagttgagaagctacagaagagaatgtctgaactagagaaattggaagaagcatttagcaagagtaaatctgagtgcacccagctacatttaaatctggagaaagaaaagaacttaaccaaagacctgctaaatgaattggaggtggtcaagagtcgagttaaagaattggaatgttctgaaagtagattggaaaaggctgaattaagcctaaaagatgatcttaccaagttgaagtcatttaccgtgatgctggttgatgaaaggaaaaatatgatggaaaaaataaaacaagaagagagaaaagtggatggactcaataaaaattttaaggtggaacaaggaaaagttatggatgtaactgaaaaactaattgaagaaagtaagaaacttttaaaactaaaatctgaaatggaggaaaaagtatacaacttgacaagagaaagagatgagttgataggcaaattgaaaagtgaagaagaaaaatcctctgaattaagctgcagtgttgacttactaaagaagagacttgatggtatagaggaagtggaaagagaaataacaagaggaaggtcacgaaaagggtctgagctcacctgcccggaagataataagattaaggaactaacacttgaaattgagagactgaagaaacgtctccaacaattggaagtggtcgaaggggatttgatgaagacagaagatgagtatgatcagctggaacagaaatttagaactgagcaggataaggctaacttcctctctcaacaactagaggagatcaagcaccaaattgccaagaataaagcaatagagaagggtgaggttgtgagccaggaagctgaactgagacacagatttcggttggaagaagctaaaagtcgagacttaaaagccgaagtacaagctcttaaagagaagattcacgaattaatgaacaaagaagatcagctttctcagctccaggtagattattctgtacttcaacaaagatttatggaagaagaaaataagaacaaaaacatggggcaggaggttctcaatctgaccaaagagttggagctttccaagcgctacagcagagctcttaggcccagtgtgaatggaagaagaatggtggatgttcctgtgacgtcaactggagtccaaactgatgcagtcagcggtgaagcagcagaggaagaaacgccagctgtattcatacggaaatccttccaggaagaaaatcatattatgagtaatcttcggcaggtgggattgaagaaacccgtggaaagatcttctgttctagacaggtatcctccagcagcaaatgagctcactatgagaaagtcttggattccatggatgagaaagagggaaaacggcccctccatcactcaggagaaagggccccgaacaaattccagtccagggcacccaggagaggtagtcctttcaccaaagcagggccagcccctgcatattcgagtgacaccagaccacgagaacagcactgcgactttggagataacaagcccgacatctgaagaatttttttctagtaccactgtcattcctaccttagggaatcagaaaccaagaataaccattattccatcaccaaacgttatgcctcaaaaacaaaaaagtggagatactactcttggcccagaacgagccatgtccccagtcacaattactacattttccagagagaagactccagaaagtggaagaggcgcatttgcagacaggcccacatcccctattcagataatgacggtgtctacatcagcagcaccagctgagattgcagtttctcccgaatcccaggaaatgcccatgggacggacaatcctcaaagtcaccccagaaaaacagactgttccaactccagtacggaaatacaactccaatgccaatatcataaccacagaggacaataaaattcacattcacttagggtctcagtttaaacggtcccctgggacttcaggtgaaggagtcagtccagttattactgtccgaccagtaaacgtgacagccgaaaaggaggtttccaccggcactgtccttcgctctcccaggaatcacctctcctcacggcctggtgcaagcaaagtgacgagcactatcaccataacaccggtcacaacgtcatctgctcgaggaacccagtcagtgtcaggacaagacgggtcatcccagcggcctacacccacccgcattcctatgtcaaaaggtatgaaagcaggaaagccagtagtggcagccccaggagcaggaaatctgaccaaattcgagcctcgagctgagactcagtctatgaaaatagagctgaagaaatctgcagccagcagcaccacctctctcggaggggggaagggctgagggcagtggctaagggggtatgttgtgcagatgctactgctgccgtgaaagtgaaccttcatctgtttgtgccagttctttacatgtactaatttaagttttaaatattgtgtttataaaataaccaactaataaccatttgtctttcccattttgtgcatttgttttgatgctggggaacaaaattagcaaaactattgcttgctgcctagaagccagggcgtggtttctagttccagttttgcttctagcaagtggacccatcaatagacccatctgagcctgtttcctcatcagttagatgtggggactcaatcacacgctcttcaagtccggctcccatatttcctaattgcaagccaaatttaatgtaccttgttccacaataattttttattaaaaaaatcctattacaaaataagacatactttaactattgtcatttgcctctttcacatcatgaatttgctttatgtgctggaaaaaacatcacatagctatcacagggcctggacctctaaaattttgcaaaaacaaaaggttctaagatgatttcaggaaataatgtgaacatgtaataaaatggaaatgaaatatggaatcctaa

SEQ ID NO: 3857 - DNA, 4051 bp, Homo sapiens
attcaataagctctctgttgattttttgagcccagtatgcgatttacattgtcagtcgtctgatcttgctgcactttctattacaggccagagaagatgtgatccacatgctgaagacagagaaaaccaagcctgaggttctggaggctcattacgggtctgcggagccagagaaagtgctgcgggtcctgcaccgagatgccattcttgcccaggagaaatccataggagaagatgtctatgagaaaccgatttcagagctggacagacttgaggaaaaacagaaagaaacctaccggcgcatgctagagcagctgttgctggccgagaagtgtcataggcgcaccgtatacgagttagagaacgagaagcataaacacactgactacatgaacaagagcgacgacttcaccaacctgctggagcaggagcgggagaggttaaaaaagctccttgaacaagaaaaggcttatcaagcccgcaaagaaaaggaaaatgctaaacgactcaataaactaagagatgagcttgttaaactcaaatcctttgcactcatgctggtggatgaaagacaaatgcacattgaacaacttggcctgcaaagccagaaagtacaggatcttactcagaagctgagggaagaagaagagaagctcaaagccattacttccaaatccaaagaagacagacagaaattgctcaagttagaagtggactttgaacacaaggcttcgaggttttctcaagagcatgaagagatgaacgctaaactggctaatcaagagtctcacaataggcaacttagactcaagctggttggcttaacccaaagaatcgaggagctagaagagaccaacaaaaatctgcagaaggcagaggaagaacttcaagaattaagagataaaattgccaaaggagaatgtggaaactctagcctcatggcagaagtggaaaatcttcgaaagcgtgtgcttgaaatggaaggtaaagatgaggagatcactaaaactgaatcccagtgtagggaattgaggaagaagctgcaagaggaagaacaccatagtaaggagctcagacttgaagttgagaagctacagaagagaatgtctgaactagagaaattggaagaagcatttagcaagagtaaatctgagtgcacccagctacatttaaatctggagaaagaaaagaacttaaccaaagacctgctaaatgaattggaggtggtcaagagtcgagttaaagaattggaatgttctgaaagtagattggaaaaggctgaattaagcctaaaagatgatcttaccaagttgaagtcatttaccgtgatgctggttgatgaaaggaaaaatatgatggaaaaaataaaacaagaagagagaaaagtggatggactcaataaaaattttaaggtggaacaaggaaaagttatggatgtaactgaaaaactaattgaagaaagtaagaaacttttaaaactaaaatctgaaatggaggaaaaagtatacaacttgacaagagaaagagatgagttgataggcaaattgaaaagtgaagaagaaaaatcctctgaattaagctgcagtgttgacttactaaagaagagacttgatggtatagaggaagtggaaagagaaataacaagaggaaggtcacgaaaagggtctgagctcacctgcccggaagataataagattaaggaactaacacttgaaattgagagactgaagaaacgtctccaacaattggaagtggtcgaaggggatttgatgaagacagaagatgagtatgatcagctggaacagaaatttagaactgagcaggataaggctaacttcctctctcaacaactagaggagatcaagcaccaaattgccaagaataaagcaatagagaagggtgaggttgtgagccaggaagctgaactgagacacagatttcggttggaagaagctaaaagtcgagacttaaaagccgaagtacaagctcttaaagagaagattcacgaattaatgaacaaagaagatcagctttctcagctccaggtagattattctgtacttcaacaaagatttatggaagaagaaaataagaacaaaaacatggggcaggaggttctcaatctgaccaaagagttggagctttccaagcgctacagcagagctcttaggcccagtgtgaatggaagaagaatggtggatgttcctgtgacgtcaactggagtccaaactgatgcagtcagcggtgaagcagcagaggaagaaacgccagctgtattcatacggaaatccttccaggaagaaaatcatattatgagtaatcttcggcaggtgggattgaagaaacccgtggaaagatcttctgttctagacaggtatcctccagcagcaaatgagctcactatgagaaagtcttggattccatggatgagaaagagggaaaacggcccctccatcactcaggagaaagggccccgaacaaattccagtccagggcacccaggagaggtagtcctttcaccaaagcagggccagcccctgcatattcgagtgacaccagaccacgagaacagcactgcgactttggagataacaagcccgacatctgaagaatttttttctagtaccactgtcattcctaccttagggaatcagaaaccaagaataaccattattccatcaccaaacgttatgcctcaaaaacaaaaaagtggagatactactcttggcccagaacgagccatgtccccagtcacaattactacattttccagagagaagactccagaaagtggaagaggcgcatttgcagacaggcccacatcccctattcagataatgacggtgtctacatcagcagcaccagctgagattgcagtttctcccgaatcccaggaaatgcccatgggacggacaatcctcaaagtcaccccagaaaaacagactgttccaactccagtacggaaatacaactccaatgccaatatcataaccacagaggacaataaaattcacattcacttagggtctcagtttaaacggtcccctgggacttcaggtgaaggagtcagtccagttattactgtccgaccagtaaacgtgacagccgaaaaggaggtttccaccggcactgtccttcgctctcccaggaatcacctctcctcacggcctggtgcaagcaaagtgacgagcactatcaccataacaccggtcacaacgtcatctgctcgaggaacccagtcagtgtcaggacaagacgggtcatcccagcggcctacacccacccgcattcctatgtcaaaaggtatgaaagcaggaaagccagtagtggcagccccaggagcaggaaatctgaccaaattcgagcctcgagctgagactcagtctatgaaaatagagctgaagaaatctgcagccagcagcaccacctctctcggaggggggaagggctgagggcagtggctaagggggtatgttgtgcagatgctactgctgccgtgaaagtgaaccttcatctgtttgtgccagttctttacatgtactaatttaagttttaaatattgtgtttataaaataaccaactaataaccatttgtctttcccattttgtgcatttgttttgatgctggggaacaaaattagcaaaactattgcttgctgcctagaagccagggcgtggtttctagttccagttttgcttctagcaagtggacccatcaatagacccatctgagcctgtttcctcatcagttagatgtggggactcaatcacacgctcttcaagtccggctcccatatttcctaattgcaagccaaatttaatgtaccttgttccacaataattttttattaaaaaaatcctattacaaaataagacatactttaactattgtcatttgcctctttcacatcatgaatttgctttatgtgctggaaaaaacatcacatagctatcacagggcctggacctctaaaattttgcaaaaacaaaaggttctaagatgatttcaggaaataatgtgaacatgtaataaaatggaaatgaaatatgg

SEQ ID NO: 3858 - DNA, 3907 bp, Homo sapiens
agtgttgtgaagggagcagaagaggagaaacctaatctccgaacccaacaacacctagcaacagtagaaaaaacttttaaacaaaagtctgggtgggagatatacaacaacttccaatttctgctgatcgggatttcagggagaagaagctgctttccctcctctctactctgtttcctgcatgacttcagctattggctggtcctgggaaagaaagtgggaaaagctttttcctctgtattcttttgggctggatagtttttgagaactcgaatctgtcttgggctgtgagacaagccactgggttcttcaaaggataaactacctacatagaggacatacctttggttaaaggagctgccgtcaggtgggaatgagatctcgaaaccaaggtggtgaaagtgcatctgatgggcatatctcctgtcccaagccctccatcatcggcaatgctggtgaaaaaagtctctcagaagatgcaaaaaagaagaagaaatcaaataggaaggaggatgatgtcatggcctcaggaactgtcaaacgacacctaaaaacatctggagaatgtgaacgaaaaactaagaaatccctggagttatccaaagaagacctcatccaactactcagtataatggaaggggagttgcaggccagagaagatgtgatccacatgctgaagacagagaaaaccaagcctgaggttctggaggctcattacgggtctgcggagccagagaaagtgctgcgggtcctgcaccgagatgccattcttgcccaggagaaatccataggagaagatgtctatgagaaaccgatttcagagctggacagacttgaggaaaaacagaaagaaacctaccggcgcatgctagagcagctgttgctggccgagaagtgtcataggcgcaccgtatacgagttagagaacgagaagcataaacacactgactacatgaacaagagcgacgacttcaccaacctgctggagcaggagcgggagaggttaaaaaagctccttgaacaagaaaaggcttatcaagcccgcaaagaaaaggaaaatgctaaacgactcaataaactaagagatgagcttgttaaactcaaatcctttgcactcatgctggtggatgaaagacaaatgcacattgaacaacttggcctgcaaagccagaaagtacaggatcttactcagaagctgagggaagaagaagagaagctcaaagccattacttccaaatccaaagaagacagacagaaattgctcaagttagaagtggactttgaacacaaggcttcgaggttttctcaagagcatgaagagatgaacgctaaactggctaatcaagagtctcacaataggcaacttagactcaagctggttggcttaacccaaagaatcgaggagctagaagagaccaacaaaaatctgcagaaggcagaggaagaacttcaagaattaagagataaaattgccaaaggagaatgtggaaactctagcctcatggcagaagtggaaaatcttcgaaagcgtgtgcttgaaatggaaggtaaagatgaggagatcactaaaactgaatcccagtgtagggaattgaggaagaagctgcaagaggaagaacaccatagtaaggagctcagacttgaagttgagaagctacagaagagaatgtctgaactagagaaattggaagaagcatttagcaagagtaaatctgagtgcacccagctacatttaaatctggagaaagaaaagaacttaaccaaagacctgctaaatgaattggaggtggtcaagagtcgagttaaagaattggaatgttctgaaagtagattggaaaaggctgaattaagcctaaaagatgatcttaccaagttgaagtcatttaccgtgatgctggttgatgaaaggaaaaatatgatggaaaaaataaaacaagaagagagaaaagtggatggactcaataaaaattttaaggtggaacaaggaaaagttatggatgtaactgaaaaactaattgaagaaagtaagaaacttttaaaactaaaatctgaaatggaggaaaaagtatacaacttgacaagagaaagagatgagttgataggcaaattgaaaagtgaagaagaaaaatcctctgaattaagctgcagtgttgacttactaaagaagagacttgatggtatagaggaagtggaaagagaaataacaagaggaaggtcacgaaaagggtctgagctcacctgcccggaagataataagattaaggaactaacacttgaaattgagagactgaagaaacgtctccaacaattggaagtggtcgaaggggatttgatgaagacagaagatgagtatgatcagctggaacagaaatttagaactgagcaggataaggctaacttcctctctcaacaactagaggagatcaagcaccaaattgccaagaataaagcaatagagaagggtgaggttgtgagccaggaagctgaactgagacacagatttcggttggaagaagctaaaagtcgagacttaaaagccgaagtacaagctcttaaagagaagattcacgaattaatgaacaaagaagatcagctttctcagctccaggtagattattctgtacttcaacaaagatttatggaagaagaaaataagaacaaaaacatggggcaggaggttctcaatctgaccaaagagttggagctttccaagcgctacagcagagctcttaggcccagtgtgaatggaagaagaatggtggatgttcctgtgacgtcaactggagtccaaactgatgcagtcagcggtgaagcagcagaggaagaaacgccagctgtattcatacggaaatccttccaggaagaaaatcatattatgagtaatcttcggcaggtgggattgaagaaacccgtggaaagatcttctgttctagacaggtatcctccagcagcaaatgagctcactatgagaaagtcttggattccatggatgagaaagagggaaaacggcccctccatcactcaggagaaagggccccgaacaaattccagtccagggcacccaggagaggtagtcctttcaccaaagcagggccagcccctgcatattcgagtgacaccagaccacgagaacagcactgcgactttggagataacaagcccgacatctgaagaatttttttctagtaccactgtcattcctaccttagggaatcagaaaccaagaataaccattattccatcaccaaacgttatgcctcaaaaacaaaaaagtggagatactactcttggcccagaacgagccatgtccccagtcacaattactacattttccagagagaagactccagaaagtggaagaggcgcatttgcagacaggcccacatcccctattcagataatgacggtgtctacatcagcagcaccagctgagattgcagtttctcccgaatcccaggaaatgcccatgggacggacaatcctcaaagtcaccccagaaaaacagactgttccaactccagtacggaaatacaactccaatgccaatatcataaccacagaggacaataaaattcacattcacttagggtctcagtttaaacggtcccctgggacttcaggtgaaggagtcagtccagttattactgtccgaccagtaaacgtgacagccgaaaaggaggtttccaccggcactgtccttcgctctcccaggaatcacctctcctcacggcctggtgcaagcaaagtgacgagcactatcaccataacaccggtcacaacgtcatctgctcgaggaacccagtcagtgtcaggacaagacgggtcatcccagcggcctacacccacccgcattcctatgtcaaaagaaagcatcatcattcaccagttacgaatgaactccagatga

SEQ ID NO: 3859 - DNA, 279 bp, Homo sapiens
atgggagtgcacgtggaaaccatctccccaggagacgggatgcttgaagatggaaagaaatttgattcctcccgggacagaaacaagccctttaagtttatgctaggcaagcaggaggtgatccgaggctgggaagaaggggttgtccagatgagtgtgggtcagagagccaaactgactatatctccagattatgcctatggtgccactgggcacccaggcatcatcccaccacatgccactctcgtcttcgatgtggagcttctaaaactggaatga

SEQ ID NO: 3860 - DNA, 1579 bp, Homo sapiens
atgggcaggcaacgcgctgagggactaggcagagccgtggaaccgccgccaggtcgctgtcggtccacgccgcccgtcgcgctgcccgcccgctcggcgtcggccgccgccatgggagtgcacgtggaaaccatctccccaggagactggcgcaccttcccgaagcgcagccagacctgcgtgatgcactacaccgggatgcttgaagatggaaagaaatttgattcctcccgggacagaaacaagccctttaagtttatgctaggcaagcaggaggtgatccgaggctgggaagaaggggttgtccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacgtgtgcacataaatccatatggagcttttcctgatgttccactccactttgtatagacatctgccccaactgaatgtgttctgtcactcagctttgcttccgacacctctgtttcctcttcccctttctcctggtatgtgcgtttacctaaactatatgccataaacgtcaagttattcattttactttttcattttggggtgaagattcagtttcagtcttttgaatataggtttccaattaagtacatggtcaagtgttaacagcacaagtgataagttaacgttaggataggaattggtgttgagggggttgcaagaatattttattttaattttttggatgaaatttttatctattatatattaaacattcttgctgctgcgctgcaaaaccatagcagatttgaggcactgttgaggactgaattattctccaagttgagagatgtccttgggttaaattaaaagccctacctaaaactgaggtggggatggggagaggctttgcctccaccattcccaccccaccctccccttaaaccctctgcctttgaaagcaggtcatgttcactgcgatgctggacactacaggtatctgtccctgggccagcagggacctctgaagccttctttgtggccttatttttttttttttttttttcatcctgtggtttttctaacggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcccagcttcagcatctcctgttttttgatgcttggctccctctgctgatctcagagtttcctggcttttcctccctcagccacttctcacccctttgctgtcctgtgtagtgatttggtgagaggaatcgttgctgcccccttcccctagcaccatatatgagtctcaagttttattattgcaataaaagtgctttatgctggcttttctcaaa

SEQ ID NO: 3861 - DNA, 994 bp, Homo sapiens
cacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttggtgttgggcaagtcataaaaggcctagacattgctatgacagatatgtgccctggagaaaagcgaaaagtagttatacccccttcatttgcatacggaaaggaaggctatggtatacttgaagaagtctttcttctgcaaaatatccttgtctcatgtcacagaacaaccctgcatgtcttgaaatgcatgttgttagtgaataacaatacatgcgcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttttttagctatttactgtactttatgtataaaacaaagtcacttttctccaagttgtatttgctatttttcccctatgagaagatattttgatctccccaatacattgattttggtataataaatgtgaggctgttttgcaaactt

SEQ ID NO: 3862 - DNA, 2834 bp, Homo sapiens
gggacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttggtgttgggcaagtcataaaaggcctagacattgctatgacagatatgtgccctggagaaaagcgaaaagtagttatacccccttcatttgcatacggaaaggaaggctatgcagaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatagcatatttgtatttctactttttttttttagctatttactgtactttatgtataaaacaaagtcacttttctccaagttgtatttgctatttttcccctatgagaagatattttgatctccccaatacattgattttggtataataaatgtgaggctgttttgcaaacttaacttgcaggaatggtatgactgtgtttcctactgctttattctgtaaacaagaattgtagcaccatgaaacagacctctgggtcccagtgggcattttttcccctttcaggatgtaggaggacatgtatagtatgtcaaaaactgcaagcttttcccaactttaaccttaccagcatgttaatatccagtttttttatagtttaaaagttaaagtgcctcatattttgaaaatatccattaaggacccaggaattagcatttcacttgtttatacatttttataacattatgaagacgatataaaaatcctagaactgaagagtcttcctttggtatatgtgcaggaagatagttgtatatctctgttccacaaagaacgcaacacagtctctaaactttttggtgtaagcttctagccttgggtattttccagtggggaatgtttaaaaatatttgaccaaaccaaagactttttgcctcttatagcaagcataaagactgtactgcctggcttttgtattccttcagacattattgtaaatgtgcaactcctcttccctcttgtaaacctttataagatgtctgccaccccaagcttttgtcttgatagttttaaattgatgccatgaaatttcttagttttcgttccctttctctagttatctctttccttatgtcacctcatttcccatcattcttgtcactaatgatgaatgatcattacaaattggtatgctgtcaaattttgataaatgtgccaaacaaaggaggatatacagtgccatggcaattttgtgtcatggtcaagttatgatatcatatgacttgagaatagtatgtaagagatgctgtagaagatcacgttggtaccaaagaaagggcacatgtctatcggaacatagattttgcatactgcatggtatggtcaggctttgtgtccacacccaaatctcatcttgaaattataatccccataatttccataatccccacatgtcaatggagagaccaggtggaggtaactgaatcatgggggtggttttccccgtgctgttctcatgcaatctgatggttttataagtgtttggtagttcctcttgcattcattctcccacccgccaccttgtgaagaaagtccttgcttccccgccttccaccatgattgtaagcttcctgaggcctccccagccatggggaaccatgagtcaatttaacctctttcctttacaaattacccagtctggggcagttctttatagcagtgtgaaaatggactactacactgcatatataggaaagtatggtcagacagtaaatagctctgttcaaaataattgagttccaaacaagtaaagttttttctaccttctgaaacttgctctttccaaaccattgttcatcctttaacttctttacactatcaaaaattctatttaaaaatagagggctttcagatgagtacatacaaaaacaaacaaaagtatacataggggtaacacaaccatgagattagtaaataatacatatggctagcacataatttgacaccttataaaacaagaatctgtactatcttttccttcctcccaatatttcttcatttctatgctcaattttctaatactttttcacatgcttaatcatttactctttcatcgccttccctcaaaaaaacctgctccgttgaagtaaactaagtaactcaatattctttattttggtttggaacctgtctcaattttttgtatccatattaagaagtcaccctataatctaaactttgtaattctaatttttttgtcccattatcatacaaagtgcttttaaacttgtttttaaaaaatgacagataatgccacatgaataggaagatgattcattctaaaacttgtatttacataattaaaaataaatttataatcattctacatacaa

SEQ ID NO: 3863 - DNA, 666 bp, Homo sapiens
atgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttggtgttgggcaagtcataaaaggcctagacattgctatgacagatatgtgccctggagaaaagcgaaaagtagttatacccccttcatttgcatacggaaaggaaggctatgaaggcaagattccaccggatgctacattgatttttgagattgaactttatgctgtgaccaaaggaccacggagcattgagacatttaaacaaatagacatggacaatgacaggcagctctctaaagccgagataaacctctacttgcaaagggaatttgaaaaagatgagaagccacgtgacaagtcatatcaggatgcagttttagaagatatttttaagaagaatgaccatgatggtgatggcttcatttctcccaaggaatacaatgtataccaacacgatgaactatag

SEQ ID NO: 3864 - DNA, 1345 bp, Homo sapiens
agggttagttgtcagtatctttcccagttgttccgccccctacccccgcctcccgcaccgcgcccctctccggctgccctctccgtgtggggcaaggctccgagggcagcattcagtagccatttagctttggaaggagaggtgattcgaatggcccggctcctcctgtcaccatgctaggcactttggccgcgcaggtgctgacctgaacctggttcatccctttctgaccaaaactgttcactcaccgtggaagggactaagcatccatatggagacgccaccagtcaatacaattggagaaaaggacacctctcagccgcaacaagagtgggaaaagaaccttcgggagaaccttgattcagttattcagattaggcagcagccccgagaccctcctaccgaaacgcttgagctggaagtaagcccagatccagccagccaaattctagagcatactcaaggagctgaaaaactggttgctgaacttgaaggagactctcataagtctcatggatcaaccagtcagatgccagagacccttcaagcttctgatctctggtactgccccgatgggagctttgtcaagaagatcgtaatccgtggccatggcttggacaaacccaaactaggctcctgctgccgggtactggctttggggtttcctttcggatcagggccgccagagggctggacagagctaactatgggcgtagggccatggagggaggaaacttggggggagctcatagagaaatgcttggagtccatgtgtcaaggtgaggaagcagagcttcagctgcctgggcactctggacctcctgtcaggctcacactggcatccttcactcaaggccgagactcctgggagctggagactagcgagaaggaagccctggccagggaagaacgtgcaaggggcacagaactatttcgagctgggaaccctgaaggagctgcccgatgctatggacgggctcttcggctgctcctgactttacccccacctggccctccagaacgaactgtccttcatgccaatctggctgcctgtcagttgttgctagggcagcctcagttggcagcccagagctgtgaccgggtgttggagcgggagcctggccatttaaaggccttataccgaaggggggttgcccaggctgcccttgggaacctggaaaaagcaactgctgacctcaagaaggtgctggcgatagatcccaaaaaccgggcagcccaggaggaactggggaaggtggtcattcaggggaagaaccaggatgcagggctggctcagggtctgcgcaagatgtttggctgattaaaagttaaaccttaaaagaga

SEQ ID NO: 3865 - DNA, 915 bp, Homo sapiens
ccagaagacagggcacccgcggccttgctgcgcatgctcgcgctgtgaccccggcttgaggccagaagccaaggagtcctcagtgacggtgggatccacaacatctccacatcgctgtccccacccagccagggcagcgccagcactagctcagacgcaaggacggaaccgctggactccaggttccttgcctgggagtaggagaaatccacctgctgggggctgagtgtggcctgagggacaggccctgggtcccgggatgcccctgcccgagcccagcgagcaggagggtgagagtgtgaaggccagccaggagccatcccccaagccaggcacagaagtcatcccggcagcccccaggaagcccagaaagttctccaaactggtcctgctcacagcctccaaagacagcaccaaggtggcgggggccaagcgcaagggtgtgcactgtgtcatgtccctgggggtgcccggccccgccacccttgccaaggccctcctccagacccaccccgaggcccagcgggccattgaggcagcccctcaggagcctgagcagaaacggagcaggcaggacccaggcacagacagaacagaagacagtggattagcagcggggcctcctgaggctgctggggagaactttgccccctgctctgtggcgcccggcaagtccctgtaaccttgacaacaggcgcatcctcccaggccaccaacccagccataggctcttctctgtccgcagggcttctggggccaaatgggtgaatctttgcttttaacattgtgtgatttcttttctttttttttttttttttagatcaagtataagttacttttgtaagcagaaaaatactttcaaacaagaataaaagaagctgttcgctagaccccataatgggcaggttttaaaca

SEQ ID NO: 3866 - DNA, 1036 bp, Homo sapiens
gggcaagacgcggaggagcggccccagccagaagacagggcacccgcggccttgctgcgcatgctcgcgctgtgaccccggcttgaggtaacagcgcgagctgaggctggggcccttggcgcggaggctgagggacccgccgcggcgctgtcgccggagagggagggcaccgctgtcgtcggccagaagccaaggagtcctcagtgacggtgggatccacaacatctccacatcgctgtccccacccagccagggcagcgccagcactagctcagacgcaaggacggaaccgctggactccaggttccttgcctgggagtaggagaaatccacctgctgggggctgagtgtggcctgagggacaggccctgggtcccgggatgcccctgcccgagcccagcgagcaggagggtgagagtgtgaaggccagccaggagccatcccccaagccaggcacagaagtcatcccggcagcccccaggaagcccagaaagttctccaaactggtcctgctcacagcctccaaagacagcaccaaggtggcgggggccaagcgcaagggtgtgcactgtgtcatgtccctgggggtgcccggccccgccacccttgccaaggccctcctccagacccaccccgaggcccagcgggccattgaggcagcccctcaggagcctgagcagaaacggagcaggcaggacccaggcacagacagaacagaagacagtggattagcagcggggcctcctgaggctgctggggagaactttgccccctgctctgtggcgcccggcaagtccctgtaaccttgacaacaggcgcatcctcccaggccaccaacccagccataggctcttctctgtccgcagggcttctggggccaaatgggtgaatctttgcttttaacattgtgtgatttcttttctttttttttttttttttagatcaagtataagttacttttgtaagcagaaaaatactttcaaacaagaataaaagaagctgttcgctagaccccataatgggcaggttttaaaca

SEQ ID NO: 3867 - DNA, 844 bp, Homo sapiens
agagcctggacctacagcgctgttggtggaggtcctgcctccaggaatagatggacatggcctggcagatgatgcagctgctgcttctggctttggtgactgctgcggggagtgcccagcccaggagtgcgcgggccaggacggacctgctcaatgtctgcatgaacgccaagcaccacaagacacagcccagccccgaggacgagctgtatggccagtgcagtccctggaagaagaatgcctgctgcacggccagcaccagccaggagctgcacaaggacacctcccgcctgtacaactttaactgggatcactgtggtaagatggaacccacctgcaagcgccactttatccaggacagctgtctcgagtgctcacccaacctggggccctggatccggcaggtcaaccagagctggcgcaaagagcgcattctgaacgtgcccctgtgcaaagaggactgtgagcgctggtgggaggactgtcgcacctcctacacctgcaaaagcaactggcacaaaggctggaattggacctcagggattaatgagtgtccggccggggccctctgcagcacctttgagtcctacttccccactccagccgccctttgtgaaggcctctggagccactccttcaaggtcagcaactatagtcgagggagcggccgctgcatccagatgtggtttgactcagcccagggcaaccccaatgaggaggtggccaagttctatgctgcggccatgaatgctggggccccgtctcgtgggattattgattcctgatccaagaagggtcctctggggttcttccaacaacctattctaatagacaaatccacatg

SEQ ID NO: 3868 - DNA, 973 bp, Homo sapiens
agagcctggacctacagcgctgttggtggaggtcctgcctccaggaatagatggacatggcctggcagatgatgcagctgctgcttctggctttggtgactgctgcggggagtgcccagcccaggagtgcgcgggccaggacggacctgctcaatgtctgcatgaacgccaagcaccacaagacacagcccagccccgaggacgagctgtatggccaggtgggagctcctcaagggccctccccaggaagtgttcctctggatgacctacctggggcagaggagccagaatatggaggagatggctgtggtggggagagacttagtcctgtgtcttccccacccagtgcagtccctggaagaagaatgcctgctgcacggccagcaccagccaggagctgcacaaggacacctcccgcctgtacaactttaactgggatcactgtggtaagatggaacccacctgcaagcgccactttatccaggacagctgtctctgagtgctcacccaacctggggccctggatccggcaggtcaaccagagctggcgcaaagagcgcattctgaacgtgcccctgtgcaaagaggactgtgagcgctggtgggaggactgtcgcacctcctacacctgcaaaagcaactggcacaaaggctggaattggacctcagggattaatgagtgtccggccggggccctctgcagcacctttgagtcctacttccccactccagccgccctttgtgaaggcctctggagccactccttcaaggtcagcaactatagtcgagggagcggccgctgcatccagatgtggtttgactcagcccagggcaaccccaatgaggaggtggccaagttctatgctgcggccatgaatgctggggccccgtctcgtgggattattgattcctgatccaagaagggtcctctggggttcttccaacaacctattctaatagacaaatccacatg

SEQ ID NO: 3869 - DNA, 2270 bp, Homo sapiens
cgccgccacccggcagccccggcgcagctccggcagccgcagtcgcagcgcccccagcgtggcgccccccggccgggcctgccgcccgggacccgggctggggcgcagagggagcccggagcccggcgcccccatgcgccgccccgccgccgccgcgccacagctatgaccctgagcactgagatgtccgatgcctctggcctcgccgaggaaacagacatcgacgtggtgggggagggcgaggacgaagaagacgaggaagaggaggacgacgacgagggcggcggtggcgggccccggctggctgtccccgcgcagcggcggcggcggcggcgctcgtacgccggggaggacgagctggaggatctggaggaggaggaggacgacgatgacatcctgctggccccgcctgctgggggctccccggcgcccccgggcccggccccggcggcgggggcaggagccggtgggggcggcggcggcggcggcgcgggcggcggcgggagcgcgggtagcggcgccaagaacccgctggtgaagccgccctactcgtatatcgcgctcatcactatggccatcctgcagagccccaagaagcggctgacgctgagcgagatctgtgagttcatcagcggccgcttcccctactaccgggagaagttccccgcctggcagaacagcatccgccacaacctctcgctcaacgactgcttcgtcaagatcccccgcgagcccggcaacccgggcaagggcaactactggacgctggacccggagtccgccgacatgttcgacaacggcagcttcctgcgccggaggaagcgcttcaagcggcagccgctgctcccacccaacgccgcggccgccgagtctctgctgctgcgcggcgcgggagccgcagggggcgcgggcgacccggcagccgccgccgcgctcttcccgcccgcgcccccgccgcccccgcatgcctacggctacggcccctacggctgcggctacggcctgcagctgccgccttacgcgccgccctcggccctcttcgccgccgcagcgcgccgccgccgccgccgccttccacccgcactcgcccccgccgcccccgccaccgcacggcgcggccgccgagctggcccggaccgccttcggctaccggccgcacccgctcggcgccgccctacccggccccctgccggcctccgcggccaaggcgggcggcccgggcgcctcagcgctggcgcgctcgcccttctccatcgagagcatcatcgggggcagcttgggcccggccgccgctgccgccgccgccgcgcaggccgccgccgccgctcaggcctcgccctcgccctcgccggtggcggcgccgccagctcccggatccagcggaggaggctgcgcggcgcaggcggccgtgggcccggcggccgcgctcacccgatccctcgtggccgccgcggccgccgccgcctcctcagtctcctcgtccgccgccttggggactctgcaccaagggactgccctgtccagtgtcgagaactttactgctaggatttccaattgttaataacgctatgttagcgcgctcgaggaagaaggtaggaatcccggctccttttctcgtcttggtggttcggtgttttgttcgctcctccaggcgcggcccctctcgacctcgcgcgcccattttcgccgctgcgaattctcggacaaaactgtcaacagcccgggcgcgccttttggctctgcgggtccctctatttatgcaaagccgacctatgctacagccccccaacccccgacctggggtagggaggaagagggtgccggggaagggagtccgccctgtccaggcactagaggctcccttgacgtttggcagatgaaaaacaactaagcctttttgaggtgtagagattctcaggtccaggcgttaaaaaataatggtcaaaagaataatacaaaaatagtaaaggtcttgaagaatgccagcgaagcaattcttttttatttgaggacacttgtctggtgtactttttcatgaaaaggaaaaatggttaacatgtttacacaagaaaaaaagtcaaaattatcatttatttcaacctgtgttttgtatcataacagacgtgtggatttttttgtacttactgcgtattctttacaaggagtattgtaaattttactggcaattattattgtactattctaaatgtaagatttttacactttttcagaaataaaaatgcttaattttcaaagaaaattcaccaaaa

SEQ ID NO: 3870 - DNA, 11181 bp, Homo sapiens
atggccgaagtcggcgaggacagcggcgcccgcgccctgctcgcgctgcgctcggcgccctgcagcccagtgctgtgcgccgcagccgccgccgccgccttccccgcggccgcacccccgccggcccccgcgcagccccagcctccgcccgggccgccgccgccgccgccaccgccgctgcctccgggcgcgatcgcgggcgcgggctcctccgggggctcctccggggtatccggggactccgcggtcgcgggcgcggcgccggccctggtggccgcggcggccgcctcggtacggcagagcccggggccggcgctggcgcggctggagggccgcgagttcgagttcctcatgcgccagcccagcgtcaccatcggccgcaactcgtcgcagggctcggtggacttgagcatgggcctgtccagcttcatctcgcggcgccacctgcagctcagcttccaggagccgcacttctacctgcgctgcctcggcaagaacggcgtcttcgtggacggggccttccagagacgcggcgcgcccgccctgcagctgcccaagcagtgtaccttccggtttcccagcacggccatcaagatccagttcacgtcgctctatcacaaagaagaggccccagcctccccgctgcggccactgtacccccagatctcccctctgaagatccacatcccggagccggacctccggagcatggtcagccccgtcccctccccgacgggcaccatcagtgtccccaactcctgcccagccagtccacgcggtgccggctcctccagttaccgctttgtgcagaacgtgacctcggacctgcagctggcagcagagtttgcagcaaaggccgcgtcggagcagcaggcagacacgtctggaggagacagccccaaggatgagtcaaagccgccgttctcctacgcgcagctgatcgtgcaggccatctcctccgcccaggaccggcagctgaccctgagcgggatctacgcccacatcaccaagcattacccctactaccggacggccgacaaaggctggcagaattctatccggcacaacctctctttgaaccgttactttatcaaagtcccacgttcccaggaggagcctgggaaggggtccttttggcgaatagaccctgcctctgaagccaagctcgtggaacaggcattccggaaacggaggcagaggggtgtctcctgcttccgcacccccttcgggcctctgtcctcaaggagcgctccagcttcgcccacacaccccgggctgatgtcccctcgctccggcggcctgcagaccccagagtgcctgtctcgggagggctcccccattccacacgaccctgagtttgggtccaagttagcttctgtcccagagtaccggtattcccaaagcgcacccggctcccccgtcagcgcccagccagtgatcatggccgtgcctccccgaccgtccagcctcgtggccaagcccgtggcctacatgcccgcctccatcgtaacctcacagcagcccgcgggccacgccatccacgtcgtgcagcaggcccccaccgtcaccatggtcagggtggtcaccacatctgccaactcggccaacggatacatcctcaccagccagggcgcggcggggggctcccatgatgcggcgggcgcagccgtgctggacctgggcagcgaggccagaggcctggaggagaaacccaccattgcgtttgccacaatccccgcggctggtggagtcatccagacggtggccagccagatggcccccggggtccccggacacacggtcaccatcctgcagcccgccacacccgtgaccctcgggcagcaccaccttccagtccgggccgtgacccagaacggaaagcatgcggttcccacgaacagtttagccggcaacgcttacgccctcaccagccctttgcagctccttgcgacccaagcgagttcatccgcgccggtggtggtcacccgggtgtgcgaggtggggcccaaggagccagcagcagccgtcgcggccacggccaccaccaccccagccactgccaccaccgcctctgcctccgcctcttccactggagagcccgaggtcaaaaggtcccgggtggaggagcccagtggtgctgtaaccacaccggctggagtgatcgcagctgccggcccccaggggccaggcaccggggagtgaggtcacctgcaacgcgggggagtgggactcacccagcggcgaccccgaagctggacccggcagctcaggcggccgcacccacagacggaggagaacagcccgcggcggcctgtgggcatcggcggcacctggacacacccagccctttccatttgatcgcctgccttcccgtggtttaagacaaaaacacataaacaagttcagacaactgattgtatgattctgggaattctttgctttcctttccttctccctcggcaccacctcctctccccaggcctccctgtcgggcatggggaggaggttggagctcagcatcttgaggaatgtgtcaagacagcccctccgctccgcgctgcacggccagccgcctttgtccgggaggacagacagaaacgcagcaaggcacacaccaaggctgccggggaggcccgggcaccggacagatgcctgttgggaagccaggagctgccgagccacggaccacctaacagcctctccgcccggaacgtgacatagagagtgttggcattaactcggggggtgtccgatttcacttcagaccccaagtttttctttgtttgtttaaacatggaattcagacttcattgtacacctgagacagacacaaaagggatcatgtatttttgaggattttacctgttgacgtctgatgaccggccgtaggtccagggttcccgctgggtttaatcccctcgaagagtaaacctgccgctctgtctgataacttcaagtaagagcagcggcttcctgggttggcgttcgcggtggaaggttcctaggatgaaaggtgagcctggatccgccggccgcagacatcgcgctgctggggacgattggggccgctgctctgcagaccagaccttcccgaattatccgtggctccgatgtcccggtgctgacggccacatggggacctaacagtgccaaacgccatctgctccagctgctttttcacccagttgcagagtcctcaccactcccacattgatctgctgttttcaattggaaccatttctcctgcctgaaactccagggcccctccctgggctgtccgtgagcaggagaccccaccccagcagcagtggtgagcaggcctgtgcctccacgcccagcccccgccaacgcgactggttttgtttgccacacggtgagaaccggaggacgggatgctccagccagttgggtggttctggggtccctgaggaagccccctcctgcacttccattaagacagccagtggttcctggatctttgtcaccaagcagcgttgagccagagctgtctaatgctgagcccagctcaggaaggagagaggagtccttcagtgtgtcttggagatgcgaagtgcgtcctcgtaaaggtcagctgtcagttttgctggccgctccggcgctggctctcctgtccgggaccacaacgagaaacagcgacagattcgacgcagagctccggaagtgcctgaggagcagtggttcttggaaatcgcccgtcctccgcatcacagcctctcaccagcaaagcagcctctgcccaggccctggcgggagagctgcagagggacccaggtgcctggagggcatttgagggaggtggctggacaggtgtctccctgaagaagaagggagaacacttttcaaagtgattccgaggcagtgcgggaggacacacgtgctgtgcagtggagtggggtcgcccgtggcccccatcagagtccccgtcccccaggacaagtgcagaacctctgtgggccccctccttccacctagatagagaaaaccccttgttcggtttccttcccgtgtcccgttgtttttctaagccccccgaattgagtcgtttctatggcactaacctttccatgggaaataagctctttgtggaagtccgtacctgttgccctgggtgaggtttcagagaaacgggggcaggatgaacacagccggctgtcctgggtgcagttacgtccgtggagggtgagagattgcgccccgttccacacttgtgtcgcctgctgttgtctgtgggccttttctttccgtggtgcctggtgtgtgcgtgcatggcgtgagagaacggggggtgggggttggaggtggctccccgacaccggtgcctgtgtggcctgagccggcgccctcccgggagcgcccgtcacggggggcctctgtgattacctgctgctgctctctcccgcgtggtgactatatgtcctcagggctgcctgtggccaccctgatgggagacctctgtttgcttctgggccactgcaggttggcctcctcaatacaagctgatgtctgcagggagcgccgcgtgctgggattgcaccacgtgttggtcacaaatcgaggtcgccttttggcctggtctgctcaggctggccctgacccacgtggtttcctggcttctgagacgcagcgcattcttcctgttagcggtagcgttctctgatttcactgcttcattgccaagggcgtggaaagggggtggtggatggagccgggaggtggcgagcacaggaccccggggctgcattctgccgtgtggggttctgcactgtctagcttctgcggggactgcaaagagggatgaagggacgtggtcctaggggtcggctcagactcggagcagggcagggagaggagggcaaggagaggaggcctgggtcctggatccactgctctgggctcataaccatgagattttgaaagagtttttggtcatctgagcaggtaccatgcctggctcatgccggaacttgtcttggaaccggtagccagaggcccaggaagggacagggcccaaaagggttgcatgtcccggccacaaagccctccctgtgtgccctgagccagcccagcaagcgcctcccagccaggcgctttcgcagaagcaagagcacaggccagggggaccgggagagcctcagcccccagcctgggcggcctgtgaccctgagccgtgtggagccaggacccaagaaccttctctaggttctcaagggtgagctgacccgggcaatgtgcaggaatgtggggagcaaaagtagctgattccagccccgttctggggtcactggggaggcagaggctgagggcctgttctctggtcaccagggactgggggcacggtccacagcggatgagaacagcaggtcacagtagtggctttgggaagggcccctcctgctttgccctgttcggaaaggggctccctcagagcccctgggcccagtaacccgcttctgtctcctgactcctgctggataaattgccaggtttatcaaatacaagaaaacacctgctttggctaggaggtaagtcccaaaaagaacgtcttaagtagagcaaaggcatccaccgaggccatttggtggcccctgggaagtggggaagcagggcctgagcgtccccaggctgctagggcagcagctggctcagggcacactctctcgtgccagcttctgccaccagcccagtgtccacggagccgcggggccagaggagctcagggagacctggctgtctagggcatggtacccagtatcccggtgtgtgcccatcctcagccacttgtgtctttctttccatgtgggagttctcccggtgacacctgccctccgttgagggtggaatctgtcactcatgcctttgagggacccagatggaccatccctcttctgcttgctttctacattcctaaaaacctcaacgttaatccctcaccagtcgggccgagtgtggcctcatggttctgccgcggcccagtcttctcccactggcttcacgctagagggcgccatgcgctctgggtgaaatgagacgctggtgtggggtccccatgtagagaccctcaggtccctatccagagaccctccaggcagtgctgggaagacactggtggcggggaccatgaccaggcgggtggagccatgtgtgtctcacacctgccgcccctcactttccttcccgaggtctggtaggtcctctttgggatttgctgtttatttgtatctcccttttctttgatttaagaacaatgccaagtgaaaaagctgggaatgaatttctgagttgctgagtgttccctgctcctaggtaccacgctctgtgcttctcaggcagggaggagatggattcggtggagttgggccaggacgggggcttcaccctgccccctccagactgccgaagcccccaagaagttttgagcccagctgggcctcgcctccccggctcctgggtccattttctgtactggtttgagatcacaggcatcattcagcgaatgctcttgtgtcctctgcataaagagggccctccctggagcacccccggggagctgggactctccagaaagccccgggtgagggctccgtcttgagagagagagaaatcccttctttgggcgattcagtgagttcaggaggaggaggaagcttttccttggctttgaaatcagtgtttttatggagacaaagaacagacctcagtgggaaaaatgaaaacgtaatggaacacggggaggtgtcggagaagaaaggattttccccttcgctttcagagccggcgggagtgcaggtctgttttgcttcagaagcctcacattctgctttgcccttgagtgacttcatgcgggatgaggaactgttgacccctctagagaggacaccccaagtccatcctgggctcctcctcacccctctgagaaagcccccctaaaaaaaggcttcagagtcaccggcatgccgcctcacgttgcaggacggaatcgcgcgctcctcacgctggagtaagttacgaaacatgatcgtcaggctctttgcaaacgcagagccccagaacgctggatggaggcctcctcggccctgcgggcggcctggctgcggtaggtctgctgcaaggagccaccacggggactgcgccacactcctgatgaaaacgtgtttacccacagcctcgcctcgagcctccttgacaataccgctgcttcaaagcaatattatttaatgagaatactttacattgctcacatgtgctgctatgaagacaggattagtctgtagacgggactcagctccagaggttcctgggtaatgtattgtggctcttggaaatgagggtagaatttgaaatataacaaatggtctctcgcccggttctgtcccttatttttagattgttttcctgcatcttacaatttccttttcttttcaaagttcctttctccaggcctgtttttcagtgctcaggacacggttttcatcacatacttactgtttttttggttgggttttgatacgaaaagctgctacgtttggtgaccagagggagggtttggaatctgtgctttgcaggggatctcggtgggtaccgcggcccctcgcagggtggcgagtggggtccgtgcctcgagaagggggcccttacccacaccgtgcggcttgaattctgtcggagttgaatctgtggaaaggattgtcccattagagctgctgcgtcctttcctctgtcctccctgtcacccaaaccccgaagtcacagctgcttagaagaatgggattttggggatacaaccacacacatttccctctggactgaaattttaaaaacagacccatttcactgacttctttttttttttttttttttttttttttttgagacggagtctcgctctgtcgcccaggctggagtgcagtggcgtgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccactgacttctttagggaaaatagtttcagtcttgggttgtcttgtgagcccacgggcatgggaccctgtctctgctgggcttttccggccccgtcccagctcctcctcaggcagaggctgcagccctcagctctgctgctggatggaacatttcaaccccctccgggaaggtgggcagggtggagggcccagggctaggcctgccatgcaccatgagcaggggtgctacctgggtgtgtgaagttgggctggcttttcctggaggtgggtgagaaggctctccgggcaaatcagaaggccacgagagagagaggagcggggagagtggtgaggaggattcgtctctgactgatgaacctcgccgtgcctgtctgtcacatccaagtctgtgccagctgctgggaggtcagactcctgccctgagaaacagcccagtccttggagaatgaaaccctgagggtcagtgagtggaggccttccctcggggccagccattcccgggaggcctgagtgtgacctggaagctctgtgggtcaccaagactggcattttccttgtatttttgtgcagggctgaagtgagcgttcctcctctgaattggtgaggctttggaaattttttgtttcttctactcatcctaatggctggttttggctgcccggagtatcagagaatatcactaagagggcagtcagtttatttttaggcatctttctttctgtccagggagaaacccctcggaagaatcttagtcactctttgcacctgccctgtcattctcgccatggggaaaatgcgttgaaaagaaaaataccggggccagggagaagccgtgaatgtatttatttgctttggtgaagctgctgaacactggctgcggagggccccccgcccccatcccgcttcaggccccagtgacccagttgcgtcttaagttccatcgtccagatttcaggccaccagaggctgccaaaggtgactgaagcggtctccaagtcactctgtcaccactttttttttttttgagatggagtctcgctctatcgcccaggctggagtgcagtggcccaatctcggctcactgcaacctccgcctcccaggttcgagcgaattctcctgcctcaacctcccaagtagctgggattacaggcacctgccaccacacccggctaatttttgtatttctaatagagatgagagtgttaccatgttggtcaggctggtcttgaactcctgacctcaggtgatctgcccacctcaacctcccaaagtgctgggattataggcatgagccaccgcgcctggcctctgtcactttttttgctccttacccagtttttgttttttgttgttttgttttgttttagcgtgatactacaatggaaagactcctagttggttattctttatctcggattcttttttctggaattgtttgctcatttgagtggttggtggtttgccctgtgtcagacacggtgaaaagagtgcaggaaagctggggccaggggaagcgaagtggcttcaatccgggctgacagccaagaagagttttcctcccttcggtgacagggcctgcccctccgagtctagaggtaaaagcagcttctagaactggcccctaagtctccaaatgtgttggctaagctgaaatgagagactctgaattagagtttttgtttgtttgtttgttctctgcatgaagttcacaggcctgtatggatgttaaattgtgtctatagcctctaaatctccaggttaactggtccagattttttttttttaatcagtaacaatgggaatttaaaatcaaatatttggccaggtgcggtggctcatgcccgtaatcccagcactttgggaggccgaggcaggcgcatcacctgaggagtttgagaccagcctgaccaacatggtgaaatcctgtctctactaaaaatacaaaaaattagccaggcgtggtggcgtgtgcctgtaatcccagctaccagggaggctgaggcatgagaatcgcttgaacctgggagatggaggttgcagtgagccgagatcatgccactgcactccagcctgggcaacagagggagactctgtctcaaaaataataatcaaatcaagtattttaagtttggctcttctttttttcaagaaaggctttttggatacctagaataccttcatgtatgtggcttgatttctgtttcaggaaaaggggggcgggaggagagacaacagccgtgttccagagtctgtcctgagatgtcgctgagtccagacacttgggctgcacgtgccctgcagatgacaaaggccggcagctcagcacacgtgcaggaggggttaaagccaatattgagtttttgttcttgttgttttaatctgaacgattattctcctgtaaaaataatttgggaggggcgggtgttgttcggtgtgtgtgtgtgtgtgtgtgtgtgtgtgtgtgtgtgtatttttttttttacagtggcgcctgtctaaagtatttttcacaacatgtttgataatcagtgctttaaaaagcagcagtgtcctatgaagtggaaatgtcagttctagagcattggatgtgaagttctggtcatgtcaccttgcgtgtctcaccctggaggagtgaaggtgggcgcccggcgggggggtgtggctgcaccccagcaccgggagggggcacgcacgacaccagaggaagggacagccccacccatgtcaacagcaggcaacctgtgttttcatttcaagtgggatacagtatttttttaataaggagccatacttttttttaagagtttgagatctgaatgtgatttctaattgtatcagacgttaatgttttaaagctataacaaagtttaaaatttctactttttgtttttcatttattttaactgttcttttatctattaaattgttgtatgtggatggggaagttttgtttctcctcttagcatttgtttctataaccagaaataaaattctatattaaagaaatgac

SEQ ID NO: 3871 - DNA, 2032 bp, Homo sapiens
cagcactttgggaggccgaggctggcggatcacgaggtcaggagatcgagaccatcctggctaacacggcaggagtgcagatgtgatctcggcacaccgcaacctctgcctcttggattcaagcaattctcctgcctcagcctcccaagtggctgggattacaggcatgcgccaccacgcccagggtttggcaaatggattctgcagagtcagatgccttaacttcgtgtagtggtcttgtggatggcttactgccttggagttaatttcgttccttctcgtttctgctaccagcttcacaggcttctgctaaggtgtaccttccggtttcccagcacggccatcaagatccagttcacgtcgctctatcacaaagaagaggccccagcctccccgctgcggccactgtacccccagatctcccctctgaagatccacatcccggagccggacctccggagcatggtcagccccgtcccctccccgacgggcaccatcagtgtccccaactcctgcccagccagtccacgcggtgccggctcctccagttaccgctttgtgcagaacgtgacctcggacctgcagctggcagcagagtttgcagcaaaggccgcgtcggagcagcaggcagacacgtctggaggagacagccccaaggatgagtcaaagccgccgttctcctacgcgcagctgatcgtgcaggccatctcctccgcccaggaccggcagctgaccctgagcgggatctacgcccacatcaccaagcattacccctactaccggacggccgacaaaggctggcagaattctatccggcacaacctctctttgaaccgttactttatcaaagtcccacgttcccaggaggagcctgggaaggggtccttttggcgaatagaccctgcctctgaagccaagctcgtggaacaggcattccggaaacggaggcagaggggtgtctcctgcttccgcacccccttcgggcctctgtcctcaaggagcgctccagcttcgcccacacaccccgggctgatgtcccctcgctccggcggcctgcagaccccagagtgcctgtctcgggagggctcccccattccacacgaccctgagtttgggtccaagttagcttctgtcccagagtaccggtattcccaaagcgcacccggctcccccgtcagcgcccagccagtgatcatggccgtgcctccccgaccgtccagcctcgtggccaagcccgtggcctacatgcccgcctccatcgtaacctcacagcagcccgcgggccacgccatccacgtcgtgcagcaggcccccaccgtcaccatggtcagggtggtcaccacatctgccaactcggccaacggatacatcctcaccagccagggcgcggcggggggctcccatgatgcggcgggcgcagccgtgctggacctgggcagcgaggccagaggcctggaggagaaacccaccattgcgtttgccacaatccccgcggctggtggagtcatccagacggtggccagccagatggcccccggggtccccggacacacggtcaccatcctgcagcccgccacacccgtgaccctcgggcagcaccaccttccagtccgggccgtgacccagaacggaaagcatgcggttcccacgaacagtttagccggcaacgcttacgccctcaccagccctttgcagctccttgcgacccaagcgagttcatccgcgccggtggtggtcacccgggtgtgcgaggtggggcccaaggagccagcagcagccgtcgcggccacggccaccaccaccccagccactgccaccaccgcctctgcctccgcctcttccactggagagcccgaggtcaaaaggtcccgggtggaggagcccagtggtgctgtaaccacaccggctggagtgatcgcagctgccggcccccaggggccaggcaccggggagtgaggtcacctgcaacgcgggggagtgggactcacccagcggcgaccccgaagctggacccggcagctcaggcggccgc

SEQ ID NO: 3872 - DNA, 11167 bp, Homo sapiens
ccgcgcgaacatggccgaagtcggcgaggacagcggcgcccgcgccctgctcgcgctgcgctcggcgccctgcagcccagtgctgtgcgccgcagccgccgccgccgccttccccgcggccgcacccccgccggcccccgcgcagccccagcctccgcccgggccgccgccgccgccgccaccgccgctgcctccgggcgcgatcgcgggcgcgggctcctccgggggctcctccggggtatccggggactccgcggtcgcgggcgcggcgccggccctggtggccgcggcggccgcctcggtacggcagagcccggggccggcgctggcgcggctggagggccgcgagttcgagttcctcatgcgccagcccagcgtcaccatcggccgcaactcgtcgcagggctcggtggacttgagcatgggcctgtccagcttcatctcgcggcgccacctgcagctcagcttccaggagccgcacttctacctgcgctgcctcggcaagaacggcgtcttcgtggacggggccttccagagacgcggcgcgcccgccctgcagctgcccaagcagtgtaccttccggtttcccagcacggccatcaagatccagttcacgtcgctctatcacaaagaagaggccccagcctccccgctgcggccactgtacccccagatctcccctctgaagatccacatcccggagccggacctccggagcatggtcagccccgtcccctccccgacgggcaccatcagtgtccccaactcctgcccagccagtccacgcggtgccggctcctccagttaccgctttgtgcagaacgtgacctcggacctgcagctggcagcagagtttgcagcaaaggccgcgtcggagcagcaggcagacacgtctggaggagacagccccaaggatgagtcaaagccgccgttctcctacgcgcagctgatcgtgcaggccatctcctccgcccaggaccggcagctgaccctgagcgggatctacgcccacatcaccaagcattacccctactaccggacggccgacaaaggctggcagaattctatccggcacaacctctctttgaaccgttactttatcaaagtcccacgttcccaggaggagcctgggaaggggtccttttggcgaatagaccctgcctctgaagccaagctcgtggaacaggcattccggaaacggaggcagaggggtgtctcctgcttccgcacccccttcgggcctctgtcctcaaggagcgctccagcttcgcccacacaccccgggctgatgtcccctcgctccggcggcctgcagaccccacccattccacacgaccctgagtttgggtccaagttagcttctgtcccagagtaccggtattcccaaagcgcacccggctcccccgtcagcgcccagccagtgatcatggccgtgcctccccgaccgtccagcctcgtggccaagcccgtggcctacatgcccgcctccatcgtaacctcacagcagcccgcgggccacgccatccacgtcgtgcagcaggcccccaccgtcaccatggtcagggtggtcaccacatctgccaactcggccaacggatacatcctcaccagccagggcgcggcggggggctcccatgatgcggcgggcgcagccgtgctggacctgggcagcgaggccagaggcctggaggagaaacccaccattgcgtttgccacaatccccgcggctggtggagtcatccagacggtggccagccagatggcccccggggtccccggacacacggtcaccatcctgcagcccgccacacccgtgaccctcgggcagcaccaccttccagtccgggccgtgacccagaacggaaagcatgcggttcccacgaacagtttagccggcaacgcttacgccctcaccagccctttgcagctccttgcgacccaagcgagttcatccgcgccggtggtggtcacccgggtgtgcgaggtggggcccaaggagccagcagcagccgtcgcggccacggccaccaccaccccagccactgccaccaccgcctctgcctccgcctcttccactggagagcccgaggtcaaaaggtcccgggtggaggagcccagtggtgctgtaaccacaccggctggagtgatcgcagctgccggcccccaggggccaggcaccggggagtgaggtcacctgcaacgcgggggagtgggactcacccagcggcgaccccgaagctggacccggcagctcaggcggccgcacccacagacggaggagaacagcccgcggcggcctgtgggcatcggcggcacctggacacacccagccctttccatttgatcgcctgccttcccgtggtttaagacaaaaacacataaacaagttcagacaactgattgtatgattctgggaattctttgctttcctttccttctccctcggcaccacctcctctccccaggcctccctgtcgggcatggggaggaggttggagctcagcatcttgaggaatgtgtcaagacagcccctccgctccgcgctgcacggccagccgcctttgtccgggaggacagacagaaacgcagcaaggcacacaccaaggctgccggggaggcccgggcaccggacagatgcctgttgggaagccaggagctgccgagccacggaccacctaacagcctctccgcccggaacgtgacatagagagtgttggcattaactcggggggtgtccgatttcacttcagaccccaagtttttctttgtttgtttaaacatggaattcagacttcattgtacacctgagacagacacaaaagggatcatgtatttttgaggattttacctgttgacgtctgatgaccggccgtaggtccagggttcccgctgggtttaatcccctcgaagagtaaacctgccgctctgtctgataacttcaagtaagagcagcggcttcctgggttggcgttcgcggtggaaggttcctaggatgaaaggtgagcctggatccgccggccgcagacatcgcgctgctggggacgattggggccgctgctctgcagaccagaccttcccgaattatccgtggctccgatgtcccggtgctgacggccacatggggacctaacagtgccaaacgccatctgctccagctgctttttcacccagttgcagagtcctcaccactcccacattgatctgctgttttcaattggaaccatttctcctgcctgaaactccagggcccctccctgggctgtccgtgagcaggagaccccaccccagcagcagtggtgagcaggcctgtgcctccacgcccagcccccgccaacgcgactggttttgtttgccacacggtgagaaccggaggacgggatgctccagccagttgggtggttctggggtccctgaggaagccccctcctgcacttccattaagacagccagtggttcctggatctttgtcaccaagcagcgttgagccagagctgtctaatgctgagcccagctcaggaaggagagaggagtccttcagtgtgtcttggagatgcgaagtgcgtcctcgtaaaggtcagctgtcagttttgctggccgctccggcgctggctctcctgtccgggaccacaacgagaaacagcgacagattcgacgcagagctccggaagtgcctgaggagcagtggttcttggaaatcgcccgtcctccgcatcacagcctctcaccagcaaagcagcctctgcccaggccctggcgggagagctgcagagggacccaggtgcctggagggcatttgagggaggtggctggacaggtgtctccctgaagaagaagggagaacacttttcaaagtgattccgaggcagtgcgggaggacacacgtgctgtgcagtggagtggggtcgcccgtggcccccatcagagtccccgtcccccaggacaagtgcagaacctctgtgggccccctccttccacctagatagagaaaaccccttgttcggtttccttcccgtgtcccgttgtttttctaagccccccgaattgagtcgtttctatggcactaacctttccatgggaaataagctctttgtggaagtccgtacctgttgccctgggtgaggtttcagagaaacgggggcaggatgaacacagccggctgtcctgggtgcagttacgtccgtggagggtgagagattgcgccccgttccacacttgtgtcgcctgctgttgtctgtgggccttttctttccgtggtgcctggtgtgtgcgtgcatggcgtgagagaacggggggtgggggttggaggtggctccccgacaccggtgcctgtgtggcctgagccggcgccctcccgggagcgcccgtcacggggggcctctgtgattacctgctgctgctctctcccgcgtggtgactatatgtcctcagggctgcctgtggccaccctgatgggagacctctgtttgcttctgggccactgcaggttggcctcctcaatacaagctgatgtctgcagggagcgccgcgtgctgggattgcaccacgtgttggtcacaaatcgaggtcgccttttggcctggtctgctcaggctggccctgacccacgtggtttcctggcttctgagacgcagcgcattcttcctgttagcggtagcgttctctgatttcactgcttcattgccaagggcgtggaaagggggtggtggatggagccgggaggtggcgagcacaggaccccggggctgcattctgccgtgtggggttctgcactgtctagcttctgcggggactgcaaagagggatgaagggacgtggtcctaggggtcggctcagactcggagcagggcagggagaggagggcaaggagaggaggcctgggtcctggatccactgctctgggctcataaccatgagattttgaaagagtttttggtcatctgagcaggtaccatgcctggctcatgccggaacttgtcttggaaccggtagccagaggcccaggaagggacagggcccaaaagggttgcatgtcccggccacaaagccctccctgtgtgccctgagccagcccagcaagcgcctcccagccaggcgctttcgcagaagcaagagcacaggccagggggaccgggagagcctcagcccccagcctgggcggcctgtgaccctgagccgtgtggagccaggacccaagaaccttctctaggttctcaagggtgagctgacccgggcaatgtgcaggaatgtggggagcaaaagtagctgattccagccccgttctggggtcactggggaggcagaggctgagggcctgttctctggtcaccagggactgggggcacggtccacagcggatgagaacagcaggtcacagtagtggctttgggaagggcccctcctgctttgccctgttcggaaaggggctccctcagagcccctgggcccagtaacccgcttctgtctcctgactcctgctggataaattgccaggtttatcaaatacaagaaaacacctgctttggctaggaggtaagtcccaaaaagaacgtcttaagtagagcaaaggcatccaccgaggccatttggtggcccctgggaagtggggaagcagggcctgagcgtccccaggctgctagggcagcagctggctcagggcacactctctcgtgccagcttctgccaccagcccagtgtccacggagccgcggggccagaggagctcagggagacctggctgtctagggcatggtacccagtatcccggtgtgtgcccatcctcagccacttgtgtctttctttccatgtgggagttctcccggtgacacctgccctccgttgagggtggaatctgtcactcatgcctttgagggacccagatggaccatccctcttctgcttgctttctacattcctaaaaacctcaacgttaatccctcaccagtcgggccgagtgtggcctcatggttctgccgcggcccagtcttctcccactggcttcacgctagagggcgccatgcgctctgggtgaaatgagacgctggtgtggggtccccatgtagagaccctcaggtccctatccagagaccctccaggcagtgctgggaagacactggtggcggggaccatgaccaggcgggtggagccatgtgtgtctcacacctgccgcccctcactttccttcccgaggtctggtaggtcctctttgggatttgctgtttatttgtatctcccttttctttgatttaagaacaatgccaagtgaaaaagctgggaatgaatttctgagttgctgagtgttccctgctcctaggtaccacgctctgtgcttctcaggcagggaggagatggattcggtggagttgggccaggacgggggcttcaccctgccccctccagactgccgaagcccccaagaagttttgagcccagctgggcctcgcctccccggctcctgggtccattttctgtactggtttgagatcacaggcatcattcagcgaatgctcttgtgtcctctgcataaagagggccctccctggagcacccccggggagctgggactctccagaaagccccgggtgagggctccgtcttgagagagagagaaatcccttctttgggcgattcagtgagttcaggaggaggaggaagcttttccttggctttgaaatcagtgtttttatggagacaaagaacagacctcagtgggaaaaatgaaaacgtaatggaacacggggaggtgtcggagaagaaaggattttccccttcgctttcagagccggcgggagtgcaggtctgttttgcttcagaagcctcacattctgctttgcccttgagtgacttcatgcgggatgaggaactgttgacccctctagagaggacaccccaagtccatcctgggctcctcctcacccctctgagaaagcccccctaaaaaaaggcttcagagtcaccggcatgccgcctcacgttgcaggacggaatcgcgcgctcctcacgctggagtaagttacgaaacatgatcgtcaggctctttgcaaacgcagagccccagaacgctggatggaggcctcctcggccctgcgggcggcctggctgcggtaggtctgctgcaaggagccaccacggggactgcgccacactcctgatgaaaacgtgtttacccacagcctcgcctcgagcctccttgacaataccgctgcttcaaagcaatattatttaatgagaatactttacattgctcacatgtgctgctatgaagacaggattagtctgtagacgggactcagctccagaggttcctgggtaatgtattgtggctcttggaaatgagggtagaatttgaaatataacaaatggtctctcgcccggttctgtcccttatttttagattgttttcctgcatcttacaatttccttttcttttcaaagttcctttctccaggcctgtttttcagtgctcaggacacggttttcatcacatacttactgtttttttggttgggttttgatacgaaaagctgctacgtttggtgaccagagggagggtttggaatctgtgctttgcaggggatctcggtgggtaccgcggcccctcgcagggtggcgagtggggtccgtgcctcgagaagggggcccttacccacaccgtgcggcttgaattctgtcggagttgaatctgtggaaaggattgtcccattagagctgctgcgtcctttcctctgtcctccctgtcacccaaaccccgaagtcacagctgcttagaagaatgggattttggggatacaaccacacacatttccctctggactgaaattttaaaaacagacccatttcactgacttctttttttttttttttttttttttttttttgagacggagtctcgctctgtcgcccaggctggagtgcagtggcgtgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccactgacttctttagggaaaatagtttcagtcttgggttgtcttgtgagcccacgggcatgggaccctgtctctgctgggcttttccggccccgtcccagctcctcctcaggcagaggctgcagccctcagctctgctgctggatggaacatttcaaccccctccgggaaggtgggcagggtggagggcccagggctaggcctgccatgcaccatgagcaggggtgctacctgggtgtgtgaagttgggctggcttttcctggaggtgggtgagaaggctctccgggcaaatcagaaggccacgagagagagaggagcggggagagtggtgaggaggattcgtctctgactgatgaacctcgccgtgcctgtctgtcacatccaagtctgtgccagctgctgggaggtcagactcctgccctgagaaacagcccagtccttggagaatgaaaccctgagggtcagtgagtggaggccttccctcggggccagccattcccgggaggcctgagtgtgacctggaagctctgtgggtcaccaagactggcattttccttgtatttttgtgcagggctgaagtgagcgttcctcctctgaattggtgaggctttggaaattttttgtttcttctactcatcctaatggctggttttggctgcccggagtatcagagaatatcactaagagggcagtcagtttatttttaggcatctttctttctgtccagggagaaacccctcggaagaatcttagtcactctttgcacctgccctgtcattctcgccatggggaaaatgcgttgaaaagaaaaataccggggccagggagaagccgtgaatgtatttatttgctttggtgaagctgctgaacactggctgcggagggccccccgcccccatcccgcttcaggccccagtgacccagttgcgtcttaagttccatcgtccagatttcaggccaccagaggctgccaaaggtgactgaagcggtctccaagtcactctgtcaccactttttttttttttgagatggagtctcgctctatcgcccaggctggagtgcagtggcccaatctcggctcactgcaacctccgcctcccaggttcgagcgaattctcctgcctcaacctcccaagtagctgggattacaggcacctgccaccacacccggctaatttttgtatttctaatagagatgagagtgttaccatgttggtcaggctggtcttgaactcctgacctcaggtgatctgcccacctcaacctcccaaagtgctgggattataggcatgagccaccgcgcctggcctctgtcactttttttgctccttacccagtttttgttttttgttgttttgttttgttttagcgtgatactacaatggaaagactcctagttggttattctttatctcggattcttttttctggaattgtttgctcatttgagtggttggtggtttgccctgtgtcagacacggtgaaaagagtgcaggaaagctggggccaggggaagcgaagtggcttcaatccgggctgacagccaagaagagttttcctcccttcggtgacagggcctgcccctccgagtctagaggtaaaagcagcttctagaactggcccctaagtctccaaatgtgttggctaagctgaaatgagagactctgaattagagtttttgtttgtttgtttgttctctgcatgaagttcacaggcctgtatggatgttaaattgtgtctatagcctctaaatctccaggttaactggtccagattttttttttttaatcagtaacaatgggaatttaaaatcaaatatttggccaggtgcggtggctcatgcccgtaatcccagcactttgggaggccgaggcaggcgcatcacctgaggagtttgagaccagcctgaccaacatggtgaaatcctgtctctactaaaaatacaaaaaattagccaggcgtggtggcgtgtgcctgtaatcccagctaccagggaggctgaggcatgagaatcgcttgaacctgggagatggaggttgcagtgagccgagatcatgccactgcactccagcctgggcaacagagggagactctgtctcaaaaataataatcaaatcaagtattttaagtttggctcttctttttttcaagaaaggctttttggatacctagaataccttcatgtatgtggcttgatttctgtttcaggaaaaggggggcgggaggagagacaacagccgtgttccagagtctgtcctgagatgtcgctgagtccagacacttgggctgcacgtgccctgcagatgacaaaggccggcagctcagcacacgtgcaggaggggttaaagccaatattgagtttttgttcttgttgttttaatctgaacgattattctcctgtaaaaataatttgggaggggcgggtgttgttcggtgtgtgtgtgtgtgtgtgtgtgtgtgtgtgtgtgtgtatttttttttttacagtggcgcctgtctaaagtatttttcacaacatgtttgataatcagtgctttaaaaagcagcagtgtcctatgaagtggaaatgtcagttctagagcattggatgtgaagttctggtcatgtcaccttgcgtgtctcaccctggaggagtgaaggtgggcgcccggcgggggggtgtggctgcaccccagcaccgggagggggcacgcacgacaccagaggaagggacagccccacccatgtcaacagcaggcaacctgtgttttcatttcaagtgggatacagtatttttttaataaggagccatacttttttttaagagtttgagatctgaatgtgatttctaattgtatcagacgttaatgttttaaagctataacaaagtttaaaatttctactttttgtttttcatttattttaactgttcttttatctattaaattgttgtatgtggatggggaagttttgtttctcctcttagcatttgtttctataaccagaaataaaattctatattaaagaaatgac

SEQ ID NO: 3873 - DNA, 1870 bp, Homo sapiens
atgcgccagcccagcgtcaccatcggccgcaactcgtcgcagggctcggtggacttgagcatgggcctgtccagcttcatctcgcggcgccacctgcagctcagcttccaggagccgcacttctacctgcgctgcctcggcaagaacggcgtcttcgtggacggggccttccagagacgcggcgcgcccgccctgcagctgcccaagcagtgtaccttccggtttcccagcacggccatcaagatccagttcacgtcgctctatcacaaagaagaggccccagcctccccgctgcggccactgtacccccagatctcccctctgaagatccacatcccggagccggacctccggagcatggtcagccccgtcccctccccgacgggcaccatcagtgtccccaactcctgcccagccagtccacgcggtgccggctcctccagttaccgctttgtgcagaacgtgacctcggacctgcagctggcagcagagtttgcagcaaaggccgcgtcggagcagcaggcagacacgtctggaggagacagccccaaggatgagtcaaagccgccgttctcctacgcgcagctgatcgtgcaggccatctcctccgcccaggaccggcagctgaccctgagcgggatctacgcccacatcaccaagcattacccctactaccggacggccgacaaaggctggcagaattctatccggcacaacctctctttgaaccgttactttatcaaagtcccacgttcccaggaggagcctgggaaggggtccttttggcgaatagaccctgcctctgaagccaagctcgtggaacaggcattccggaaacggaggcagaggggtgtctcctgcttccgcacccccttcgggcctctgtcctcaaggagcgctccagcttcgcccacacaccccgggctgatgtcccctcgctccggcggcctgcagaccccagagtgcctgtctcgggagggctcccccattccacacgaccctgagtttgggtccaagttagcttctgtcccagagtaccggtattcccaaagcgcacccggctcccccgtcagcgcccagccagtgatcatggccgtgcctccccgaccgtccagcctcgtggccaagcccgtggcctacatgcccgcctccatcgtaacctcacagcagcccgcgggccacgccatccacgtcgtgcagcaggcccccaccgtcaccatggtcagggtggtcaccacatctgccaactcggccaacggatacatcctcaccagccagggcgcggcggggggctcccatgatgcggcgggcgcagccgtgctggacctgggcagcgaggccagaggcctggaggagaaacccaccattgcgtttgccacaatccccgcggctggtggagtcatccagacggtggccagccagatggcccccggggtccccggacacacggtcaccatcctgcagcccgccacacccgtgaccctcgggcagcaccaccttccagtccgggccgtgacccagaacggaaagcatgcggttcccacgaacagtttagccggcaacgcttacgccctcaccagccctttgcagctccttgcgacccaagcgagttcatccgcgccggtggtggtcacccgggtgtgcgaggtggggcccaaggagccactgccaccaccgcctctgcctccgcctcttccactggagagcccgaggtcaaaaggtcccgggtggaggagcccagtggtgctgtaaccacaccggctggagtgatcgcagctgccggcccccaggggccaggcaccggggagtgaggtcacctgcaacgcgggggagtgggactcacccagcggcgaccccgaagctggacccg

SEQ ID NO: 3874 - DNA, 3436 bp, Homo sapiens
acggctttctttgaggccaggactgggtgatggtgtcgctacccccgccgcagtctgacgtcacgctgccgggccccaccagactggagggcgagcgccaaggggacctcatgcaggcaccgggcctcccaggctcccctgccccacagagtaagcatgccggcttcagctgctcgtcatttgtgtccgacggccctccagagaggacaccctcactgcccccacacagcccccgcattgcgtcaccagggcccgagcaagtccagggccactgcccagccggccccggccctgggcccttcaggctctcaccctcagacaagtatcctggctttggctttgaggaggccgcagcaagcagccctgggcgattcctcaagggcagccacgcgcccttccacccgtacaagcggcctttccatgaggacgtcttcccagaggccgagaccaccctggccctcaaaggacactcctttaagaccccagggccgctggaggccttcgaggagatcccagtggacgtggcggaggccgaggccttcctgcctggcttctcagcagaggcctggtgtaacgggctcccctaccccagccaggagcatggcccccaagtcctgggttcagaggtcaaagtcaagcccccagttctggagagtggtgctgggatgttctgctaccagcctcccttgcagcatatgtactgctcctcccagccccccttccaccagtactcgccaggtggtggcagctaccccataccctacctgggctcctcacactatcagtaccagcgaatggcaccccaggccagcaccgatgggcaccagcctctcttcccaaaacccatctattcctacagcatcctcatcttcatggcccttaagaacagtaaaactgggagccttcccgtcagcgagatctacaattttatgacggagcactttccttacttcaagacagcacccgatggctggaagaattctgtccggcacaacctatccctcaacaagtgcttcgagaaggtggagaacaaatcaggaagttcctcccgcaagggctgcctgtgggccctcaatccggccaagatcgacaagatgcaagaggagctgcaaaaatggaagaggaaagatcccattgctgtgcgcaaaagcatggccaagccagaagagctggacagcctcattggagacaagagagaaaagctgggctccccactcctgggctgtccgccccctgggctgtccggctcaggccccatccggcccctggcacccccagctggcctctccccaccactgcactcactccacccagctccaggccccattcctggcaagaaccccctgcaggacctacttatggggcacacaccctcctgctatgggcagacatacttgcacctctcaccaggcctggcccctcctggacccccgcagccattgttcccacagccggacgggcaccttgagctgcgggcccagccaggcaccccccaggactcgcctctgcctgcccacaccccacccagccacagtgccaagctactggccgagccttccccagccaggactatgcacgacaccctgctgccagatggagaccttggcactgacctggatgccatcaatccctcactcactgacttcgacttccagggaaacctgtgggaacagttgaaggatgatagcttggccctcgaccccctggtactggtgacctcatccccgacatcatcttcgatgccaccaccccagccaccacctcactgcttcccccctgggccctgtctgacagagacaggcagtggggcaggtgacttggcagccccgggcagtggtggctccggggcactgggtgacctgcacctcaccaccctctactctgcctttatggagctggagcccacgccccccacggcccctgcaggcccctctgtgtacctcagccccagctccaagcccgtggccctggcatgagctgtgcccagcttcgtcagctccagcgtttgcctggtctggaagtcctggccggccgcccacatcgggctcaccttaaaggtcaaggaaggaaaatactacctgtcccctatgccactaagccaacgtgtgtgtcagctggtagctgggggcgcagaggacatcacctggggtgctgcctctcacacatttctgccacgtggtggcccagctcctcacccagggcccccaaagagcaagcgtctgggcaagaggaaaatgccctgtccctagctcacactcatccacacttaagccctcgtgcacacacacaaattattcagatgtacacccacccacatatcttacagccagaggaaccagcactccatcactgagagcccgacttcgtttctggggcaactgagagctgagcgctttgcttaccaaaagctcagggccctgtgccaggccaaagatccccccagacccccattctgacatccacatgctctgcagtcctggccccctcgtcattttctttcccagaagcgccctgtatttattcccccatcttcatcccaacagcccagcaagaaggaggagacagagagctcctccctgggttgtctgtggacccccccaggagctgctaattggcagcacccactcagccattctctacccatccttagtacatgctctgtccagctttccccagggtgacatacagaaggggcaacatctacccgggcaccaaactgagcccaattccgaagcagtgtttggaaaagcccttgccctcggaaacttgaacatgtcctttttccccagtcccgggtgcaggaagggccccctccaggtcaccacaatctcactcctcctccagaaagaaaagttcacatagtttaggtcctggcttaactctacttatgatggttcaacttacactttttcaactttaagatggtgcaaaagcaatacacattcagtatgttcctcgacttaggatgcggttatgtccgataaacccattgtaaattgaaaccaccgaaagtcaaaaaccactttcgacttacgatgtttcccactcacgatgggtttctccggatgtagccccatcataagttgaggagcacctgttagttacttccaactgtctcaggcaacctgggcattcaggagaaaagcctggcacagggtgacagggaagcacccatgcaaagcacccccgctttgactgcttggcagacctagggtgcccgggaagcacaagggatacccttggccctgcggggtgtggcccaggtgcctgccatgagcctgaccccatcgagggggaacctcagcccaccctgggcctgggggtgacaagaacttccacaggttggccccaggcttataggaggcataagcagatcccgcgatggcttgtcattgtcccctgtcctggaacaataaagcaagtgccttgtggtctc

SEQ ID NO: 3875 - DNA, 2274 bp, Homo sapiens
gcacacactcatcgaaaaaaatttggattattagaagagagaggtctgcggcttccacaccgtacagcgtggtttttcttctcggtataaaagcaaagttgtttttgatacgtgacagtttcccacaagccaggctgatccttttctgtcagtccacttcaccaagcctgcccttggacaaggacccgatgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcagctggtgctggagaaggagaagctgagtgccatgcaggcccacctggctgggaaaatggcactgaccaaggcttcatctgtggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctgacctcaagatcaaggaaaggaggatggacgaacaggggccaaactggtgggaggcagaggtggtgggggcagggatgataggccctggatgtgcccacagggaccaagaagtgaggtttccactgtcttgcctgccagggcccctgttcccccgctggcagccaccccctcccccatcatatcctttgccccaaggctgctcagaggggccccggtcctggccccagcccccacctccgccccagacacaccccccagtcgagccctgcagccaaacagagccttcacaaccagccacacagagcctgcctcagctgctcgcacagattacttcagggctggaaaagtcacacagacacacaaaatgtcacaatcctgtccctcactcaacacaaaccccaaaacacagagagcctgcctcagtacactcaaacaacctcaaagctgcatcatcacacaatcacacacaagcacagccctgacaacccacacaccccaaggcacgcacccacagccagcctcagggcccacaggggcactgtcaacacaggggtgtgcccagaggcctacacagaagcagcgtcagtaccctcaggatctgaggtcccaacacgtgctcgctcacacacacggcctgttagaattcacctgtgtatctcacgcatatgcacacgcacagccccccagtgggtctcttgagtcccgtgcagacacacacagccacacacactgccttgccaaaaataccccgtgtctcccctgccactcacctcactcccattccctgagccctgatccatgcctcagcttagactgcagaggaactactcatttatttgggatccaaggcccccaacccacagtaccgtccccaataaactgcagccgagctcccc

SEQ ID NO: 3876 - DNA, 2434 bp, Homo sapiens
attactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgaagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaagagacgagtatttgtagagatggtgaagaacaggatgcagaactcaaattcccaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaagtctttaaagattgttaccctagtgtttcatttcctagaccagtattttgaacaatattatattttggagactgtggggagaagggttcttctttaaaaatacctatgaatgtacacgaactcaggtatatgaagaatagaagtgtgtaacccagatgtccaggcctggtagatataattatgtggtccacgttgggtcatgatgttcccaaatatcaaacctcctaagacttc

SEQ ID NO: 3877 - DNA, 5090 bp, Homo sapiens
gggtgcgagctggagactccgcgggagcgcggccgggaggcttcgccccggagctggcccgacgcctcccgagctggcagggctctcggcggaggtcggagcgtgggcttcctcctcccgccagggaaaacagagaggatgaaggcctatctaaagagcgcagaaggcttttttgtcctaaataaaagtaccacaattggaaggcatgaaaattcagaccttgttttacagtctcctgacatcgacaaccaccatgcactcattgaatataacgaggcggagtgcagctttgttctccaggacttcaattcccgcaacggcacgtttgtcaacgagtgccacattcaaaacgtggctgtgaagctcatccctggagacatcctgagatttgggtctgcagggctgacctatgaactggtcattgaaaatccacctccggtctctttcccatggatgaggggcccagcaccatggccagggccacagccacctcgtgccacacagcagccaaaccaggcccccccaccatcacatatccccttccaccaaggtgtccagccagcaccgatgcaaaggagctggtcccaggcctttcccagacccaccgtggtcctgccggcctcccacaggcggcctgtgagcgccaacaaggagatgttctcgttcgtggtggacgacgcccgcaagccacccgtcatcaagcaagtgtggaccaatgccatgaaactgtcagaaaaatcagtggccgaggggattcctggggcagttccccctgcggagatttatgtggaggaggacttggcccagcaggacaaggatgaaataattctgctgctgggaaaagaggtcagccgtctctcagattatgaaattgaatccaaatacaaagacgtcataatagcaaacctgcagaatgaagtggctgagctgagtcagaaggtgtcagagaccaccacctccaggcagaatgagaaggagatctcgcagaagtgtcaggttctggatgaagacatcgatgccaaacagaaagagatccagagcttgaaaagccagatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagatgctcggtgctaaaggaagagttaaaacaggaagatgctcacagggagctcagggaagcccaggagaaagagttaaaactctgcaaaacccaaatccaagacatggagaaagaaatgaagaagcttagggcagagctgaggaagagttgtactgaacaaagcgtgatctctaggactctgagagaaaaaagcaaggttgaagagaagcttcaggaggattccagaaggaaattgcttcagctgcaagaaatggggaacagagagagcgtcattaaaatcaatttggagagggcagtaggtcagctggagcacttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagatcaagttcaacagttctcaggaaactcagcagtctttactgcaggaaaagctgcgggagcatctggcagagaaggagaagctgaacgaggagaggctagagcaagaggagaagctcaaagccaaaatcaggcaactgacggaagagaaggcggtaaggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggaggttttggagagcagcatagcccatgaaaaaagaaaagcaaaggaagccttggagtcggaaaagagaaaagttcaggatctggagaaccatttaacccaacagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgaagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaagtctttaaagattgttaccctagtgtttcatttcctagaccagtattttgaacaatattatattttggagactgtggggagaagggttcttctttaaaaatacctatgaatgtacacgaactcaggtatatgaagaatagaagtgtgtaacccagatgtccaggcctggtagatataattatgtggtccacgttgggtcatgatgttcccaaatatcaaacctcctaagacttccaacagactcacacttgagaaaacctaagacttgtactggagcctcagggcagaattgtaaccttggagctctcagggccttgggatagtgaattcaagtctccgttatggcctggcaggatggctcatgcctgtaatctcagcactttgggaggccgaggcaggcggattataagatcaggagtttgagaccagcctggcaaacatagtgaatacctgtctctactaaaaatacaaaaattagccaggtgtggtggcacatgcctgtagtcccagctacacaggaggctgaggtgggagaatcacttgaacctaggaggcagaggttgcagtgagccaagaccacgccattgcacgccagcctaacagagtgagactctgtctt

SEQ ID NO: 3878 - DNA, 4500 bp, Homo sapiens
gggtgcgagctggagactccgcgggagcgcggccgggaggcttcgccccggagctggcccgacgcctcccgagctggcagggctctcggcggaggtcggagcgtgggcttcctcctcccgccagggaaaacagagaggatgaaggcctatctaaagagcgcagaaggcttttttgtcctaaataaaagtaccacaattggaaggcatgaaaattcagaccttgttttacagtctcctgacatcgacaaccaccatgcactcattgaatataacgaggcggagtgcagctttgttctccaggacttcaattcccgcaacggcacgtttgtcaacgagtgccacattcaaaacgtggctgtgaagctcatccctggagacatcctgagatttgggtctgcagggctgacctatgaactggtcattgaaaatccacctccggtctctttcccatggatgaggggcccagcaccatggccagggccacagccacctcgtgccacacagcagccaaaccaggcccccccaccatcacatatccccttccaccaaggtgtccagccagcaccgatgcaaaggagctggtcccaggcctttcccagacccaccgtggtcctgccggcctcccacaggcggcctgtgagcgccaacaaggagatgttctcgttcgtggtggacgacgcccgcaagccacccgtcatcaagcaagtgtggaccaatgccatgaaactgtcagaaaaatcagtggccgaggggattcctggggcagttccccctgcggagatttatgtggaggaggacttggcccagcaggacaaggatgaaataattctgctgctgggaaaagaggtcagccgtctctcagattatgaaattgaatccaaatacaaagacgtcataatagcaaacctgcagaatgaagtggctgagctgagtcagaaggtgtcagagaccaccacctccaggcagaatgagaaggagatctcgcagaagtgtcaggttctggatgaagacatcgatgccaaacagaaagagatccagagcttgaaaagccagatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagatgctcggtgctaaaggaagagttaaaacaggaagatgctcacagggagctcagggaagcccaggagaaagagttaaaactctgcaaaacccaaatccaagacatggagaaagaaatgaagaagcttagggcagagctgaggaagagttgtactgaacaaagcgtgatctctaggactctgagagaaaaaagcaaggttgaagagaagcttcaggaggattccagaaggaaattgcttcagctgcaagaaatggggaacagagagagcgtcattaaaatcaatttggagagggcagtaggtcagctggagcacttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagatcaagttcaacagttctcaggaaactcagcagtctttactgcaggaaaagctgcgggagcatctggcagagaaggagaagctgaacgaggagaggctagagcaagaggagaagctcaaagccaaaatcaggcaactgacggaagagaaggcggtaaggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggaggttttggagagcagcatagcccatgaaaaaagaaaagcaaaggaagccttggagtcggaaaagagaaaagttcaggatctggagaaccatttaacccaacagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgaagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaagatgaggaaactgcgcctcagagagttaagaggcgcccaagtgcacacagcggctggtaaggacagctgggacctgaccccagatccctctgaccctggttctcctgctgtctgcagggttggccgaaagtgtagaggagcacgaactgagaaacgcaaaagaatcgacaccttgcaactgtgccttcaaagagaaagacaggcaggccctgccccacctgcctgcagtttgaacggatga

SEQ ID NO: 3879 - DNA, 993 bp, Homo sapiens
atgattctgaggcctccccggccatgtggaactatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagatgctcggtgctaaaggaagagttaaaacaggaagatgctcacagggagctcagggaagcccaggagaaagagttaaaactctgcaaaacccaaatccaagacatggagaaagaaatgaagaagcttagggcagagctgaggaagagttgtactgaacaaagcgtgatctctaggactctgagagaaaaaagcaagctggagcacttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaaggttactgggactttttttctcacatggttgcatgactctaaaatgtcgcgttgaatctcagcatgatgggacatctg

SEQ ID NO: 3880 - DNA, 4982 bp, Homo sapiens
gggtgcgagctggagactccgcgggagcgcggccgggaggcttcgccccggagctggcccgacgcctcccgagctggcagggctctcggcggaggtcggagcgtgggcttcctcctcccgccagggaaaacagagaggatgaaggcctatctaaagagcgcagaaggcttttttgtcctaaataaaagtaccacaattggaaggcatgaaaattcagaccttgttttacagtctcctgacatcgacaaccaccatgcactcattgaatataacgaggcggagtgcagctttgttctccaggacttcaattcccgcaacggcacgtttgtcaacgagtgccacattcaaaacgtggctgtgaagctcatccctggagacatcctgagatttgggtctgcagggctgacctatgaactggtcattgaaaatccacctccggtctctttcccatggatgaggggcccagcaccatggccagggccacagccacctcgtgccacacagcagccaaaccaggcccccccaccatcacatatccccttccaccaaggtgtccagccagcaccgatgcaaaggagctggtcccaggcctttcccagacccaccgtggtcctgccggcctcccacaggcggcctgtgagcgccaacaaggagatgttctcgttcgtggtggacgacgcccgcaagccacccgtcatcaagcaagtgtggaccaatgccatgaaactgtcagaaaaatcagtggccgaggggattcctggggcagttccccctgcggagatttatgtggaggaggacttggcccagcaggacaaggatgaaataattctgctgctgggaaaagaggtcagccgtctctcagattatgaaattgaatccaaatacaaagacgtcataatagcaaacctgcagaatgaagtggctgagctgagtcagaaggtgtcagagaccaccacctccaggcagaatgagaaggagatctcgcagaagtgtcaggttctggatgaagacatcgatgccaaacagaaagagatccagagcttgaaaagccagatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagatgctcggtgctaaaggaagagttaaaacaggaagatgctcacagggagctcagggaagcccaggagaaagagttaaaactctgcaaaacccaaatccaagacatggagaaagaaatgaagaagcttagggcagagctgaggaagagttgtactgaacaaagcgtgatctctaggactctgagagaaaaaagcaaggttgaagagaagcttcaggaggattccagaaggaaattgcttcagctgcaagaaatggggaacagagagagcgtcattaaaatcaatttggagagggcagtaggtcagctggagcacttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagatcaagttcaacagttctcaggaaactcagcagtctttactgcaggaaaagctgcgggagcatctggcagagaaggagaagctgaacgaggagaggctagagcaagaggagaagctcaaagccaaaatcaggcaactgacggaagagaaggcggtaaggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgaagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgagaggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaaggttggaaccagaaaagcctccctaaagatggaccaagaaagagagatgctgaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaagtctttaaagattgttaccctagtgtttcatttcctagaccagtattttgaacaatattatattttggagactgtggggagaagggttcttctttaaaaatacctatgaatgtacacgaactcaggtatatgaagaatagaagtgtgtaacccagatgtccaggcctggtagatataattatgtggtccacgttgggtcatgatgttcccaaatatcaaacctcctaagacttccaacagactcacacttgagaaaacctaagacttgtactggagcctcagggcagaattgtaaccttggagctctcagggccttgggatagtgaattcaagtctccgttatggcctggcaggatggctcatgcctgtaatctcagcactttgggaggccgaggcaggcggattataagatcaggagtttgagaccagcctggcaaacatagtgaatacctgtctctactaaaaatacaaaaattagccaggtgtggtggcacatgcctgtagtcccagctacacaggaggctgaggtgggagaatcacttgaacctaggaggcagaggttgcagtgagccaagaccacgccattgcacgccagcctaacagagtgagactctgtctt

SEQ ID NO: 3881 - DNA, 5341 bp, Homo sapiens
tcactcactggggagcccggcggtggcggcacctttcgaggtagacccgctgagctgctagcccgccggccagcgagtgagaggtcggacagactgtggagccgacagactgaaggacagcggcaccgccagacggccagaaagttccgccatgagctggggcacggagctgtgggatcagttcgacagcttagacaagcatacacaatggggaattgacttcttggaaagatatgccaaatttgttaaagagaggatagaaattgaacagaactatgcgaaacaattgagaaatctggttaagaagtactgccccaaacgttcatccaaagatgaagagccacggtttacctcgtgtgtagccttttttaatatccttaatgagttaaatgactatgcaggacagcgagaagttgtagcagaagaaatggcgcacagagtgtatggtgaattaatgagatatgctcatgatctgaaaactgaaagaaaaatgcatctgcaagaaggacgaaaagctcaacaatatcttgacatgtgctggaaacagatggataatagtaaaaagaagtttgaaagagaatgtagagaggcagaaaaggcacaacagagttatgaaagattggataatgatactaatgcaaccaaggcagatgttgaaaaggccaaacagcagttgaatctgcgtacgcatatggccgatgaaaataaaaatgaatatgctgcacaattacaaaactttaatggagaacaacataaacatttttatgtagtgattcctcagatttacaagcaactacaagaaatggacgaacgaaggactattaaactcagtgagtgttacagaggatttgctgactcagaacgcaaagttattcccatcatttcaaaatgtttggaaggaatgattcttgcagcaaaatcagttgatgaaagaagagactctcaaatggtggtagactccttcaaatctggttttgaacctccaggagactttccatttgaagattacagtcaacatatatatagaaccatttctgatgggactatcagtgcatccaaacaggagagtgggaagatggatgccaaaaccacagtaggaaaggccaagggcaaattgtggctctttggaaagaagccaaagggcccagcactagaagatttcagtcatctgccaccagaacagagacgtaaaaaactacagcagcgcattgatgaacttaacagagaactacagaaagaatcagaccaaaaagatgcactcaacaaaatgaaagatgtatatgagaagaatccacaaatgggggatccagggagtttgcagcctaaattagcagagaccatgaataacattgaccgcctacgaatggaaatccataagaatgaggcttggctctctgaagtcgaaggcaaaacaggtgggagaggagacagaagacatagcagtgacataaatcatcttgtaacacagggacgagaaagtcctgagggaagttacactgatgatgcaaaccaggaagtccgtgggccaccccagcagcatggtcaccacaatgagtttgatgatgaatttgaggatgatgatcccttgcctgctattggacactgcaaagctatctacccttttgatggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggtgcagtaacttatatctaaactaaccaggcacctttgtgccatgtgtgacataggaagagtaacataaaatgaaaacacattcaacaggttgaaaaaaataaggaaacttaaagggcatccaagattaattgttcactatgtgagctgagtgtaggcttgatcttgtgaatattaccacaagaaacattttgtggcactttactgtttgagtaacgttggtgtgaagcttaattgatgccttttgctttatgtcccgcttaagtctgtgtgaaggatttgtgtttttctgccttacaaatagaatttgatttattgggcaggaattcatggatagtaatgctctctgccccctttacttcagaaaacacagtgactttagtgaatttgaatagtgaaactgctctgaaatgctatggaaagccgactccccaaagagtggtttcttctagaagtttgaatttgtagctacagtttccaagaagaaaaatagtagttggataatttagtaaaataataacatcattttcattttcttacctattcttaactttggtttcctaaaggaagaaaatgagcaggtagcacataatctatttaagtagatttaaagagagtttcaaaataaatctcctggtctagctcttaggtgaataaaatagattttgtttgagacctcaaaatattttgaggttagctggtaattttcaataatttacaagcttccttccaaactaatctcatacttttgtatgtttcatcttgaaaatatcttttgggaaataccactttagtgattatttagcatttagcagttacacataggaaaatacacagttacatagaaaaatacacatttgaagatagaggaaaccttgaatggaggggaagtgttgacaaattttaatttttaaaggagaaactttttgactatctgggttagaggaagatatgtgtaccgcctttagggcattttgttatttccgctgaatcattagttattaggatagataaatttttccaattagtttcagcaagcgttgttggaaacactgtgcagtcaaggattgtgcagtgctggttgtgtgaccacaccctgagtcagtggtgtggggaagtaaagtgtgaagaagcagtaagattggtttttaattttgcccatgttttaaattttcctggtgttttcggtagctgactataaaatgatagagacatttgggacaggcactttaaactgaacaccccttttggttttaccaaaggtcttcagtaattgttcttttctttttcctcctggactgcaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccaagtccattttaatttcctcagtggttttatgagaagttttatgggcctcccccaattgtctttttattttgggttatgacgatcatgtttgataattacaatgatagtctctttccacgtgatgcttttgtttgaacctgataaaatttagtgaaactttgtaatgatctatgtgcacttttacttgtaaaatggaatttctgtatgtttatacttgtaaatatgattgttgttagtgctcctgttgctcatggtgtcctgcctcgcatttgtgattctgttaatgacatgtatcttaactaatttcttagtggtgttgtaatagggagatggggcaggtggggggttatttgtaccactgaatcttcattaatttggttctttactgttttgaggggagaaagaacgtgaaatggtttgtgtattattgaattttaagcaatattttagaagctgtgtgactgctttaataactttttcccagtgttatttgaatcatactacccgttatactaaagctgaatgacaattgtgtgaaagttactgccttcataagatcaagtcaccactgttacacagctgacatatagtgtattacctttgcagctagtaaactataaagtttagatattgaatctcgttacagggttatttatataatgtgacattattcagtactgacagactacatgaagtagttttaaaatctagtgctatttttattttaaaggttagcaatgaggaggaaatgtgatctggctgtgtttgtcttctgtacaaagcctgaagtgcttatggttttttggctaacagccacagagggcaaagtttaagactttcttgtaaggactaactgttcttttcaagctactgtttgtttttctaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacatggaataaaacaatcttttcatggcctgtt

SEQ ID NO: 3882 - DNA, 4212 bp, Homo sapiens
tcactcactggggagcccggcggtggcggcacctttcgaggtagacccgctgagctgctagcccgccggccagcgagtgagaggtcggacagactgtggagccgacagactgaaggacagcggcaccgccagacggccagaaagttccgccatgagctggggcacggagctgtgggatcagttcgacagcttagacaagcatacacaatggggaattgacttcttggaaagatatgccaaatttgttaaagagaggatagaaattgaacagaactatgcgaaacaattgagaaatctggttaagaagtactgccccaaacgttcatccaaagatgaagagccacggtttacctcgtgtgtagccttttttaatatccttaatgagttaaatgactatgcaggacagcgagaagttgtagcagaagaaatggcgcacagagtgtatggtgaattaatgagatatgctcatgatctgaaaactgaaagaaaaatgcatctgcaagaaggacgaaaagctcaacaatatcttgacatgtgctggaaacagatggataatagtaaaaagaagtttgaaagagaatgtagagaggcagaaaaggcacaacagagttatgaaagattggataatgatactaatgcaaccaaggcagatgttgaaaaggccaaacagcagttgaatctgcgtacgcatatggccgatgaaaataaaaatgaatatgctgcacaattacaaaactttaatggagaacaacataaacatttttatgtagtgattcctcagatttacaagcaactacaagaaatggacgaacgaaggactattaaactcagtgagtgttacagaggatttgctgactcagaacgcaaagttattcccatcatttcaaaatgtttggaaggaatgattcttgcagcaaaatcagttgatgaaagaagagactctcaaatggtggtagactccttcaaatctggttttgaacctccaggagactttccatttgaagattacagtcaacatatatatagaaccatttctgatgggactatcagtgcatccaaacaggagagtgggaagatggatgccaaaaccacagtaggaaaggccaagggcaaattgtggctctttggaaagaagccaaagccacagtccccacccttaacccctactagtttattcacatccagtactcctaatgggtcccagtttctcacattctccattgagcccgtgcattattgtatgaatgaaataaaaacagggaagcccagaattccttctttcagaagcctcaaaagagggtggtcggtgaagatgggcccagcactagaagatttcagtcatctgccaccagaacagagacgtaaaaaactacagcagcgcattgatgaacttaacagagaactacagaaagaatcagaccaaaaagatgcactcaacaaaatgaaagatgtatatgagaagaatccacaaatgggggatccagggagtttgcagcctaaattagcagagaccatgaataacattgaccgcctacgaatggaaatccataagaatgaggcttggctctctgaagtcgaaggcaaaacaggtgggagaggagacagaagacatagcagtgacataaatcatcttgtaacacagggacgagaaagtcctgagggaagttacactgatgatgcaaaccaggaagtccgtgggccaccccagcagcatggtcaccacaatgagtttgatgatgaatttgaggatgatgatcccttgcctgctattggacactgcaaagctatctacccttttgatggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccaagtccattttaatttcctcagtggttttatgagaagttttatgggcctcccccaattgtctttttattttgggttatgacgatcatgtttgataattacaatgatagtctctttccacgtgatgcttttgtttgaacctgataaaatttagtgaaactttgtaatgatctatgtgcacttttacttgtaaaatggaatttctgtatgtttatacttgtaaatatgattgttgttagtgctcctgttgctcatggtgtcctgcctcgcatttgtgattctgttaatgacatgtatcttaactaatttcttagtggtgttgtaatagggagatggggcaggtggggggttatttgtaccactgaatcttcattaatttggttctttactgttttgaggggagaaagaacgtgaaatggtttgtgtattattgaattttaagcaatattttagaagctgtgtgactgctttaataactttttcccagtgttatttgaatcatactacccgttatactaaagctgaatgacaattgtgtgaaagttactgccttcataagatcaagtcaccactgttacacagctgacatatagtgtattacctttgcagctagtaaactataaagtttagatattgaatctcgttacagggttatttatataatgtgacattattcagtactgacagactacatgaagtagttttaaaatctagtgctatttttattttaaaggttagcaatgaggaggaaatgtgatctggctgtgtttgtcttctgtacaaagcctgaagtgcttatggttttttggctaacagccacagagggcaaagtttaagactttcttgtaaggactaactgttcttttcaagctactgtttgtttttctaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacatggaataaaacaatcttttcatggcctgtt

SEQ ID NO: 3883 - DNA, 5465 bp, Homo sapiens
gaggtagacccgctgagctgctagcccgccggccagcgagtgagaggtcggacagactgtggagccgacagactgaaggacagcggcaccgccagacggccagaaagttccgccatgagctggggcacggagctgtgggatcagttcgacagcttagacaagcatacacaatggggaattgacttcttggaaagatatgccaaatttgttaaagagaggatagaaattgaacagaactatgcgaaacaattgagaaatctggttaagaagtactgccccaaacgttcatccaaagatgaagagccacggtttacctcgtgtgtagccttttttaatatccttaatgagttaaatgactatgcaggacagcgagaagttgtagcagaagaaatggcgcacagagtgtatggtgaattaatgagatatgctcatgatctgaaaactgaaagaaaaatgcatctgcaagaaggacgaaaagctcaacaatatcttgacatgtgctggaaacagatggataatagtaaaaagaagtttgaaagagaatgtagagaggcagaaaaggcacaacagagttatgaaagattggataatgatactaatgcaaccaaggcagatgttgaaaaggccaaacagcagttgaatctgcgtacgcatatggccgatgaaaataaaaatgaatatgctgcacaattacaaaactttaatggagaacaacataaacatttttatgtagtgattcctcagatttacaagcaactacaagaaatggacgaacgaaggactattaaactcagtgagtgttacagaggatttgctgactcagaacgcaaagttattcccatcatttcaaaatgtttggaaggaatgattcttgcagcaaaatcagttgatgaaagaagagactctcaaatggtggtagactccttcaaatctggttttgaacctccaggagactttccatttgaagattacagtcaacatatatatagaaccatttctgatgggactatcagtgcatccaaacaggagagtgggaagatggatgccaaaaccacagtaggaaaggccaagggcaaattgtggctctttggaaagaagccaaagccacagtccccacccttaacccctactagtttattcacatccagtactcctaatgggtcccagtttctcacattctccattgagcccgtgcattattgtatgaatgaaataaaaacagggaagcccagaattccttctttcagaagcctcaaaagagggggcccagcactagaagatttcagtcatctgccaccagaacagagacgtaaaaaactacagcagcgcattgatgaacttaacagagaactacagaaagaatcagaccaaaaagatgcactcaacaaaatgaaagatgtatatgagaagaatccacaaatgggggatccagggagtttgcagcctaaattagcagagaccatgaataacattgaccgcctacgaatggaaatccataagaatgaggcttggctctctgaagtcgaaggcaaaacaggtgggagaggagacagaagacatagcagtgacataaatcatcttgtaacacagggacgagaaagtcctgagggaagttacactgatgatgcaaaccaggaagtccgtgggccaccccagcagcatggtcaccacaatgagtttgatgatgaatttgaggatgatgatcccttgcctgctattggacactgcaaagctatctacccttttgatggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggtgcagtaacttatatctaaactaaccaggcacctttgtgccatgtgtgacataggaagagtaacataaaatgaaaacacattcaacaggttgaaaaaaataaggaaacttaaagggcatccaagattaattgttcactatgtgagctgagtgtaggcttgatcttgtgaatattaccacaagaaacattttgtggcactttactgtttgagtaacgttggtgtgaagcttaattgatgccttttgctttatgtcccgcttaagtctgtgtgaaggatttgtgtttttctgccttacaaatagaatttgatttattgggcaggaattcatggatagtaatgctctctgccccctttacttcagaaaacacagtgactttagtgaatttgaatagtgaaactgctctgaaatgctatggaaagccgactccccaaagagtggtttcttctagaagtttgaatttgtagctacagtttccaagaagaaaaatagtagttggataatttagtaaaataataacatcattttcattttcttacctattcttaactttggtttcctaaaggaagaaaatgagcaggtagcacataatctatttaagtagatttaaagagagtttcaaaataaatctcctggtctagctcttaggtgaataaaatagattttgtttgagacctcaaaatattttgaggttagctggtaattttcaataatttacaagcttccttccaaactaatctcatacttttgtatgtttcatcttgaaaatatcttttgggaaataccactttagtgattatttagcatttagcagttacacataggaaaatacacagttacatagaaaaatacacatttgaagatagaggaaaccttgaatggaggggaagtgttgacaaattttaatttttaaaggagaaactttttgactatctgggttagaggaagatatgtgtaccgcctttagggcattttgttatttccgctgaatcattagttattaggatagataaatttttccaattagtttcagcaagcgttgttggaaacactgtgcagtcaaggattgtgcagtgctggttgtgtgaccacaccctgagtcagtggtgtggggaagtaaagtgtgaagaagcagtaagattggtttttaattttgcccatgttttaaattttcctggtgttttcggtagctgactataaaatgatagagacatttgggacaggcactttaaactgaacaccccttttggttttaccaaaggtcttcagtaattgttcttttctttttcctcctggactgcaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccaagtccattttaatttcctcagtggttttatgagaagttttatgggcctcccccaattgtctttttattttgggttatgacgatcatgtttgataattacaatgatagtctctttccacgtgatgcttttgtttgaacctgataaaatttagtgaaactttgtaatgatctatgtgcacttttacttgtaaaatggaatttctgtatgtttatacttgtaaatatgattgttgttagtgctcctgttgctcatggtgtcctgcctcgcatttgtgattctgttaatgacatgtatcttaactaatttcttagtggtgttgtaatagggagatggggcaggtggggggttatttgtaccactgaatcttcattaatttggttctttactgttttgaggggagaaagaacgtgaaatggtttgtgtattattgaattttaagcaatattttagaagctgtgtgactgctttaataactttttcccagtgttatttgaatcatactacccgttatactaaagctgaatgacaattgtgtgaaagttactgccttcataagatcaagtcaccactgttacacagctgacatatagtgtattacctttgcagctagtaaactataaagtttagatattgaatctcgttacagggttatttatataatgtgacattattcagtactgacagactacatgaagtagttttaaaatctagtgctatttttattttaaaggttagcaatgaggaggaaatgtgatctggctgtgtttgtcttctgtacaaagcctgaagtgcttatggttttttggctaacagccacagagggcaaagtttaagactttcttgtaaggactaactgttcttttcaagctactgtttgtttttctaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacatggaataaaacaatcttttcatggcctgttaa

SEQ ID NO: 3884 - DNA, 4229 bp, Homo sapiens
gcggcggaggcttctccagtcgcgtctttctcactcactggggagcccggcggtggcggcacctttcgaggtagacccgctgagctgctagcccgccggccagcgagtgagaggtcggacagactgtggagccgacagactgaaggacagcggcaccgccagacggccagaaagttccgccatgagctggggcacggagctgtgggatcagttcgacagcttagacaagcatacacaatggggaattgacttcttggaaagatatgccaaatttgttaaagagaggatagaaattgaacagaactatgcgaaacaattgagaaatctggttaagaagtactgccccaaacgttcatccaaagatgaagagccacggtttacctcgtgtgtagccttttttaatatccttaatgagttaaatgactatgcaggacagcgagaagttgtagcagaagaaatggcgcacagagtgtatggtgaattaatgagatatgctcatgatctgaaaactgaaagaaaaatgcatctgcaagaaggacgaaaagctcaacaatatcttgacatgtgctggaaacagatggataatagtaaaaagaagtttgaaagagaatgtagagaggcagaaaaggcacaacagagttatgaaagattggataatgatactaatgcaaccaaggcagatgttgaaaaggccaaacagcagttgaatctgcgtacgcatatggccgatgaaaataaaaatgaatatgctgcacaattacaaaactttaatggagaacaacataaacatttttatgtagtgattcctcagatttacaagcaactacaagaaatggacgaacgaaggactattaaactcagtgagtgttacagaggatttgctgactcagaacgcaaagttattcccatcatttcaaaatgtttggaaggaatgattcttgcagcaaaatcagttgatgaaagaagagactctcaaatggtggtagactccttcaaatctggttttgaacctccaggagactttccatttgaagattacagtcaacatatatatagaaccatttctgatgggactatcagtgcatccaaacaggagagtgggaagatggatgccaaaaccacagtaggaaaggccaagggcaaattgtggctctttggaaagaagccaaagccacagtccccacccttaacccctactagtttattcacatccagtactcctaatgggtcccagtttctcacattctccattgagcccgtgcattattgtatgaatgaaataaaaacagggaagcccagaattccttctttcagaagcctcaaaagagggggcccagcactagaagatttcagtcatctgccaccagaacagagacgtaaaaaactacagcagcgcattgatgaacttaacagagaactacagaaagaatcagaccaaaaagatgcactcaacaaaatgaaagatgtatatgagaagaatccacaaatgggggatccagggagtttgcagcctaaattagcagagaccatgaataacattgaccgcctacgaatggaaatccataagaatgaggcttggctctctgaagtcgaaggcaaaacaggtgggagaggagacagaagacatagcagtgacataaatcatcttgtaacacagggacgagaaagtcctgagggaagttacactgatgatgcaaaccaggaagtccgtgggccaccccagcagcatggtcaccacaatgagtttgatgatgaatttgaggatgatgatcccttgcctgctattggacactgcaaagctatctacccttttgatggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccaagtccattttaatttcctcagtggttttatgagaagttttatgggcctcccccaattgtctttttattttgggttatgacgatcatgtttgataattacaatgatagtctctttccacgtgatgcttttgtttgaacctgataaaatttagtgaaactttgtaatgatctatgtgcacttttacttgtaaaatggaatttctgtatgtttatacttgtaaatatgattgttgttagtgctcctgttgctcatggtgtcctgcctcgcatttgtgattctgttaatgacatgtatcttaactaatttcttagtggtgttgtaatagggagatggggcaggtggggggttatttgtaccactgaatcttcattaatttggttctttactgttttgaggggagaaagaacgtgaaatggtttgtgtattattgaattttaagcaatattttagaagctgtgtgactgctttaataactttttcccagtgttatttgaatcatactacccgttatactaaagctgaatgacaattgtgtgaaagttactgccttcataagatcaagtcaccactgttacacagctgacatatagtgtattacctttgcagctagtaaactataaagtttagatattgaatctcgttacagggttatttatataatgtgacattattcagtactgacagactacatgaagtagttttaaaatctagtgctatttttattttaaaggttagcaatgaggaggaaatgtgatctggctgtgtttgtcttctgtacaaagcctgaagtgcttatggttttttggctaacagccacagagggcaaagtttaagactttcttgtaaggactaactgttcttttcaagctactgtttgtttttctaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacatggaataaaacaatcttttcatggcctgttaa

SEQ ID NO: 3885 - DNA, 1358 bp, Homo sapiens
gataatagtaaaaagaagtttgaaagagaatgtagagaggcagaaaaggcacaacagagttatgaaagattggataatgatactaatgcaaccaaggcagatgttgaaaaggccaaacagcagttgaatctgcgtacgcatatggccgatgaaaataaaaatgaatatgctgcacaattacaaaactttaatggagaacaacataaacatttttatgtagtgattcctcagatttacaagcaactacaagaaatggacgaacgaaggactattaaactcagtgagtgttacagaggatttgctgactcagaacgcaaagttattcccatcatttcaaaatgtttggaaggaatgattcttgcagcaaaatcagttgatgaaagaagagactctcaaatggtggtagactccttcaaatctggttttgaacctccaggagactttccatttgaagattacagtcaacatatatatagaaccatttctgatgggactatcagtgcatccaaacaggagagtgggaagatggatgccaaaaccacagtaggaaaggccaagggcaaattgtggctctttggaaagaagccaaagggcccagcactagaagatttcagtcatctgccaccagaacagagacgtaaaaaactacagcagcgcattgatgaacttaacagagaactacagaaagaatcagaccaaaaagatgcactcaacaaaatgaaagatgtatatgagaagaatccacaaatgggggatccagggagtttgcagcctaaattagcagagaccatgaataacattgaccgcctacgaatggaaatccataagaatgaggcttggctctctgaagtcgaaggcaaaacaggtgggagaggagacagaagacatagcagtgacataaatcatcttgtaacacagggacgagaaagtcctgagggaagttacactgatgatgcaaaccaggaagtccgtgggccaccccagcagcatggtcaccacaatgagtttgatgatgaatttgaggatgatgatcccttgcctgctattggacactgcaaagctatctacccttttgatggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggtgcagtaacttatatctaaactaaccaggcacctttgtgccatgtgtgacataggaagagtaacataaaatgaaaacacattcaacaggttgaaaaaaataaggaaacttaaagggcatc

SEQ ID NO: 3886 - DNA, 1332 bp, Homo sapiens
ctttccatttgaagattacagtcaacatatatatagaaccatttctgatgggactatcagtgcatccaaacaggagagtgggaagatggatgccaaaaccacagtaggaaaggccaagggcaaattgtggctctttggaaagaagccaaagccacagtccccacccttaacccctactagtttattcacatccagtactcctaatgggtcccagtttctcacattctccattgagcccgtgcattattgtatgaatgaaataaaaacagggaagcccagaattccttctttcagaagcctcaaaagagggtggtcggtgaagatgggcccagcactagaagatttcagtcatctgccaccagaacagagacgtaaaaaactacagcagcgcattgatgaacttaacagagaactacagaaagaatcagaccaaaaagatgcactcaacaaaatgaaagatgtatatgagaagaatccacaaatgggggatccagggagtttgcagcctaaattagcagagaccatgaataacattgaccgcctacgaatggaaatccataagaatgaggcttggctctctgaagtcgaaggcaaaacaggtgggagaggagacagaagacatagcagtgacataaatcatcttgtaacacagggacgagaaagtcctgagggaagttacactgatgatgcaaaccaggaagtccgtgggccaccccagcagcatggtcaccacaatgagtttgatgatgaatttgaggatgatgatcccttgcctgctattggacactgcaaagctatctaccctttgatggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagc

SEQ ID NO: 3887 - DNA, 3969 bp, Homo sapiens
gcttgggctcgcgatggggaagaagtcccgggcggtacccggccgtaggcccatcctgcaactctctccgccgggtcctcggggcagcacgccgggccgggacccggagccggaacccgacactgagccggactcaaccgcggcggtccccagccagcccgccccgtcggcggcgacgaccaccaccaccgcggtgactgccgccgcggcctcggacgactcgccttcagaagatgaacaggaagcggtgcaggaggttcctagagttgttcagaatcctccaaaaccagtcatgaccactagacccacagctgttaaagcaacaggcggtctatgcttgcttggtgcttatgctgacagtgatgacgatgacaatgatgtttccgaaaaactagcacaatccaaagagacaaatggaaaccagtcaactgatattgatagtacattggccaacttcctagcggagatcgatgccataacagctcctcagcctgcagctcctgtaggagcttctgctccacctccaactccacctcgaccagagccaaaggaagcagcaacatctaccctttcttcttctacttcaaatggaacagactccacccaaacatctggttggcaatatgatactcagtgttcactggcaggagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataatcc

SEQ ID NO: 3888 - DNA, 5575 bp, Homo sapiens
gcggccgcgggcccggcagaaggccgagtaggagggaccacgcgccgggggccgcgatctctggcagggggcggtgtgccagcggagcaccatgcacataggcgcccagcgccccaactacccctcccgaggaaaagaggccggggccgcgctggggcggcggagagcatgagggaggccggggggcggctcggcttggagcgctgctagggagcggtgcgcgccgcacacccgcctgggcgcggcggagggcggggagccgggcaggtcgcgcctgcgggcggcagccgaccgccgggagctgttctgatttccgacgcgcacgctaggggcccggagcagcccccggccccggcgcgccgccgacatgggcaacgcagggagcatggattcgcagcagaccgatttcagggcgcacaacgtgcctttgaagctgccgatgccagagccaggtgaactggaggagcgatttgccatcgtgctgaatgctatgaacctacctcctgacaaagccaggttactgcggcagtatgataatgagaaaaaatgggaactgatttgtgatcaggaacgattccaggtgaagaatcctccccatacatacattcaaaagctcaaaggctatctggatccagctgtaaccaggaagaaattcagacggcgtgttcaagaatctacacaagtgctaagagaactggaaatttctttgagaactaaccacattggatgggtcagagaatttctgaatgaagaaaacaaaggtcttgatgttctagtggaatatctctcatttgcacagtacgcggtaacttttgactttgaaagtgtggagagtactgtggagagctcggtggacaaatcaaagccctggagtaggtccatcgaggacctgcacagagggagcaacctgccctcacctgtgggcaacagtgtctcccgctctggaagacattctgcactgcgatataatacattgccaagcagaagaactctgaaaaattcaagattagtgagtaagaaagatgatgtgcatgtctgtatcatgtgtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggacgaatacttggacaagctgaaacacactgagagtgacaagcttcaagtccagatccaggcttacctggacaatgtttttgatgtaggagctctactggaagatgctgaaactaagaatgctgccttggagagggtggaagaactggaagaaaacatttctcatttatctgaaaaactgcaagacacagagaatgaagccatgtccaagattgtggaactggaaaagcaactcatgcagaggaacaaggagctggatgtcgttcgggaaatctacaaagatgcaaatactcaagttcacacattaagaaaaatggtcaaagaaaaagaagaagcaattcaaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgccgccgccgccccctcctccacctcctcctcccccaccgccccctccgcctcctcctctcccaggccctgcagctgagactgtaccagctcctcccttagcacctccccttccctctgcacctccgctgcctggaacatcttcacccacagtggttttcaactcaggattagcagctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgcgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactactattctgtaa

SEQ ID NO: 3889 - DNA, 3857 bp, Homo sapiens
aaagacagtctaccctggaaaaaaagattcatgagctagagaaacaagggaccattaaaattcagaagaaaggggatggggatatcgccatactgccagttgtggcttctggcacattgtccatggggtcagaagtggtagcaggtaactctgtgggacccacaatgggggccgcttcctcaggacccttgccccctcctccaccaccactgcctccctcatcagacacacctgaaacagtgcaaaatggtccagtaacaccacctatgccaccgcctcctcctctcccaggccctgcagctgagactgtaccagctcctcccttagcacctccccttccctctgcacctccgctgcctggaacatcttcacccacagtggttttcaactcaggattagcagctgtgaaaattaagaagccaatcaagacgaagttcagaatgccagtgtttaactgggttgctctgaagcccaatcagatcaatggcacagtcttcaatgaaattgatgatgagcgaattctggaggatttaaatgtggatgaatttgaggaaatattcaagacaaaagcccaaggacctgccattgatctttcttcaagcaaacagaagataccacagaagggatcaaacaaagtgacattactagaagcaaacagggccaaaaatcttgccataactttaaggaaagctggaaagactgctgatgaaatatgtaaagctattcatgtatttgacttgaagacactgcctgtggactttgtggaatgcttgatgcggttcctaccaactgagaatgaagtgaaagtgcttcggctctacgagcgggaaaggaagcctctggaaaacttgtcagatgaagatcggttcatgatgcagtttagtaaaatcgagaggctcatgcagaagatgaccatcatggccttcattgggaactttgctgaaagcattcagatgctgactcctcaactacatgcgattatagcagcatctgtctctataaagtcgtcccaaaaactcaagaaaattctggagatcatcttagcccttggaaactacatgaatagcagtaaaagaggagcagtttatggatttaaacttcagagtttagatctgctcttagatacaaagtcaacagacagaaagcaaacactgttgcactatatatccaatgtggtgaaagaaaaatatcaccaagtgtccctgttttataatgagcttcattatgtggaaaaagctgctgcagtctcccttgagaatgttttgctggatgtcaaggagctccagaggggaatggacttgaccaagagagagtacaccatgcatgaccataacacgctgctgaaggagttcatcctcaacaatgaggggaagctgaagaagctgcaggatgatgccaagatcgcacaggatgcctttgatgatgttgtgaagtattttggagaaaaccccaagacaacaccaccctctgtcttctttcctgtctttgtccggtttgtgaaagcatataagcaagcagaagaggaaaatgagctgaggaaaaagcaggaacaagctctcatggaaaaactcctagagcaagaagctctgatggagcagcaggatccaaagtctccttctcataaatcaaagaggcagcagcaagagttaattgcagaattaagaagacgacaagttaaagataacagacatgtatatgagggaaaagatggtgccattgaagatattatcacagccttaaagaagaataatatcactaaatttccaaatgttcactcgagggtaaggatttcttctagcacaccggtggtggaggatacacagagctgatcttagaaaccaaccatacagacgagccgatgcggtgaggagaagcgtcaggcggcgctttgatgatcagaacttgcgttctgttaatggtgccgaaataacaatgtgaacctgagactggcctgcatgaatacagggtgtgcgtgaatgaaactgcccacatgaactttatgtgctacgatttaactgcagccttgaacacacacaaaaatattcttaagggctcagatttagcaaacacggaagaattttaaaatgagctctcctttcaacccttgttaacaagtgcctaaaaatggaagtacctgttcagattaatcaaagcaataggatttgatttgattaggtatctttttacaccagtatgttatttttaaccaaaatgtaaagttcttattaaactcattacctgccattgtgattgtcccatcatggcccacctggtttcctgatgttgtaaataacatcaatgcatctgctgtgggtcctttgctgagatgtcttcgaaggaattttgttttagccatatccatcaactttgtattttacttgcaatttggaagaaggaaagtcacatgatgaaactccttttgtctataaccaggccctggcaaagtgcaaacaggatgcaactgcagtggcacaaaggtcactcaatcctttgtttccagtttcacattctactacttctgcgctagagaacgatgctctgtgagaggcattcactagtatgaatgtggggatatagtgtataagacttatttgcagtactgtgttcttcagctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaagccactgttattttccttcctctctggcagggcacttgatccattccaaagtcaaaaactggactgaagctaaatttgtacttttcataatatacattctgcttctggcttatcttcttggtacatcaatatattaattgtaaagtttattgtatagtatttaaccgctgaagttcctattttatgttgtgcttatgtgaaccccttggtgaaggtcccttttccttggatgtgtagttatatgatctttttaaatgtacagatattttgctataaaatcggtgcagttttttatggtttttacacttctctttaattcccacctaagcctctgggtaatattgtaaatattgttttaaaatgcatcagcctatgctatacaatctgaatgttattttaacttatagttttttttaatatatatatttaactataaggacagtttagggaacaagttacctaccacatttcactttagtgtacctatttacagaaagattaaactgccacctgcgggcacattcccataaatgtgtactttactttaaaaagaacatgccacgattttgtctttctgtggactcaacattcacttcgattaaaaatagcaatttgaccaagttggacttccactacaaagcagctgttttccaaagttcaatgctgacatatatgtatattaaaataattgcctatttattaatctacaaatagacaacgttggcatgttcttttctgtttgtctattaatgggcctgcttcttagcaatattagaatgttttataaaagcaattcatgttacttttctggtcttttcatggcatatgagcaaataataaactatttacactac

SEQ ID NO: 3890 - DNA, 3321 bp, Homo sapiens
gagccggccgcctccgtccgccttgcttcggtgcggctgtccgctacgctgcctccgccctcgccgcgcgcccccgccagcgggactccagggaacccccggcgccctcgacggggccgaggagtcgggactcggggagccggcgctgagggaggagcctggtcggagccgcggagccgaaagctccggagcgtggaggtggggggccgaggcccctgagggggccccgccgcgatgggcaacctggagagcgccgagggggtcccgggagagcccccctctgtcccgttgttgctgccgcccggcaagatgccgatgcctgagccctgtgagctggaggaaaggttcgccctggtgctgagctccatgaacctgcctccagacaaggcccggctcctgcggcagtatgacaatgagaagaaatgggatctgatctgtgaccaggaacgattccaggtgaagaatcctccccacacttacattcagaaactccagagcttcttggaccccagtgtaactcggaagaagttcaggaggagggtgcaggagtcaaccaaagtactaagggagctggagatctctcttcgcaccaaccacattgggtgggtgcgggaatttctgaatgatgaaaacaaaggcctggatgtactggtggattacctgtcctttgcccagtgttctgtcatgtttgactttgagggtctggaaagtggtgacgatggtgcatttgacaaactccggtcctggagcaggtcaatcgaggacctgcagccacccagcgccctgtcggcccccttcaccaacagcctcgctcgctctgcgcgccagtctgtgctccggtatagcactctccctgggcgcagggccctgaagaactcccgcctagtgagccagaaggatgacgtccacgtctgtatcctttgtctcagagccatcatgaactatcagtacggattcaacctggtcatgtcccacccccatgctgtcaatgagattgcacttagcctcaataacaagaatccaaggaccaaagcccttgtcttagagcttctggcagctgtgtgtttggtgcgaggaggtcacgaaatcatccttgctgcctttgacaatttcaaagaggtatgcaaggagctgcaccgctttgagaagctgatggagtatttccggaatgaggacagcaatattgacttcatggtggcctgcatgcagttcatcaacatcgtggtgcactcggtggaggacatgaacttccgggtccacctgcagtatgagtttaccaagctggggctagaggagttcctgcagaagtcaaggcacacagagagcgagaagctgcaggtgcagattcaggcatatctggacaacgtgtttgatgtcgggggtttgttggaggatgctgagaccaagaatgtagccctggagaaggtggaggagttggaggagcatgtgtcccatctcacagagaagcttctggacctagagaatgaaaacatgatgcgggtggcagaactagagaagcagctgctacagcgggagaaggaactagagagcatcaaggagacatatgagaacacaagccaccaggtgcacaccctgcggaggctcattaaagagaaggaggaggcctttcagcgtcgatgtcatttggagccaaatgtccggggcctggagtctgtggacagtgaggccctggccagagtaggccctgcagagctgagtgagggcatgccaccctccgacctggaccttctggctccagccccaccccctgaggaggtcctgcctcttcctccaccaccagctccgcccttgccccctccacctcccccattaccagacaagtgtcccccagccccacctctccctggtgctgcaccctctgtggtgttgacagtgggcctgtcagccattcgaattaagaaacctatcaagaccaagttccggctgcctgtcttcaactggacagcactgaaacccaaccagatcagtggcactgtcttcagcgaacttgatgatgagaagatcttggaggacctggatcttgataagtttgaagaattattcaagacaaaagcgcagggccctgcccttgacctcatctgctccaaaaacaagacagcgcaaaaagctgccagcaaggtgactctgttggaagccaatcgtgccaagaacctggccatcaccctacgcaaggctggccgctcggctgaggagatctgcagggccattcatacgtttgacttgcagacactacctgtggacttcgtggagtgcctgatgcgcttcctgcccacagaggctgaggtaaagctgctgcggcaatatgagcgggagcggcagcccctggaggagttggcagctgaggaccgcttcatgctgctcttcagcaaggtggaacggttgacccagcgaatggctggcatggccttcctggggaacttccaggataacctgcagatgctcacaccgcaactcaatgccatcattgcggcgtccgcttccgtcaagtcttcacagaagctgaagcagatgttggagatcatacttgcactggggaactacatgaacagcagcaagcggggagctgtgtatggcttcaagctccagagcctggatctgctgctggataccaagtccactgaccggaagatgacactgcttcatttcatcgccttgacagtgaaggagaaatacccagacctggctaacttctggcatgagctgcactttgttgagaaggctgcagcagtgtccctggagaacgtgctgctggacgtgaaggagctgggccggggcatggagctgattcggcgtgagtgcagcatccatgacaacagcgtcctccggaacttcctcagtaccaatgaaggcaaactagacaagctccagcgggacgccaagacggctgaggaggcctacaatgcagttgtgcgctactttggcgagagtcccaagactacacctccttctgtattcttcccagtatttgtccgattcattcgttcttacaaggaagcagaacaagagaatgaagcccgcaagaagcaggaggaggtaatgcgggagaagcagctggctcaggaagccaagaaactggatgccaagaccccatcccagcggaacaagtggcaacagcaggagttaatagcagagttgaggcggcgccaggccaaggaacaccggcctgtttatgaggggaaggatggtaccatcgaggacatcatcacagtgctgaagagtgtccctttcacggcccgtactgccaagcggggctcacgcttcttctgtgatgcagcccaccatgatgagtcaaactgttag

SEQ ID NO: 3891 - DNA, 11192 bp, Homo sapiens
gagccggccgcctccgtccgccttgcttcggtgcggctgtccgctacgctgcctccgccctcgccgcgcgcccccgccagcgggactccagggaacccccggcgccctcgacggggccgaggagtcgggactcggggagccggcgctgagggaggagcctggtcggagccgcggagccgaaagctccggagcgtggaggtggggggccgaggcccctgagggggccccgccgcgatgggcaacctggagagcgccgagggggtcccgggagagcccccctctgtcccgttgttgctgccgcccggcaagatgccgatgcctgagccctgtgagctggaggaaaggttcgccctggtgctgagctccatgaacctgcctccagacaaggcccggctcctgcggcagtatgacaatgagaagaaatgggatctgatctgtgaccaggaacgattccaggtgaagaatcctccccacacttacattcagaaactccagagcttcttggaccccagtgtaactcggaagaagttcaggaggagggtgcaggagtcaaccaaagtactaagggagctggagatctctcttcgcaccaaccacattgggtgggtgcgggaatttctgaatgatgaaaacaaaggcctggatgtactggtggattacctgtcctttgcccagtgttctgtcatgtttgactttgagggtctggaaagtggtgacgatggtgcatttgacaaactccggtcctggagcaggtcaatcgaggacctgcagccacccagcgccctgtcggcccccttcaccaacagcctcgctcgctctgcgcgccagtctgtgctccggtatagcactctccctgggcgcagggccctgaagaactcccgcctagtgagccagaaggatgacgtccacgtctgtatcctttgtctcagagccatcatgaactatcagtacggattcaacctggtcatgtcccacccccatgctgtcaatgagattgcacttagcctcaataacaagaatccaaggaccaaagcccttgtcttagagcttctggcagctgtgtgtttggtgcgaggaggtcacgaaatcatccttgctgcctttgacaatttcaaagaggtatgcaaggagctgcaccgctttgagaagctgatggagtatttccggaatgaggacagcaatattgacttcatggtggcctgcatgcagttcatcaacatcgtggtgcactcggtggaggacatgaacttccgggtccacctgcagtatgagtttaccaagctggggctagaggagttcctgcagaagtcaaggcacacagagagcgagaagctgcaggtgcagattcaggcatatctggacaacgtgtttgatgtcgggggtttgttggaggatgctgagaccaagaatgtagccctggagaaggtggaggagttggaggagcatgtgtcccatctcacagagaagcttctggacctagagaatgaaaacatgatgcgggtggcagaactagagaagcagctgctacagcgggagaaggaactagagagcatcaaggagacatatgagaacacaagccaccaggtgcacaccctgcggaggctcattaaagagaaggaggaggcctttcagcgtcgatgtcatttggagccaaatgtccggggcctggagtctgtggacagtgaggccctggccagagtaggccctgcagagctgagtgagggcatgccaccctccgacctggaccttctggctccagccccaccccctgaggaggtcctgcctcttcctccaccaccagctccgcccttgccccctccacctcccccattaccagacaagtgtcccccagccccacctctccctggtgctgcaccctctgtggtgttgacagtgggcctgtcagccattcgaattaagaaacctatcaagaccaagttccggctgcctgtcttcaactggacagcactgaaacccaaccagatcagtggcactgtcttcagcgaacttgatgatgagaagatcttggaggacctggatcttgataagtttgaagaattattcaagacaaaagcgcagggccctgcccttgacctcatctgctccaaaaacaagacagcgcaaaaagctgccagcaaggtgactctgttggaagccaatcgtgccaagaacctggccatcaccctacgcaaggctggccgctcggctgaggagatctgcagggccattcatacgtttgacttgcagacactacctgtggacttcgtggagtgcctgatgcgcttcctgcccacagaggctgaggtaaagctgctgcggcaatatgagcgggagcggcagcccctggaggagttggcagctgaggaccgcttcatgctgctcttcagcaaggtggaacggttgacccagcgaatggctggcatggccttcctggggaacttccaggataacctgcagatgctcacaccgcaactcaatgccatcattgcggcgtccgcttccgtcaagtcttcacagaagctgaagcagatgttggagatcatacttgcactggggaactacatgaacagcagcaagcggggagctgtgtatggcttcaagctccagagcctggatctgctgctggataccaagtccactgaccggaagatgacactgcttcatttcatcgccttgacagtgaaggagaaatacccagacctggctaacttctggcatgagctgcactttgttgagaaggctgcagcagtgtccctggagaacgtgctgctggacgtgaaggagctgggccggggcatggagctgattcggcgtgagtgcagcatccatgacaacagcgtcctccggaacttcctcagtaccaatgaaggcaaactagacaagctccagcgggacgccaagacggctgaggaggcctacaatgcagttgtgcgctactttggcgagagtcccaagactacacctccttctgtattcttcccagtatttgtccgattcattcgttcttacaaggaagcagaacaagagaatgaagcccgcaagaagcaggaggaggtaatgcgggagaagcagctggctcaggaagccaagaaactggatgccaagaccccatcccagcggaacaagtggcaacagcaggagttaatagcagagttgaggcggcgccaggccaaggaacaccggcctgtttatgaggggaaggatggtaccatcgaggacatcatcacaggcctccactgccagcctatggttgttcgccaccaagccaggagtgctgcaccgcccagtggtccccctcgggctccaggcccccactgagaccctctcggaggcagaagcacttcacccctcagagtcctacaagtccaaccagtggacctggaattggccaagggctcaggagagggctgtgttgctctctcaaccatgtccgccccagctcttgaggctggatctttctacttgtgccactatgggcactaggtctgtaggtccctggtgcttccagtactgcactttgcccccaaggtctttgacttcatttcctgaagggtcaccaagggtcagctcagggctaggaaaaaccatttccagccttagcctaaacagggcacatagatctctcccactagagcccagagggatgagaggagagagcaactgttctttctttttttttcccttcctttttgcaggcccatggtcagctctggtctagatgtatctaggcttagggagccctgggaccctgccagtctcagttcatctcttaccaggagcaaggccctctgaagcatgggccgtgccagctgtgccctagtgataagggtaagaggagagatgtcaggctcactgcccttatttctctgcccatttcattctaggctcacactgtccttgtcaaggtgggcagaagagcagaggtcttctctgcaccaaccactctctgcagatggctggagaaagggtgtgccaactcttcaccttctttcctcagctacggtttttttttttttttttttttttttggcaggggacaaggagcatggtggtcttggctatttgcttaccttcccgtttctcctctgcccctggaagggaatgtgggggcccacttttttgtacatgtaccacctccctttcctcttactgtacataaacctcagactctccccctctcaacaaaggcttgatgcaccaggcctgactttgtctcctctttctgagcttagggggctagggtggccatttagtctgacctgggctatggggatagaaaagaaatctttggggcactgcatctgttttggaggagatgagatcagaactctggggaaaggagaaccggctaggtgggctctagccacacaaagggaagcaggcctgccatgagacactagtgccctctgctgggcatgtgtccagtccccagcctgccccagtagcacatggaaaagagtcactggccatgttataaatattgttatttaaaaaacaaaaaacaaaacacacgtacattaggtcctgggtggaggaagaagtggtggagcctcagggccagggcaggcaggagcaggcactgatgctagagggtgatgaccctgccctctgccacccaggctgcgtccaacagcctgtgactcttccctggagaccccttctctcacacttttatctactggcatcacccaccccacatggcatataccacccatctctggtctggggctgagggcaaggactgcactagtccagggagtaggggacccttgaacaccaagagcaaccttgagaggtgccaacaatggtgtgctgggggtggggttactttagaaaaagtggacacagaccagactaaggaagaagtctgaggcagacggtgagggtggcccaggagccatggcctcacacagacccgaggcagagaacagctcattgggtcactggtgatcatccagctgctgtaggagtgtccgccgccgcctctccagctcaccctcactcagctcactttctgacgtgtcccagcctgtctgttggagcaaaggcacagttcacccttagcctgcactaagggccgtggaagcttgaccagcgtgctgactggcctagggcccctgcccctcaccttctccttcttgattccaaagcctggggaacggttagggagctctgcctgttggagctccctgtccttgtcctgttcttgttctttctcatcgctctccttgccagctttctcctcagggtctgtctcactctcaggactattctgtaagagtccagagcccacctcctcagttcctgtggatagcctgggaggcaggtagaacagaactcacaaaatagcaggggcttaggtagaagttccttcactcaccgacttgtgtcttctcttcttagttttcttttttggtttcttggctttccgaaggccatgatctagagatagaaaaatccctactaagtcccaacaggagaaagacaggctctttttctttgttctagcccctctgttcattcttcacaggcaggaacctcatgctctgaggaagtctaagtccagttttccttctccagcttcttgcttgggcaggtagaggaagttctttctacttccacaggtgcagccctcccaatccagtctaccctcaaaggagctggggcttgtggagggcatcctctcagtctgggacaacagttctccagcttctacgctcacagcaactgcttacctgctccaagaagatgggaggaaggggagccccgtcctccaagggcagcacccccactttcaactgaatcaagtgaggaagagggctcagagcctgactctgaggggttccgcctcctccgcttggggggccggagagatggtgggggcagctcctcttcttctgactcagagccctgggcagatcagcagatacatgtcagtgcagaggttctctgccctccagaagccctcgtctgggaattcgagagaggaggaggacccagggccaaaggaatcctcaaacttccctccaagggagatattgtaaggggaaaacaaagtgtttatttccccaaaacaacccagcttcaccccatgtcccttctacacgcttactcactgagggtgagtgggaacgcttgtgatggtgcttcttgcctttcctgccatgctttcggcctttggtgtggaggtgctggcattcagtctgctagaggcagaggaagaagggtgaggacagcaccagacttagccccaggaaggatcctacttcctaaaatctggctttgcctccctttctcagactagagccttctgcctatcccagggatcctcaggcctccccttccttagctggccaggagtgccctaagggtaagagggaggccactgaggtctctgttgaactggtctaatgagttcaagggcctgaggcagatccagaggacaagcctgcctcacctccagcacctgtaggaactcccggaagagccggatccgctccgactccagggtgatctgctcaaaggctgagtcacacacaaaacgctcacggaccttgaacgaggagagcactgctgatcagactaggccccactcagcctggcctggacaccgccatgagcacagggcagggctggggcagagaaaggaagggaactggagctggcccagggctgtgacgtgactggggtgggccctcagtggtgaagcaccgctgccctcaggcttgaggggtgcttggggccaggctacgctcctgacctcttcccaggcagtgcctagctccagagcaggcacagcctgcctcagcatgcttcgaaaggcagcttccctgcgccgcatcctgcgtgcctcctccttctcccgctccctctcccgtgcctctgctttctccagcagctgaggaaagaagggacacggaacagggtcacccaggagggtggatgccaggtcccactcaggcataccttaggaggtggaaagttagggtctgggcttctaccaccatcccctgaattgggaatatagtcagtgggacagtgagtgagaaggaatggagcaagacacagatgaattagagaacttcccacgccccgcccagcccctcacactattgaaggtcagcttgatgttgcctgcgtccagtgcggcagccctcttgtcaaagcttatgacgtgggcgaagtcctcaaaggccgtgttcacctccacgcagaagccccggtcctgtgggtacagcagtgcatgaagcaggggcaccacgtgcctgaggccaaagctggcaggcagagtggtcacattacagatggtcaagaaggcccttgcctctggaagagatccacaggactgtggtctgcattagaaaccaagttatccaagtcctcatcacttgacaattaagcccccatgcctacccttggtttggatgtcacacagagctgaaggggttgggagatgtctcccaactgctgattaatgctgagtttctcaaaattaacttttgttcctttggcttaaagctctggccccagctgggccctcctgctgctcagcagtgcttccatgcattctcaatcaacatttgctggcccctaccctttgggtctatttattgagtgcttactatgtaccaggtaccatgatgagtgtttcacacattatctcatttaatcctcttggttctacatttaagaataggtcctagtatcctaattttacacagaaggagaaaccaaggttcagagaaactagagcacttgcccaaggtctcacagctgatatacggctgggcaagaaccctaccctgggggggctctctatccccaaagtgtctgctttcaagcaccacacccacccagatgacttagtccatgggagaaacggaggccaccaggtgtgcagctccccaccaatactaaaaacatgtccacaggccaggctctatgcttctcatttaggcctcacaacattccagtgaagcagaggcttagaaaagtgatctcagttggcccaagatgacatgagtggtaaatgaagccactggagttcaaagtctggctctcacgtcagttaagcacaggccagattccctttctctccctccacatagctctcacctcctctggcctttttgctgatggcagaggtgtgctcctctttcttctttccaagggtacttcctcaaccctgctacagtccttatcaacacagcattcattctcagggaattgaaagctccaagtcacccttgttactggctccttccatcaagcagacacctcacctaacctggaacatcctttccaccatgctctccccttcatcaagctaactacctctgctcttttccattgtttcaaaacctcttgaaatgcagcagaaaggaaaaggaataaacatttattgagaacctattagacactttacagatgttatttaattctcacaaccttacctatgaattatccctgatttacaggtgagcaaacaggctcagagacacggaacttacggaggtctcagagccaataagcaaccaggagtaatctgactctaaaacatgtgctgcccccatgccacctccatgactctactctcccaaaggttgcttgtgtctactagccaaatccaaggccgccttctttgtcctcactcatctggtcctcagtgcctctaccacttacttcttcaacactcccctctccaggtcacaccctctctgaccttttattctcttgcatatgcatgttcctgagaacagcacttagtcctctttcactacccaatctgtactccctcgcaatctcatccttcatctctcctgattttcaaacatcctagactggatatttcagacacttaaaattcaacagatctcaagagaatatatttctcatgagcatcctccatggatctccctgacccggatctgtctgcctgttctaagtccagggctctttgcattatcctatgggatgaaaggcaccatcatggtctgcctggctgtggaaagcaagagggactcctgggctcatctgccctccataggcaggaacccaaatggggaaagaggaagggaactgtctaaaaaagttgctttctcaggttgtgtggagagacaggactcagtgaggataggcccctacaggcctatcaaccagccactctgtggctaaaagttaattgtccaataaaatttagctatcccaggataaggcatttctactttatacgattattctgttttaaaatatatttgctttgagagtaattccccaaatagaattcctattttctacagccttgctcttcttgttttatccttatcaatagtgccatcatccactgccctgacacctctgattccttcctttccctccatttcacaaaatctatcaattctacttagtgactctatcccactggtgttgaattctcccttttttttttaaacagcagaaacagtttattaaaatagaaatcttatgtagaacctttatgcataaaaaagattcaagctgcttcacttgaaaacaggaagcagcaccaaatccccccatactcaactccaacccttgcttgtctcaaggcacctacatagaaacccagagtgtctcagaagaacagctggagcgctacagcctgctctcttctgctgtccccactgcccccggctaggatcacctcctacaagattcctgcacagcctactgacttttctccctgctcaccctcttccatccctctaacccagctcctagcatctagtgcttcttggacttttgtaccaagtagccccaacagtaggagagaggtctggggataagtgaaatgaatatgactatttgaattaccactatcagttttagtatcttgaggcttcaagaactgctctacctagcaccaccaccttccctaaggacataagtacgtactctagactgaaaggttctactatacaccatctaatctgatcattccccggttcctcattacttacgagagaaaaatccaaatttcttattttagcattcaaggcactttacatgcagggctctacttccaagctggggcatgtggttccagagaaagagaggatacctcaggacagtatgatacatcttacctaatggtaagtaatttaaaatattaaatttatattaaataggtaatatggtgttaaaatgcaacacctacgtgaatttgtaaggcaaaacagtacttcaaagaaatgtatatgcagtgagacatttctagctttatttccagatccctttcaacccaggtaccatttaatctctgtaattaggtgtactctggtggaacactcaccattttttagatgaggaaacagggtcagaaaggtcaagtgacctatccaaggtcacacaactagcaagcagttaagctagacttttactgtaggcagtctgcctccagtcccgctcctaaccactgtactgtattatctcctcaaatgcattagaatcttcacttccataaagaaatatgctctttgtttttttcttttggaacacaaggtttagtccatcactcactcacttttccacttttgataagatgtaaatattgagaactatttctcttctccagtagaagaagagcaacaggccatgtgtgatggtaaatggcagctgacacttgcgacagtatcaagaaggcactaaggaatggtgagaaggatgacttgccctttctaaagtggcatctcagcttgagtctgcagaatgccttgcaaatccagctcagtactgctagataatccatattgacaagagaagctaaagattcagattttctatgtgaagtttcctggttttaaaatgttagcaacaaattccaaatttttacagaacactgtacaggccagaaagaacaatctgtgtgctaccagtttacaattagctatgcttcttcctcctcagacctggcatgccctttccacccccttgcctttgctcttagtaccccgtgtacactccaacctcttccacctacaaatttctaaatgcacagttcaaatgttagttcttcagattcctgtctctgtaataacacttgcccctttgtataacagttctcatgtatatcttcctattagaccatgagctcctgtggtagaaattgtgtattcattactgtatccctagtgtgcagtaaaggatcacagtag

SEQ ID NO: 3892 - DNA, 4006 bp, Homo sapiens
cttgcttcggtgcggctgtccgctacgctgcctccgccctcgccgcgcgcccccgccagcgggactccagggaacccccggcgccctcgacggggccgaggagtcgggactcggggagccggcgctgagggaggagcctggtcggagccgcggagccgaaagctccggagcgtggaggtggggggccgaggcccctgagggggccccgccgcgatgggcaacctggagagcgccgagggggtcccgggagagcccccctctgtcccgttgttgctgccgcccggcaagatgccgatgcctgagccctgtgagctggaggaaaggttcgccctggtgctgagctccatgaacctgcctccagacaaggcccggctcctgcggcagtatgacaatgagaagaaatgggatctgatctgtgaccaggaacgattccaggtgaagaatcctccccacacttacattcagaaactccagagcttcttggaccccagtgtaactcggaagaagttcaggaggagggtgcaggagtcaaccaaagtactaagggagctggagatctctcttcgcaccaaccacattgggtgggtgcgggaatttctgaatgatgaaaacaaaggcctggatgtactggtggattacctgtcctttgcccagtgttctgtcatgtatagcactctccctgggcgcagggccctgaagaactcccgcctagtgagccagaaggatgacgtccacgtctgtatcctttgtctcagagccatcatgaactatcagtacggattcaacctggtcatgtcccacccccatgctgtcaatgagattgcacttagcctcaataacaagaatccaaggaccaaagcccttgtcttagagcttctggcagctgtgtgtttggtgcgaggaggtcacgaaatcatccttgctgcctttgacaatttcaaagaggtatgcaaggagctgcaccgctttgagaagctgatggagtatttccggaatgaggacagcaatattgacttcatggtggcctgcatgcagttcatcaacatcgtggtgcactcggtggaggacatgaacttccgggtccacctgcagtatgagtttaccaagctggggctagaggagttcctgcagaagtcaaggcacacagagagcgagaagctgcaggtgcagattcaggcatatctggacaacgtgtttgatgtcgggggtttgttggaggatgctgagaccaagaatgtagccctggagaaggtggaggagttggaggagcatgtgtcccatctcacagagaagcttctggacctagagaatgaaaacatgatgcgggtggcagaactagagaagcagctgctacagcgggagaaggaactagagagcatcaaggagacatatgagaacacaagccaccaggtgcacaccctgcggaggctcattaaagagaaggaggaggcctttcagcgtcgatgtcatttggagccaaatgtccggggcctggagtctgtggacagtgaggccctggccagagtaggccctgcagagctgagtgagggcatgccaccctccgacctggaccttctggctccagccccaccccctgaggaggtcctgcctcttcctccaccaccagctccgcccttgccccctccacctcccccattaccagacaagtgtcccccagccccacctctccctggtgctgcaccctctgtggtgttgacagtgggcctgtcagccattcgaattaagaaacctatcaagaccaagttccggctgcctgtcttcaactggacagcactgaaacccaaccagatcagtggcactgtcttcagcgaacttgatgatgagaagatcttggaggacctggatcttgataagtttgaagaattattcaagacaaaagcgcagggccctgcccttgacctcatctgctccaaaaacaagacagcgcaaaaagctgccagcaaggtgactctgttggaagccaatcgtgccaagaacctggccatcaccctacgcaaggctggccgctcggctgaggagatctgcagggccattcatacgtttgacttgcagacactacctgtggacttcgtggagtgcctgatgcgcttcctgcccacagaggctgaggtaaagctgctgcggcaatatgagcgggagcggcagcccctggaggagttggcagctgaggaccgcttcatgctgctcttcagcaaggtggaacggttgacccagcgaatggctggcatggccttcctggggaacttccaggataacctgcagatgctcacaccgcaactcaatgccatcattgcggcgtccgcttccgtcaagtcttcacagaagctgaagcagatgttggagatcatacttgcactggggaactacatgaacagcagcaagcggggagctgtgtatggcttcaagctccagagcctggatctgctgctggataccaagtccactgaccggaagatgacactgcttcatttcatcgccttgacagtgaaggagaaatacccagacctggctaacttctggcatgagctgcactttgttgagaaggctgcagcagtgtccctggagaacgtgctgctggacgtgaaggagctgggccggggcatggagctgattcggcgtgagtgcagcatccatgacaacagcgtcctccggaacttcctcagtaccaatgaaggcaaactagacaagctccagcgggacgccaagacggctgaggaggcctacaatgcagttgtgcgctactttggcgagagtcccaagactacacctccttctgtattcttcccagtatttgtccgattcattcgttcttacaaggaagcagaacaagagaatgaagcccgcaagaagcaggaggaggtaatgcgggagaagcagctggctcaggaagccaagaaactggatgccaagaccccatcccagcggaacaagtggcaacagcaggagttaatagcagagttgaggcggcgccaggccaaggaacaccggcctgtttatgaggggaaggatggtaccatcgaggacatcatcacaggcctccactgccagcctatggttgttcgccaccaagccaggagtgctgcaccgcccagtggtccccctcgggctccaggcccccactgagaccctctcggaggcagaagcacttcacccctcagagtcctacaagtccaaccagtggacctggaattggccaagggctcaggagagggctgtgttgctctctcaaccatgtccgccccagctcttgaggctggatctttctacttgtgccactatgggcactaggtctgtaggtccctggtgcttccagtactgcactttgcccccaaggtctttgacttcatttcctgaagggtcaccaagggtcagctcagggctaggaaaaaccatttccagccttagcctaaacagggcacatagatctctcccactagagcccagagggatgagaggagagagcaactgttctttctttttttttcccttcctttttgcaggcccatggtcagctctggtctagatgtatctaggcttagggagccctgggaccctgccagtctcagttcatctcttaccaggagcaaggccctctgaagcatgggccgtgccagctgtgccctagtgataagggtaagaggagagatgtcaggctcactgcccttatttctctgcccatttcattctaggctcacactgtccttgtcaaggtgggcagaagagcagaggtcttctctgcaccaaccactctctgcagatggctggagaaagggtgtgccaactcttcaccttctttcctcagctacggtttttttttttttttttttttttttggcaggggacaaggagcatggtggtcttggctatttgcttaccttcccgtttctcctctgcccctggaagggaatgtgggggcccacttttttgtacatgtaccacctccctttcctcttactgtacataaacctcagactctccccctctc

SEQ ID NO: 3893 - DNA, 4118 bp, Homo sapiens
ggaggtggggggccgaggcccctgagggggccccgccgcgatgggcaacctggagagcgccgagggggtcccgggagagcccccctctgtcccgttgttgctgccgcccggcaagatgccgatgcctgagccctgtgagctggaggaaaggttcgccctggtgctgagctccatgaacctgcctccagacaaggcccggctcctgcggcagtatgacaatgagaagaaatgggatctgatctgtgaccaggaacgattccaggtgaagaatcctccccacacttacattcagaaactccagagcttcttggaccccagtgtaactcggaagaagttcaggaggagggtgcaggagtcaaccaaagtactaagggagctggagatctctcttcgcaccaaccacattgggtgggtgcgggaatttctgaatgatgaaaacaaaggcctggatgtactggtggattacctgtcctttgcccagtgttctgtcatgtttgactttgagggtctggaaagtggtgacgatggtgcatttgacaaactccggtcctggagcaggtcaatcgaggacctgcagccacccagcgccctgtcggcccccttcaccaacagcctcgctcgctctgcgcgccagtctgtgctccggtatagcactctccctgggcgcagggccctgaagaactcccgcctagtgagccagaaggatgacgtccacgtctgtatcctttgtctcagagccatcatgaactatcagtacggattcaacctggtcatgtcccacccccatgctgtcaatgagattgcacttagcctcaataacaagaatccaaggaccaaagcccttgtcttagagcttctggcagctgtgtgtttggtgcgaggaggtcacgaaatcatccttgctgcctttgacaatttcaaagaggtatgcaaggagctgcaccgctttgagaagctgatggagtatttccggaatgaggacagcaatattgacttcatggtggcctgcatgcagttcatcaacatcgtggtgcactcggtggaggacatgaacttccgggtccacctgcagtatgagtttaccaagctggggctagaggagttcctgcagaagtcaaggcacacagagagcgagaagctgcaggtgcagattcaggcatatctggacaacgtgtttgatgtcgggggtttgttggaggatgctgagaccaagaatgtagccctggagaaggtggaggagttggaggagcatgtgtcccatctcacagagaagcttctggacctagagaatgaaaacatgatgcgggtggcagaactagagaagcagctgctacagcgggagaaggaactagagagcatcaaggagacatatgagaacacaagccaccaggtgcacaccctgcggaggctcattaaagagaaggaggaggcctttcagcgtcgatgtcatttggagccaaatgtccggggcctggagtctgtggacagtgaggccctggccagagtaggccctgcagagctgagtgagggcatgccaccctccgacctggaccttctggctccagccccaccccctgaggaggtcctgcctcttcctccaccaccagctccgcccttgccccctccacctcccccattaccagacaagtgtcccccagccccacctctccctggtgctgcaccctctgtggtgttgacagtgggcctgtcagccattcgaattaagaaacctatcaagaccaagttccggctgcctgtcttcaactggacagcactgaaacccaaccagatcagtggcactgtcttcagcgaacttgatgatgagaagatcttggaggacctggatcttgataagtttgaagaattattcaagacaaaagcgcagggccctgcccttgacctcatctgctccaaaaacaagacagcgcaaaaagctgccagcaaggtgactctgttggaagccaatcgtgccaagaacctggccatcaccctacgcaaggctggccgctcggctgaggagatctgcagggccattcatacgtttgacttgcagacactacctgtggacttcgtggagtgcctgatgcgcttcctgcccacagaggctgaggtaaagctgctgcggcaatatgagcgggagcggcagcccctggaggagttggcagctgaggaccgcttcatgctgctcttcagcaaggtggaacggttgacccagcgaatggctggcatggccttcctggggaacttccaggataacctgcagatgctcacaccgcaactcaatgccatcattgcggcgtccgcttccgtcaagtcttcacagaagctgaagcagatgttggagatcatacttgcactggggaactacatgaacagcagcaagcggggagctgtgtatggcttcaagctccagagcctggatctgctgctggataccaagtccactgaccggaagatgacactgcttcatttcatcgccttgacagtgaaggagaaatacccagacctggctaacttctggcatgagctgcactttgttgagaaggctgcagcagtgtccctggagaacgtgctgctggacgtgaaggagctgggccggggcatggagctgattcggcgtgagtgcagcatccatgacaacagcgtcctccggaacttcctcagtaccaatgaaggcaaactagacaagctccagcgggacgccaagacggctgaggcctacaatgcagttgtgcgctactttggcgagagtcccaagactacacctccttctgtattcttcccagtatttgtccgattcattcgttcttacaaggaagcagaacaagagaatgaagcccgcaagaagcaggaggaggtaatgcgggagaagcagctggctcaggaagccaagaaactggatgccaagaccccatcccagcggaacaagtggcaacagcaggagttaatagcagagttgaggcggcgccaggccaaggaacaccggcctgtttatgaggggaaggatggtaccatcgaggacatcatcacagtgctgaagagtgtccctttcacggcccgtactgccaagcggggctcacgcttcttctgtgatgcagcccaccatgatgagtcaaactgttagcccccaaggttggggcccgacaggcctccactgccagcctatggttgttcgccaccaagccaggagtgctgcaccgcccagtggtccccctcgggctccaggcccccactgagaccctctcggaggcagaagcacttcacccctcagagtcctacaagtccaaccagtggacctggaattggccaagggctcaggagagggctgtgttgctctctcaaccatgtccgccccagctcttgaggctggatctttctacttgtgccactatgggcactaggtctgtaggtccctggtgcttccagtactgcactttgcccccaaggtctttgacttcatttcctgaagggtcaccaagggtcagctcagggctaggaaaaaccatttccagccttagcctaaacagggcacatagatctctcccactagagcccagagggatgagaggagagagcaactgttctttctttttttttcccttcctttttgcaggcccatggtcagctctggtctagatgtatctaggcttagggagccctgggaccctgccagtctcagttcatctcttaccaggagcaaggccctctgaagcatgggccgtgccagctgtgccctagtgataagggtaagaggagagatgtcaggctcactgcccttatttctctgcccatttcattctaggctcacactgtccttgtcaaggtgggcagaagagcagaggtcttctctgcaccaaccactctctgcagatggctggagaaagggtgtgccaactcttcaccttctttcctcagctacggtttttttttttttttttttttttttggcaggggacaaggagcatggtggtcttggctatttgcttaccttcccgtttctcctctgcccctggaagggaatgtgggggcccacttttttgtacatgtaccacctccctttcctcttactgtacataaacctcagactctccccctctcaacaaaggcttgatgcacca

SEQ ID NO: 3894 - DNA, 363 bp, Homo sapiens
atgaatggagaggagaaaagctgcagtggctacggaggccctgatgccatggatggtaaactggtatcttctgacgatgatgactttattgtaaaaagagaacatacacgagcatcaggaataaggaaagccgtgctgagtggcccaggtcagtctgctgagaatgaaaccgaccaggtcaattttagagagatccctccacgatgctatccaaagcatgcaaaggcatgcatatattttacttacaaggttcactactctaacagctccactgagattcctgaattcctcactgcattggaagtgctgatggcttcagacttcctagatatatatatttttcttttttttctttttttttga

SEQ ID NO: 3895 - DNA, 2811 bp, Homo sapiens
atggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaagggcatgatgccattgtcacactcctgaagcattataagagaccacaagatgaattgccctgtaatgaatattctcagcctggaggagatggctcctatgtgtctgttccatcacccttggggaagattaaaagcatgacaaaagagaaggcagatattctcctcctaagagctggattgccttcacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacagtcacaatattcttctctatgaggatgggcatgctgtggtggcagattttggagaatcaagatttctacagtctctggatgaagacaacatgacaaaacaacctgggaacctccgttggatggctcctgaggtgttcacgcagtgcactcggtacaccatcaaagcagatgtcttcagctatgctctgtgtctgtgggaaattctcactggcgaaattccattcgctcatctcaagccagcggctgcggcagcagacatggcttaccaccacatcagacctcccattggctattccattcccaagcccatatcatctctgctgatacgagggtggaacgcatgtcctgaaggaagacccgaattttctgaagttgtcatgaagttagaagagtgtctctgcaacattgagctgatgtctcctgcatcaagtaacagcagtgggtctctctcaccttcttcttcttctgattgcctggtgaaccggggaggacctggccggagtcatgtggcagcattaagaagtcgtttcgaattggaatatgctctaaatgcaaggtcctatgctgctttgtcccaaagtgctggacaatattcctctcaaggtctgtctttggaggagatgaaaagaagtcttcaatacacacccattgacaaatatggctatgtatccgatcccatgagctcaatgcattttcattcttgccgaaatagtagcagctttgaggacagcagctga

SEQ ID NO: 3896 - DNA, 2752 bp, Homo sapiens
gcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaagggcatgatgccattgtcacactcctgaagcattataagagaccacaagatgaattgccctgtaatgaatattctcagcctggaggagatggctcctatgtgtctgttccatcacccttggggaagattaaaagcatgacaaaagagaaggcagatattctcctcctaagagctggattgccttcacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacagtcacaatattcttctctatgaggatgggcatgctgtggtggcagattttggagaatcaagatttctacagtctctggatgaagacaacatgacaaaacaacctgggaacctccgttggatggctcctgaggtgttcacgcagtgcactcggtacaccatcaaagcagatgtcttcagctatgctctgtgtctgtgggaaattctcactggcgaaattccattcgctcatctcaagccagcggctgcggcagcagacatggcttaccaccacatcagacctcccattggctattccattcccaagcccatatcatctctgctgatacgagggtggaacgcatgtcctgaagcaaaatccagaccaagtcattacccagtctcatctgtgtacacagaaactcttaagaagaaaaatgaagatcgttttgggatgtggattgagtatctcagaagataacctcttatcctggccattcaacctgatgtgttacatgtttatttgtttagaatcttccatcactaccaaaatgttagctccatgaaagcggtcctttttgtttattttgttcactgctataacactaacatctaaagctggatgcttaagaatgtttgttgagtaaatgaatgaataccagta

SEQ ID NO: 3897 - DNA, 1081 bp, Homo sapiens
tccccgctctgctctgtccggtcacaggactttttgccctctgttcccgggtccctcaggcggccacccagtgggcacactcccaggcggcgctccggccccgcgctccctccctctgcctttcattcccagctgtcaacatcctggaagctttgaagctcaggaaagaagagaaatccactgagaacagtctgtaaaggtccgtagtgctatctacatccagacggtggaagggagagaaagagaaagaaggtatcctaggaatacctgcctgcttagaccctctataaaagctctgtgcatcctgccactgaggactccgaagaggtagcagtcttctgaaagacttcaactgtgaggacatgtcgttcagatttggccaacatctcatcaagccctctgtagtgtttctcaaaacagaactgtccttcgctcttgtgaataggaaacctgtggtaccaggacatgtccttgtgtgcccgctgcggccagtggagcgcttccatgacctgcgtcctgatgaagtggccgatttgtttcagacgacccagagagtcgggacagtggtggaaaaacatttccatgggacctctctcaccttttccatgcaggatggccccgaagccggacagactgtgaagcacgttcacgtccatgttcttcccaggaaggctggagactttcacaggaatgacagcatctatgaggagctccagaaacatgacaaggaggactttcctgcctcttggagatcagaggaggaaatggcagcagaagccgcagctctgcgggtctactttcagtgacacagatgtttttcagatcctgaattccagcaaaagagctattgccaaccagtttgaagaccgccccccgcctctccccaagaggaactgaatcagcatgaaaatgcagtttcttcatctcaccatcctgtattcttcaaccagtgatcccccacctcggtcactccaactcccttaaaatacctagacctaaacggctcagacaggcagatttgaggtttccccctgtctccttattcggcagccttatgattaaacttccttctctgctgcaa

SEQ ID NO: 3898 - DNA, 1433 bp, Homo sapiens
ccccgcagcgcctcagccgacaggggcttccgagcgagcagagtcccgcgccccgcactccatggagcagctgctgcgcgccgagctgcgcaccgcgaccctgcgggccttcggcggccccggcgccggctgcatcagcgagggccgagcctacgacacggacgcaggcccagtgttcgtcaaagtcaaccgcaggacgcaggcccggcagatgtttgagggggaggtggccagcctggaggccctcaggagcacgggcctggtgcgggtgccgaggcccatgaaggtcatcgacctgccgggaggtggggccgcctttgtgatggagcatttgaagatgaagagcttgagcagtcaagcatcaaaacttggagagcagatggcagatttgcatctttacaaccagaagctcagggagaagttgaaggaggaggagaacacagtgggccgaagaggtgagggtgctgagcctcagtatgtggacaagttcggcttccacacggtgacgtgctgcggcttcatcccgcaggtgaatgagtggcaggatgactggccgacctttttcgcccggcaccggctccaggcgcagctggacctcattgagaaggactatgctgaccgagaggcacgagaactctggtcccggctacaggtgaagatcccggatctgttttgtggcctagagattgtccccgcgttgctccacggggatctctggtcgggaaacgtggctgaggacgacgtggggcccattatttacgacccggcttccttctatggccattccgagtttgaactggcaatcgccttgatgtttggggggttccccagatccttcttcaccgcctaccaccggaagatccccaaggctccgggcttcgaccagcggctgctgctctaccagctgtttaactacctgaaccactggaaccacttcgggcgggagtacaggagcccttccttgggcaccatgcgaaggctgctcaagtagcggcccctgccctcccttcccctgtccccgtccccgtctccgtctccccgtccctgtccccccgtcccccgtccctgtgcccccgtccctgtccccctgttcccgtctccccgtccctccgtctccatccccccgtccccccatcctcctgtccccgtccccccgtccccgtccctccatccctgtcccccgtccccctgtccccctgtccacataccaatccccctgtccccgaccccccatccccgtcccccatctccgtccccgtcccccctgccccgtccccgtctccgttcccccgtccccatcctccatccccgtctcccatcgccgtccccccgtccccgtcccccgtccccgtcccccctgtccctgtcccccttcccccgacccctcccagatcctggggaccaataaagcccgcagcgggtctcggctggcg

SEQ ID NO: 3899 - DNA, 1581 bp, Homo sapiens
agagtcccgcgccccgcactccatggagcagctgctgcgcgccgagctgcgcaccgcgaccctgcgggccttcggcggccccggcgccggctgcatcagcgagggccgagcctacgacacggacgcaggcccagtgttcgtcaaagtcaaccgcaggacgcaggcccggcagatgtttgagggggaggtggccagcctggaggccctcaggagcacgggcctggtgcgggtgccgaggcccatgaaggtcatcgacctgccgggaggtggggccgcctttgtgatggagcatttgaagatgaagagcttgagcagtcaagcatcaaaacttggagagcagatggcagatttgcatctttacaaccagaagctcagggagaagttgaaggaggaggagaacacagtgggccgaagaggtgagggtgctgagcctcagtatgtggacaagttcggcttccacacggtgacgtgctgcggcttcatcccgcaggagcctcttgaaccatcatctttgaaatctgtgaagttccaaagaagactttggacagcccaactgccctgtgcttctcttgaagaagccaatattggaccatattttggttttgttaggaacacagcacccattatataagagctagttcaaagtcactgcttcttgaagagagaatactttcaaatctgtctccttgtcgacgcccgtcctgactagttgggtccctgcgaacaatgaccaagctctccctggtgtgggtagagggtgattctcccagctggaggtcacctggggcaagatcctcatgaagcccaagcagatttagggttcccagccaacaggcagtcctcacatctgggctcgctagaactgcacatggagcttaccagatttaccgagacccccgagatctcagccacagctggctcccctggggtcacacacctgtccggagccagtgagcagcaccctcttcacctgtccaggtgagcacggctgggtgcagcttgtggtcctgtggtcctgctgtggatgctgaggtcaagggctgcaagtggcgggctctacaggacttggctggcccagcagagtggtgtttcaaagaaatgaagtgaaatcttacccagagcccctgtgtgtgaagcagacgagaagggggctagtctgtttggagcacagggagcccctcaatgcccctcggactccaggatcaaggaacccacctcagatcaggtgcagcctggctaggaagggtgaggcgccagggaggacacctgccctgcttcctgcttgttgtgcctcggacagcaccaggttccggaggcttcccactccttgggagggctcaatgggtcctgggggaatgtgtgctgcagccaatggggggcagtgctgagcggcgggctcctcagacacctgggcactaaggccccctggggctgccagctgggtcggctgtggtgcttgccccatgctctgtacactgccacatacaggcacccttctaagcacttcactgaactcaactcacccacttgccctagcaggtaaccaggcagataatgtcactgatccgttttatagatgag

SEQ ID NO: 3900 - DNA, 2515 bp, Homo sapiens
ctctgggccgcccctctcagcccaccgtcctcctggcagtgggaaagaagcagagacatggctgggcccctggcagggaccccacgggccaggccagcgttctccttcccacaggccttgtctgtgtttagacctgatttctatctcctgctgaaaatagttctgtttaagaatgtatggaaggccgggcgcggtggttcacacctgtaatcccatcactttgggaggccgaggtgagtggatccctgaggtcaggagttcgagaccatcctggccaacatggtgaaaccccgtctctaccaaaaaatgcaataattagccggatgtggtgccactggcctgtaatcccagctactcgggaggccgaagcaggagaatcgtttgaacccaggaggcggaggctgccgtgagccgagatcatgccactgccctccagcctgggtgacagagtgagaccctgtctcaaaacaaacatgcaattctataggccaaggtattcatggaccacgttcgtcaatgcatgttttcaaccaatgtgtactgtacgtgaggtgagtgttcacctaactgaaaactggaatgtttgtgggaatatttcagaaacaggaaggcccaggtcccacgggaggcgttgggggccggccgggtgtgccgtgccttttaccttcccagcccctgccctggacctgaggccccgcctgatgggcccagccctcttcttccctgcctgacgtgtgtgcccaagttagctccagtgaggcctctgctgtggctgccccaccctaagaggcagcaaggaaggtgggtagcccgggggtccagctctggaccttggttcactcacacctccccacgccctcagtgctcccgggcacccacacgtggcctgtgcatcctcctgtcacagcagcctgcagaccccacacccctcacggcccaggctcagcctcagccttgcagcctctcgtctccgacggggggcccctctgcaccctgccctctgtggtggacgccagctcccagccagagccagctatcagtgaatgaaggtccttgtgactcccacgtggtagcttctgtcaagggcccagtgggcagaggccctggctgagtcaacaaggctgacaaggctgtgttctggatgcaggcccggcagatgtttgagggggaggtggccagcctggaggccctcaggagcacgggcctggtgcgggtgccgaggcccatgaaggtcatcgacctgccgggaggtggggccgcctttgtgatggagcatttgaagatgaagagcttgagcagtcaagcatcaaaacttggagagcagatggcagatttgcatctttacaaccagaagctcagggagaagttgaaggaggaggagaacacagtgggccgaagaggtgagggtgctgagcctcagtatgtggacaagttcggcttccacacggtgacgtgctgcggcttcatcccgcaggtgaatgagtggcaggatgactggccgacctttttcgcccggcaccggctccaggcgcagctggacctcattgagaaggactatgctgaccgagaggcacgagaactctggtcccggctacaggtgggcacggcagtgacttctctgggaaagagctggtcctctcatgatcccgccgcatttgtgcgggttcatctgtaaaacggagctggagcagggaacactgagtcctggagcacacatcagggaggaaggggggcaggggcgggggttcccccaaaagggagtccgaaaggagtgaggagtgaagacacacttggctcctcgtgcccctctccactgctaggtcaccaggtatttagcctcagactttcctcatgtgaaacacaggtgcttgtaaatggtggtgtttaccatgattactgttcttactatcagtaacacttgtccactccatcgtgttcctctcccatgggaagatgtgggtaccagatgatccagaatgactgatttcaaaacataactctcggccgggcacagtggttcacgcctgtaatcgcagcatttgggaggcctaggtgggcagatcacttgaggtcaggagtttgagaccagcctggccaacatggtgaaaccctgtctgtactaaaaatgcaaaaattaaccgtgcatggtggtgcatgcctgtaatcccagctactcaggaggctgaggcaggagaatcacttgaacccgggaggcggaggctgcagtgaggggagattgcaccattgcactccagcctggacgacagagtgagatcctgtatcaaaaagaaaaaaaatcaaaatataactctcaaaatgttaaaaaagaatgtgcatgtcaatccagagtgagtatacatcaaagagacttgaactcattaatgaagaaactaggctgggcacggtggctcaagcctgtaatcctagcactttgggaggccgaggtggatagattttacctgaggtcaggatttcaagaccagactggccaatatggtgaaaccccatctctact

SEQ ID NO: 3901 - DNA, 11688 bp, Homo sapiens
gaagacctcgcagcacagccgggcgcccgtcgggctctgggagagagcgagagagaaatccggttaaaatcagagtcggagggaggtttaaccacagatcggttccgatcggattattccttaaaggggacgcgccattgtcaagagaacggagccaggggcccgagggcggggaccggcggcgctggaggagcgaggcagctgtactaggactgggaacggcctagaacattccatattctgcttcacacacggtgactcactcactactgctttgtaccagtgtgcccactcgagtgcctgtaaagtacaagctccagatcaaaaaagcttctagatggatcctttccaaacttggtgtcttttctacaaactctgtgcctcaacaaccatttctaagtgagctgaagccatttattggtatcttggatggttaacatctaaatgcttaattcctgaaaccactcaagagtcataggattagatgatccaagtcaccaagaaattactgtctcaagtgatacgcttcagcgccagtcagcaaagtaaataaatactgtgcttcttccaactttcattccacttggggaaaaaaaaatatcatcatgtcaaacattacgattgacccagatgtcaaacctggtgaatatgtcatcaagagcctctttgcagaatttgctgttcaagctgaaaagaaaattgaagttgtaatggccgaacccttggagaagctattgtccagatctcttcagaggggtgaagatcttcagtttgatcagttgataagctctatgagctcagtagcagagcactgtctcccttccttacttcgcaccttgtttgactggtacagacgccaaaatggaacggaagatgaatcttatgaatataggcctcggtctagcacaaagtctaagggggatgaacagcaacgtgaaagagattatcttcttgaaaggagggacttagcagtagacttcattttttgtttagttttagttgaagttctaaagcagattcctgttcatcctgtacccgatcccttagttcatgaagttctaaacttagcttttaagcactttaaacataaggaaggatattcaggaaccaacactgggaatgtgcatattattgctgatttatatgcagaggtgataggggttcttgcccaatcaaagtttcaggctgtaaggaagaagtttgtgacagaattaaaagaactgcgacaaaaggaacaaagcccacatgtggtacaaagtgtcatcagcttaataatgggaatgaaattttttcgagtaaaaatgtatcctgtagaagattttgaagcatcatttcaatttatgcaggaatgtgctcagtatttcttagaagtgaaagataaagatataaaacatgcacttgctggtttatttgtggagattcttatccctgtagctgctgctgttaaaaatgaagtgaatgttccctgtttgaaaaattttgtggagatgctttatcagactacttttgaactgagctcgagaaagaagcattcattggctttatatccactaattacctgccttttatgtgtcagtcagaaacaattttttttaaataactggcatattttcctacagaactgtttgtcacatttaaagaataaagatccgaaaatgtctcgagttgcactggaatctttgtatagattattgtgggtttatgtaattagaataaaatgtgaaagcaacactgtaactcaaagtcgtcttatgagcatagtgtcagcactttttccaaaaggctcacgaagtgtggttcctcgtgacacacctctcaatatatttgtgaagattattcagttcattgctcaggaacgcttggattttgcaatgaaagaaataatatttgatcttctcagtgttggaaaatctactaaaactttcaccattaatccagagagaatgaacataggtctcagagtcttccttgtaatagcagacagtttgcagcagaaagatggtgaaccacccatgccaacaacaggagttattcttccctcaggaaatactcttcgtgtaaagaaaatatttctcaataaaaccttgacagatgaagaagcaaaagtcataggaatgtcagtttactatcctcaagtaagaaaagcattagatagcatcctcagacatttggacaaagaagttgggagaccaatgtgtatgaccagtgtgcagatgtctaataaggagcctgaagacatgattacgggggaaagaaaacccaagattgatttgtttagaacttgtattgctgcgattccaaggttgattcctgacggtatgagcagaactgacctgattgaattgttagcaaggctcacaattcatatggatgaagaactgcgtgctctggctttcaatactctgcaggcactaatgcttgattttccagattggcgggaggatgttctttcaggatttgtttattttattgttcgtgaagtgactgatgtccatcccacacttcttgataatgccgtaaagatgttggtacaattaataaatcagtggaaacaagcagcccaaatgcataataaaaaccaggacactcagcatggtgtagctaatggagcttctcatccccctcctctggaaaggagcccatattccaatgtattccatgtggttgaaggctttgcgcttgtcattctctgtagcagtcgacctgccactaggagactagccgtcagtgtccttagagaaatacgggctttatttgcacttctggaaatacctaagggtgatgatgaattagccatagatgtgatggacaggctaagcccatccattcttgagagcttcatacatctcactggggctgatcagactactttgctctattgccctagctcgatagatttacaaactttagcagaatggaactcttctcctattagccaccagtttgatgtgattagtccatcacatatatggatatttgcacatgtgacccaaggccaagacccatggattataagtctctccagttttttaaagcaagaaaatcttcctaaacactgctctacagctgtgagctatgcttggatgtttgcatacacaagacttcagttgttgtcccctcaggtcgatataaatagccccatcaatgctaagaaagtaaataccaccacaagcagtgactcatacattggcctgtggagaaactatctgatcctttgctgcagtgcagcaacatcgtcatcttccacatctgcaggttctgtgagatgttctcctcctgagacgctggcgtctaccccagatagcggctatagcattgattctaaaattattggcatcccatccccttcatccttgtttaagcacatagttccaatgatgcgttctgagagcatggaaatcacagaatcccttgttctaggtcttggcaggaccaacccaggagcttttagggaactaatagaggaattacatcccataattaaagaagcactcgaaagaaggccagagaatatgaaacggcgcaggcgtcgagacattttacgagtacaactggtacgaatatttgaactgctggcagatgctggtgtcattagtcacagtgcaagtggtggccttgataatgaaacacattttctcaacaacactttattggaatatgtagatttaactagacaactcctggaagcagaaaatgaaaaagactctgacacactgaaggatatacgatgccattttagtgccttagtggcgaatattattcagaatgttccagtgcaccagagaagaagtatttttcctcaacagagccttcgtcacagtctatttatgctgttcagtcactgggcaggtccttttagcatcatgtttacgcccttggacagatacagtgatagaaatatgcaaattaatagacatcaatactgtgcgttaaaggctatgtctgctgtactgtgttgtggccctgttgcagataatgtaggactttcatcagatggctatttgtacaaatggttggataacattttggattctctggacaaaaaggttcaccagctgggctgtgaagcagttacgttgttactggagctgaaccctgatcagagcaacctgatgtactgggctgtggaccgctgctacacgggctccgggagggtggcggccggctgctttaaagccattgctaatgttttccagaacagggattatcaatgtgacacagtgatgcttctaaatctgatactgtttaaagcagctgattcttctagaagtatctatgaagttgctatgcaacttttacagattctggaaccgaagatgtttcgctatgctcacaaattggaggttcagagaacagatggagtactcagccagctgtctcctctaccacatctctattctgtttcatattatcagttgtccgaggaactagcaagggcgtatcctgagctaactctcgccatattctcagagataagccagagaatccagacagctcaccctgctgggcggcaggtgatgctgcactacctgctaccatggatgaacaacatcgagctggtggacttaaaacctctccccacagcaaggcgacatgatgaagatgaagatgattccttaaaagaccgagaacttatggtgactagtaggcgctggttacggggagaaggatggggatctccacaagccactgcaatggttttgaacaatctgatgtatatgacagcaaagtatggcgatgaactggcctggtcggaggtggagaatgtgtggaccacacttgcagatggctggcccaaaaacctgaaaataattttgcactttttgatcagcatttgtggggtgaatagcgaaccaagcctcttgccttacgtgaagaaggtcattgtatatttaggtagagataaaacaatgcagttgctagaagagctggtgagtgagcttcagctgaccgatcctgtcagttcaggggtcactcacatggataatcccccgtattatcgcatcacttccagctataaaatcccttctgtcacctcaggaactacttccagtagcaatacaatggtagctcccacagatggcaatcctgataataagcccattaaagagaatattgaagagagctatgtgcacctggacatttacagtggactaaacagtcatttgaatcggcaacatcacagactagaatcccgatacagtagcagctctggaggatcttatgaagaagaaaaaagtgattcaatgccactttattctaattggcgactgaaagtgatggagcataaccaaggagagccactgcccttcccaccagctggaggctgctggtcaccactggtggattacgtgcctgaaacgtcatcacctggattacctcttcacaggtgtaacatagcagtgatccttttgactgatctcatcattgatcatagtgtgaaggtggaatggggaagctacctccatcttcttcttcatgcaatttttatagggtttgaccactgccaccctgaggtgtatgaacattgtaaacgcctgcttctgcacttattaatagtaatgggacccaatagtaacatccgaactgttgcttctgtccttctcaggaacaaggagtttaatgagcccagggtgcttacagtcaaacaagttgcacacttagattataatttcacagcaggcattaacgattttatacctgattaccagccctcccctatgactgactcagggcttagctcaagttctacctcttctagtatcagcttaggaaataacagtgctgccatttcacatctgcacaccactatcctcaatgaggttgacatctcagtggagcaggatggaaaagtcaaaaccctcatggaattcattacctcaagaaaaagagggcccctttggaaccatgaggatgtttctgccaagaatcctagcataaagagtgctgaacagttaactacatttttgaaacatgtggtttctgtttttaagcagtcaagctcagaaggaattcatctggaacatcatcttagtgaagttgctctgcaaacagcactttcctgttcttctcgacactatgctgggagatcctttcagattttcagggccctaaagcagcctctcactgcaactacactttctgatgttctctccagacttgtagaaactgtaggggatccaggagaagatgcacagggatttgtgattgagcttcttctcacattggaatctgcaattgatactttggctgaaaccatgaagcattatgatcttctttctgccctttctcaaacctcatatcatgatcctataatgggaaacaagtatgcagctaacaggaaaagcactggacaactcaatctaagcacaagtcccattaatagtagcagttatttgggatataacagtaatgcaagaagtaactctttgagattaagtttgattggtgaccgacgaggtgaccggcggcggagtaacacactggatataatggatggacggataaaccatagcagtagtttagcaaggactagaagcctttcctctctaagagagaaaggaatgtatgacgtgcagtccactactgagcctaccaacttgatggccaccattttttggatagcagcatctttattagaatcagattatgaatatgaatacctcctggctctcaggcttctcaacaaactgcttatccatttgcctttggataaatcagagagtcgagagaagattgaaaatgtacaaagcaaattgaaatggactaattttccaggacttcagcagctcttccttaagggttttacctcagcatctacacaagaaatgaccgtgcacctcctcagtaaactcatttctgtctccaaacatacattggtggatccttcccaattgtcaggctttcctcttaacatcctttgcttattgcctcacttaatccagcattttgacagcccaactcagttttgcaaagaaacagctagtcgaatagcaaaggtttgtgcagaagaaaaatgcccaacacttgtcaatctggcacacatgatgagtttgtacagtacacacacgtattccagagactgttctaactggatcaatgtcgtgtgcagatacctgcatgactccttctcagatacaacatttaatcttgtgacttatcttgcagagctgttagagaaaggattgtccagtatgcagcaatcattactacagattatttatagtctattgagtcatattgacctgtctgcagccccagccaagcagtttaatctggagatcataaagattattggcaaatatgtacagagtccttactggaaggaagcccttaacatattaaagctggtggtgtcacgctctgcgagtcttgtcgtacccagtgatatccccaagacctatggaggagatacaggttctcctgaaatatccttcactaaaatttttaataatgtttctaaggagttgcctgggaagaccttagattttcattttgatatatctgagacaccaattattggaaacaaatatggtgatcagcacagtgcggctggaagaaatgggaaaccaaaagttattgctgtcactagaagtacttcctcaacttcttctggttctaattctaatgccttggttcctgttagttggaaaaggccacagttatcacagcgaagaacaagagaaaagctaatgaatgtgctttctctctgtggtccagaatctggcctcccaaagaacccatcagttgtattttcttctaatgaggatttggaagtcggtgaccaacagactagcctaatttctacaacagaagacataaatcaagaggaagaagtagctgtggaagataatagcagtgaacaacagtttggtgtttttaaggattttgactttttagatgttgaattggaagatgcagagggtgaaagtatggacaatttcaactggggagttcgcaggcgctcactggacagtattgacaaaggggacactccatccctccaggagtaccagtgctctagtagcacccccagcctgaacctcaccaatcaggaggatacagatgagtcctcggaagaagaagcggcacttacagcaagccagatactctcacgcacacagatgttaaacagtgattctgccactgatgaaacaataccagaccatcctgacttacttctccagtctgaagattccactggcagcatcacaacagaggaagtgcttcaaatcagggatgagaccccaactttggaggcttctctagataatgctaacagccggctgcctgaggatacaacttcagtattaaaggaggaacatgttacaacctttgaagatgaaggatcctatataattcaagaacagcaggaatctcttgtgtgtcaaggaattcttgatttagaagaaactgaaatgccagagcctctagctcctgaaagttaccccgagtcagtctgtgaagaggatgttaccttagctctgaaagagctagatgaaagatgtgaagaagaagaagcggatttctccggactgtctagtcaagatgaagaagagcaagatggttttccagaagtacagacgtcgcctctgccgtcaccatttctttctgccatcatagccgcctttcagcccgtggcatatgatgatgaagaggaagcctggcgctgccacgtcaatcagatgctgtctgacaccgacgggtcctctgcagtgtttacttttcatgtgttttctaggctgtttcagacaattcaaagaaagtttggagaaataactaatgaggcagtcagctttcttggtgatagtctgcaacgcattggtaccaaatttaaaagttccttggaagtgatgatgctgtgttcagaatgcccaacagtctttgtggatgctgaaacactgatgtcatgtggtttgctggaaacactcaagtttggtgttttggagttgcaagaacacctggatacatacaatgtgaaaagagaagccgctgagcagtggctagatgattgtaagaggacatttggtgccaaagaagacatgtataggataaacacagatgcacaagaattggagctctgccgaagattatacaaattgcattttcaattgctgcttctgttccaggcctactgtaaacttatcaaccaagtaaatacgataaaaaatgaagcagaggtcatcaacatgtcagaggaacttgcccaactggaaagtatcctcaaagaagctgagtccgcttccgaaaacgaagaaattgacatttccaaagctgcacaaactactatagaaactgccattcattctttaattgaaactttgaaaaataaagaatttatatcagctgtagcacaagtcaaagctttcagatctctctggcccagtgatatctttggcagttgtgaagatgaccctgtacagacactgttacatatatatttccatcatcagacgctgggccagacaggaagctttgcagttataggctctaacctggacatgtcagaagccaactacaaactgatggaacttaatctggaaataagagagtctctacgcatggtgcaatcataccaacttctagcacaggccaaaccaatgggaaatatggtgagcactggattctgagacacttcaggcctttaggaaagaaactaaactgaagatgatgaagaatattaaccaagcaccttttatggacccttgcattcactgataactttctggcagcatctactttttagtgtaactaatgtcaaactgtatcatcaaaaacaaagatctgaaagaaaaaaacatctgatattttaacagctgccaatatctcccacaataactgcgtgaagaaggaattttttaattacttaacctacgtgaaaagaaaagggctaaaagtgatgcctacaaatacattactttctggggaaagaaaagaattccaagaatgtttgcaataatggcctccaatactgaaacaaccaaaagcaggtgaaatgaggctgaaatcaaggctgtttcattttagctgaagacctgcaaagctgcttggatttctagcagttgaaaacctaacctgcaattgatgcttaatcatccatccacatgaacatgcagtcagctatacgcatcaagactcgtttgcaaaaaccattgatttttcagtatgtgggataagggtttgggtttttttgttttttggtctgtataaggaattatgtgtgtgtgagttgggatgtatggatatgtgatagtcatattttcaaggtatggatgtttggtgataacgtctcagagcatgcctaaaagagcactgcaagattatttttgaagaaatgttattttattagatctaactcttcatagtatgtaaatgttagaacattttaataatattttaaaactgggctttcccagtatttcaaaaagaaataatatatctgttaacgttattggaatgctgctcagttctctgatcagtgcttatgttatgattgttgataactaaccaaagtagatgcctgcagagactttaaaatgtaaaataaagatgtatgctgcctgtcagctattctcattagaaaagttttaacttattttactccatatagaaactgtagagactaaaaccagttattttcttgtacatttgtgccatgcactgttgttatacaagaataggtgtacaaagctaaagaaaaattgtggtcattgatgatggaatatatgacttgcaggctttgaagtctgcagaattcaagaaaagagctgcaaatgcatttttgtatctttattcaggactcacatgctttaccctaaagaaacctggggctaggggaaatgaaaggaagcctgaagactgactaccaaaacatgcaatatacttattcactgtctaagtctgtagtataacatgaactggagtctctatccttttctaaaatcgcattttgtaagaaaagaaagaaaaaaaaaaaaaaagaatgtagtcccacaactcctgatttgaaagaaacaccttgtattttttatatacatctcttatccactgtgacttttcttttaaactgggctctgtgattccagagtttagaatgtagaaatgaaatgcttagctttaccttttcttggggggtgtggaccctgccagaaatgtaattacgtatgctcaagtgcattaattgaaggcactgtgcacaccattggactgctgaccacagttaaacatttccagtaaaatttcgtaactggtcacagctcattcataatcactgtattttttgaccctgataaagacaattattttgatggtgttctggtactgtaattggtatcctttaaattatttaaaacttttgggtgtggggcaggcagagagggatggtgtccagagatacatcacactttacatcctatcttactgtcctctgtttttcttaccctccttacatcctttttgttaaaaataaaaagcattgtagctgttggtttgtgttgtattttaacaaagaatgaatgattacagtgtgcatcatttagaaacctttcaaatgttaccttcttgaattgccctagaaaagaacaaaattagttgactacccaaccaaacctttcagttgatatttgctttttgtgtttatttatatgtaactaagtctattaatataataaaaatgaatatacctgcagc

SEQ ID NO: 3902 - DNA, 11706 bp, Homo sapiens
gaagacctcgcagcacagccgggcgcccgtcgggctctgggagagagcgagagagaaatccggttaaaatcagagtcggagggaggtttaaccacagatcggttccgatcggattattccttaaaggggacgcgccattgtcaagagaacggagccaggggcccgagggcggggaccggcggcgctggaggagcgaggcagctgtactaggactgggaacggcctagaacattccatattctgcttcacacacggtgactcactcactactgctttgtaccagtgtgcccactcgagtgcctgtaaagtacaagctccagatcaaaaaagcttctagatggatcctttccaaacttggtgtcttttctacaaactctgtgcctcaacaaccatttctaagtgagctgaagccatttattggtatcttggatggttaacatctaaatgcttaattcctgaaaccactcaagagtcataggattagatgatccaagtcaccaagaaattactgtctcaagtgatacgcttcagcgccagtcagcaaagtaaataaatactgtgcttcttccaactttcattccacttggggaaaaaaaaatatcatcatgtcaaacattacgattgacccagatgtcaaacctggtgaatatgtcatcaagagcctctttgcagaatttgctgttcaagctgaaaagaaaattgaagttgtaatggccgaacccttggagaagctattgtccagatctcttcagaggggtgaagatcttcagtttgatcagttgataagctctatgagctcagtagcagagcactgtctcccttccttacttcgcaccttgtttgactggtacagacgccaaaatggaacggaagatgaatcttatgaatataggcctcggtctagcacaaagtctaagggggatgaacagcaacgtgaaagagattatcttcttgaaaggagggacttagcagtagacttcattttttgtttagttttagttgaagttctaaagcagattcctgttcatcctgtacccgatcccttagttcatgaagttctaaacttagcttttaagcactttaaacataaggaaggatattcaggaaccaacactgggaatgtgcatattattgctgatttatatgcagaggtgataggggttcttgcccaatcaaagtttcaggctgtaaggaagaagtttgtgacagaattaaaagaactgcgacaaaaggaacaaagcccacatgtggtacaaagtgtcatcagcttaataatgggaatgaaattttttcgagtaaaaatgtatcctgtagaagattttgaagcatcatttcaatttatgcaggaatgtgctcagtatttcttagaagtgaaagataaagatataaaacatgcacttgctggtttatttgtggagattcttatccctgtagctgctgctgttaaaaatgaagtgaatgttccctgtttgaaaaattttgtggagatgctttatcagactacttttgaactgagctcgagaaagaagcattcattggctttatatccactaattacctgccttttatgtgtcagtcagaaacaattttttttaaataactggcatattttcctacagaactgtttgtcacatttaaagaataaagatccgaaaatgtctcgagttgcactggaatctttgtatagattattgtgggtttatgtaattagaataaaatgtgaaagcaacactgtaactcaaagtcgtcttatgagcatagtgtcagcactttttccaaaaggctcacgaagtgtggttcctcgtgacacacctctcaatatatttgtgaagattattcagttcattgctcaggaacgcttggattttgcaatgaaagaaataatatttgatcttctcagtgttggaaaatctactaaaactttcaccattaatccagagagaatgaacataggtctcagagtcttccttgtaatagcagacagtttgcagcagaaagatggtgaaccacccatgccaacaacaggagttattcttccctcaggaaatactcttcgtgtaaagaaaatatttctcaataaaaccttgacagatgaagaagcaaaagtcataggaatgtcagtttactatcctcaagtaagaaaagcattagatagcatcctcagacatttggacaaagaagttgggagaccaatgtgtatgaccagtgtgcagatgtctaataaggagcctgaagacatgattacgggggaaagaaaacccaagattgatttgtttagaacttgtattgctgcgattccaaggttgattcctgacggtatgagcagaactgacctgattgaattgttagcaaggctcacaattcatatggatgaagaactgcgtgctctggctttcaatactctgcaggcactaatgcttgattttccagattggcgggaggatgttctttcaggatttgtttattttattgttcgtgaagtgactgatgtccatcccacacttcttgataatgccgtaaagatgttggtacaattaataaatcagtggaaacaagcagcccaaatgcataataaaaaccaggacactcagcatggtgtagctaatggagcttctcatccccctcctctggaaaggagcccatattccaatgtattccatgtggttgaaggctttgcgcttgtcattctctgtagcagtcgacctgccactaggagactagccgtcagtgtccttagagaaatacgggctttatttgcacttctggaaatacctaagggtgatgatgaattagccatagatgtgatggacaggctaagcccatccattcttgagagcttcatacatctcactggggctgatcagactactttgctctattgccctagctcgatagatttacaaactttagcagaatggaactcttctcctattagccaccagtttgatgtgattagtccatcacatatatggatatttgcacatgtgacccaaggccaagacccatggattataagtctctccagttttttaaagcaagaaaatcttcctaaacactgctctacagctgtgagctatgcttggatgtttgcatacacaagacttcagttgttgtcccctcaggtcgatataaatagccccatcaatgctaagaaagtaaataccaccacaagcagtgactcatacattggcctgtggagaaactatctgatcctttgctgcagtgcagcaacatcgtcatcttccacatctgcaggttctgtgagatgttctcctcctgagacgctggcgtctaccccagatagcggctatagcattgattctaaaattattggcatcccatccccttcatccttgtttaagcacatagttccaatgatgcgttctgagagcatggaaatcacagaatcccttgttctaggtcttggcaggaccaacccaggagcttttagggaactaatagaggaattacatcccataattaaagaagcactcgaaagaaggccagagaatatgaaacggcgcaggcgtcgagacattttacgagtacaactggtacgaatatttgaactgctggcagatgctggtgtcattagtcacagtgcaagtggtggccttgataatgaaacacattttctcaacaacactttattggaatatgtagatttaactagacaactcctggaagcagaaaatgaaaaagactctgacacactgaaggatatacgatgccattttagtgccttagtggcgaatattattcagaatgttccagtgcaccagagaagaagtatttttcctcaacagagccttcgtcacagtctatttatgctgttcagtcactgggcaggtccttttagcatcatgtttacgcccttggacagatacagtgatagaaatatgcaaattaatagacatcaatactgtgcgttaaaggctatgtctgctgtactgtgttgtggccctgttgcagataatgtaggactttcatcagatggctatttgtacaaatggttggataacattttggattctctggacaaaaaggttcaccagctgggctgtgaagcagttacgttgttactggagctgaaccctgatcagagcaacctgatgtactgggctgtggaccgctgctacacgggctccgggagggtggcggccggctgctttaaagccattgctaatgttttccagaacagggattatcaatgtgacacagtgatgcttctaaatctgatactgtttaaagcagctgattcttctagaagtatctatgaagttgctatgcaacttttacagattctggaaccgaagatgtttcgctatgctcacaaattggaggttcagagaacagatggagtactcagccagctgtctcctctaccacatctctattctgtttcatattatcagttgtccgaggaactagcaagggcgtatcctgagctaactctcgccatattctcagagataagccagagaatccagacagctcaccctgctgggcggcaggtgatgctgcactacctgctaccatggatgaacaacatcgagctggtggacttaaaacctctccccacagcaaggcgacatgatgaagatgaagatgattccttaaaagaccgagaacttatggtgactagtaggcgctggttacggggagaaggatggggatctccacaagccactgcaatggttttgaacaatctgatgtatatgacagcaaagtatggcgatgaactggcctggtcggaggtggagaatgtgtggaccacacttgcagatggctggcccaaaaacctgaaaataattttgcactttttgatcagcatttgtggggtgaatagcgaaccaagcctcttgccttacgtgaagaaggtcattgtatatttaggtagagataaaacaatgcagttgctagaagagctggtgagtgagcttcagctgaccgatcctgtcagttcaggggtcactcacatggataatcccccgtattatcgcatcacttccagctataaaatcccttctgtcacctcaggaactacttccagtagcaatacaatggtagctcccacagatggcaatcctgataataagcccattaaagagaatattgaagagagctatgtgcacctggacatttacagtggactaaacagtcatttgaatcggcaacatcacagactagaatcccgatacagtagcagctctggaggatcttatgaagaagaaaaaagtgattcaatgccactttattctaattggcgactgaaagtgatggagcataaccaaggagagccactgcccttcccaccagctggaggctgctggtcaccactggtggattacgtgcctgaaacgtcatcacctggattacctcttcacaggtgtaacatagcagtgatccttttgactgatctcatcattgatcatagtgtgaaggtggaatggggaagctacctccatcttcttcttcatgcaatttttatagggtttgaccactgccaccctgaggtgtatgaacattgtaaacgcctgcttctgcacttattaatagtaatgggacccaatagtaacatccgaactgttgcttctgtccttctcaggaacaaggagtttaatgagcccagggtgcttacagtcaaacaagttgcacacttagattataatttcacagcaggcattaacgattttatacctgattaccagccctcccctatgactgactcagggcttagctcaagttctacctcttctagtatcagcttaggaaataacagtgctgccatttcacatctgcacaccactatcctcaatgaggttgacatctcagtggagcaggatggaaaagtcaaaaccctcatggaattcattacctcaagaaaaagagggcccctttggaaccatgaggatgtttctgccaagaatcctagcataaagagtgctgaacagttaactacatttttgaaacatgtggtttctgtttttaagcagtcaagctcagaaggaattcatctggaacatcatcttagtgaagttgctctgcaaacagcactttcctgttcttctcgacactatgctgggagatcctttcagattttcagggccctaaagcagcctctcactgcaactacactttctgatgttctctccagacttgtagaaactgtaggggatccaggagaagatgcacagggatttgtgattgagcttcttctcacattggaatctgcaattgatactttggctgaaaccatgaagcattatgatcttctttctgccctttctcaaacctcatatcatgatcctataatgggaaacaagtatgcagctaacaggaaaagcactggacaactcaatctaagcacaagtcccattaatagtagcagttatttgggatataacagtaatgcaagaagtaactctttgagattaagtttgattggtgaccgacgaggtgaccggcggcggagtaacacactggatataatggatggacggataaaccatagcagtagtttagcaaggactagaagcctttcctctctaagagagaaaggaatgtatgacgtgcagtccactactgagcctaccaacttgatggccaccattttttggatagcagcatctttattagaatcagattatgaatatgaatacctcctggctctcaggcttctcaacaaactgcttatccatttgcctttggataaatcagagagtcgagagaagattgaaaatgtacaaagcaaattgaaatggactaattttccaggacttcagcagctcttccttaagggttttacctcagcatctacacaagaaatgaccgtgcacctcctcagtaaactcatttctgtctccaaacatacattggtggatccttcccaattgtcaggctttcctcttaacatcctttgcttattgcctcacttaatccagcattttgacagcccaactcagttttgcaaagaaacagctagtcgaatagcaaaggtttgtgcagaagaaaaatgcccaacacttgtcaatctggcacacatgatgagtttgtacagtacacacacgtattccagagactgttctaactggatcaatgtcgtgtgcagatacctgcatgactccttctcagatacaacatttaatcttgtgacttatcttgcagagctgttagagaaaggattgtccagtatgcagcaatcattactacagattatttatagtctattgagtcatattgacctgtctgcagccccagccaagcagtttaatctggagatcataaagattattggcaaatatgtacagagtccttactggaaggaagcccttaacatattaaagctggtggtgtcacgctctgcgagtcttgtcgtacccagtgatatccccaagacctatggaggagatacaggttctcctgaaatatccttcactaaaatttttaataatgtttctaaggagttgcctgggaagaccttagattttcattttgatatatctgagacaccaattattggaaacaaatatggtgatcagcacagtgcggctggaagaaatgggaaaccaaaagttattgctgtcactagaagtacttcctcaacttcttctggttctaattctaatgccttggttcctgttagttggaaaaggccacagttatcacagcgaagaacaagagaaaagctaatgaatgtgctttctctctgtggtccagaatctggcctcccaaagaacccatcagttgtattttcttctaatgaggatttggaagtcggtgaccaacagactagcctaatttctacaacagaagacataaatcaagaggaagaagtagctgtggaagataatagcagtgaacaacagtttggtgtttttaaggattttgactttttagatgttgaattggaagatgcagagggtgaaagtatggacaatttcaactggggagttcgcaggcgctcactggacagtattgacaaaggggacactccatccctccaggagtaccagtgctctagtagcacccccagcctgaacctcaccaatcaggaggatacagatgagtcctcggaagaagaagcggcacttacagcaagccagatactctcacgcacacagatgttaaacagtgattctgccactgatgaaacaataccagaccatcctgacttacttctccagtctgaagattccactggcagcatcacaacagaggaagtgcttcaaatcagggatgagaccccaactttggaggcttctctagataatgctaacagccggctgcctgaggatacaacttcagtattaaaggaggaacatgttacaacctttgaagatgaaggatcctatataattcaagaacagcaggaatctcttgtgtgtcaaggaattcttgatttagaagaaactgaaatgccagagcctctagctcctgaaagttaccccgagtcagtctgtgaagaggatgttaccttagctctgaaagagctagatgaaagatgtgaagaagaagaagcggatttctccggactgtctagtcaagatgaagaagagcaagatggttttccagaagtacagacgtcgcctctgccgtcaccatttctttctgccatcatagccgcctttcagcccgtggcatatgatgatgaagaggaagcctggcgctgccacgtcaatcagatgctgtctgacaccgacgggtcctctgcagtgtttacttttcatgtgttttctaggctgtttcagacaattcaaagaaagtttggagaaataactaatgaggcagtcagctttcttggtgatagtctgcaacgcattggtaccaaatttaaaagttccttggaagtgatgatgctgtgttcagaatgcccaacagtctttgtggatgctgaaacactgatgtcatgtggtttgctggaaacactcaagtttggtgttttggagttgcaagaacacctggatacatacaatgtgaaaagagaagccgctgagcagtggctagatgattgtaagaggacatttggtgccaaagaagacatgtataggataaacacagatgcacaacaaatggaaatactagcagaattggagctctgccgaagattatacaaattgcattttcaattgctgcttctgttccaggcctactgtaaacttatcaaccaagtaaatacgataaaaaatgaagcagaggtcatcaacatgtcagaggaacttgcccaactggaaagtatcctcaaagaagctgagtccgcttccgaaaacgaagaaattgacatttccaaagctgcacaaactactatagaaactgccattcattctttaattgaaactttgaaaaataaagaatttatatcagctgtagcacaagtcaaagctttcagatctctctggcccagtgatatctttggcagttgtgaagatgaccctgtacagacactgttacatatatatttccatcatcagacgctgggccagacaggaagctttgcagttataggctctaacctggacatgtcagaagccaactacaaactgatggaacttaatctggaaataagagagtctctacgcatggtgcaatcataccaacttctagcacaggccaaaccaatgggaaatatggtgagcactggattctgagacacttcaggcctttaggaaagaaactaaactgaagatgatgaagaatattaaccaagcaccttttatggacccttgcattcactgataactttctggcagcatctactttttagtgtaactaatgtcaaactgtatcatcaaaaacaaagatctgaaagaaaaaaacatctgatattttaacagctgccaatatctcccacaataactgcgtgaagaaggaattttttaattacttaacctacgtgaaaagaaaagggctaaaagtgatgcctacaaatacattactttctggggaaagaaaagaattccaagaatgtttgcaataatggcctccaatactgaaacaaccaaaagcaggtgaaatgaggctgaaatcaaggctgtttcattttagctgaagacctgcaaagctgcttggatttctagcagttgaaaacctaacctgcaattgatgcttaatcatccatccacatgaacatgcagtcagctatacgcatcaagactcgtttgcaaaaaccattgatttttcagtatgtgggataagggtttgggtttttttgttttttggtctgtataaggaattatgtgtgtgtgagttgggatgtatggatatgtgatagtcatattttcaaggtatggatgtttggtgataacgtctcagagcatgcctaaaagagcactgcaagattatttttgaagaaatgttattttattagatctaactcttcatagtatgtaaatgttagaacattttaataatattttaaaactgggctttcccagtatttcaaaaagaaataatatatctgttaacgttattggaatgctgctcagttctctgatcagtgcttatgttatgattgttgataactaaccaaagtagatgcctgcagagactttaaaatgtaaaataaagatgtatgctgcctgtcagctattctcattagaaaagttttaacttattttactccatatagaaactgtagagactaaaaccagttattttcttgtacatttgtgccatgcactgttgttatacaagaataggtgtacaaagctaaagaaaaattgtggtcattgatgatggaatatatgacttgcaggctttgaagtctgcagaattcaagaaaagagctgcaaatgcatttttgtatctttattcaggactcacatgctttaccctaaagaaacctggggctaggggaaatgaaaggaagcctgaagactgactaccaaaacatgcaatatacttattcactgtctaagtctgtagtataacatgaactggagtctctatccttttctaaaatcgcattttgtaagaaaagaaagaaaaaaaaaaaaaaagaatgtagtcccacaactcctgatttgaaagaaacaccttgtattttttatatacatctcttatccactgtgacttttcttttaaactgggctctgtgattccagagtttagaatgtagaaatgaaatgcttagctttaccttttcttggggggtgtggaccctgccagaaatgtaattacgtatgctcaagtgcattaattgaaggcactgtgcacaccattggactgctgaccacagttaaacatttccagtaaaatttcgtaactggtcacagctcattcataatcactgtattttttgaccctgataaagacaattattttgatggtgttctggtactgtaattggtatcctttaaattatttaaaacttttgggtgtggggcaggcagagagggatggtgtccagagatacatcacactttacatcctatcttactgtcctctgtttttcttaccctccttacatcctttttgttaaaaataaaaagcattgtagctgttggtttgtgttgtattttaacaaagaatgaatgattacagtgtgcatcatttagaaacctttcaaatgttaccttcttgaattgccctagaaaagaacaaaattagttgactacccaaccaaacctttcagttgatatttgctttttgtgtttatttatatgtaactaagtctattaatataataaaaatgaatatacctgcagc

SEQ ID NO: 3903 - DNA, 11103 bp, Homo sapiens
atgtcaaacattacgattgacccagatgtcaaacctggtgaatatgtcatcaagagcctctttgcagaatttgctgttcaagctgaaaagaaaattgaagttgtaatggccgaacccttggagaagctattgtccagatctcttcagaggggtgaagatcttcagtttgatcagttgataagctctatgagctcagtagcagagcactgtctcccttccttacttcgcaccttgtttgactggtacagacgccaaaatggaacggaagatgaatcttatgaatataggcctcggtctagcacaaagtctaagggggatgaacagcaacgtgaaagagattatcttcttgaaaggagggacttagcagtagacttcattttttgtttagttttagttgaagttctaaagcagattcctgttcatcctgtacccgatcccttagttcatgaagttctaaacttagcttttaagcactttaaacataaggaaggatattcaggaaccaacactgggaatgtgcatattattgctgatttatatgcagaggtgataggggttcttgcccaatcaaagtttcaggctgtaaggaagaagtttgtgacagaattaaaagaactgcgacaaaaggaacaaagcccacatgtggtacaaagtgtcatcagcttaataatgggaatgaaattttttcgagtaaaaatgtatcctgtagaagattttgaagcatcatttcaatttatgcaggaatgtgctcagtatttcttagaagtgaaagataaagatataaaacatgcacttgctggtttatttgtggagattcttatccctgtagctgctgctgttaaaaatgaagtgaatgttccctgtttgaaaaattttgtggagatgctttatcagactacttttgaactgagctcgagaaagaagcattcattggctttatatccactaattacctgccttttatgtgtcagtcagaaacaattttttttaaataactggcatattttcctacagaactgtttgtcacatttaaagaataaagatccgaaaatgtctcgagttgcactggaatctttgtatagattattgtgggtttatgtaattagaataaaatgtgaaagcaacactgtaactcaaagtcgtcttatgagcatagtgtcagcactttttccaaaaggctcacgaagtgtggttcctcgtgacacacctctcaatatatttgtgaagattattcagttcattgctcaggaacgcttggattttgcaatgaaagaaataatatttgatcttctcagtgttggaaaatctactaaaactttcaccattaatccagagagaatgaacataggtctcagagtcttccttgtaatagcagacagtttgcagcagaaagatggtgaaccacccatgccaacaacaggagttattcttccctcaggaaatactcttcgtgtaaagaaaatatttctcaataaaaccttgacagatgaagaagcaaaagtcataggaatgtcagtttactatcctcaagtaagaaaagcattagatagcatcctcagacatttggacaaagaagttgggagaccaatgtgtatgaccagtgtgcagatgtctaataaggagcctgaagacatgattacgggggaaagaaaacccaagattgatttgtttagaacttgtattgctgcgattccaaggttgattcctgacggtatgagcagaactgacctgattgaattgttagcaaggctcacaattcatatggatgaagaactgcgtgctctggctttcaatactctgcaggcactaatgcttgattttccagattggcgggaggatgttctttcaggatttgtttattttattgttcgtgaagtgactgatgtccatcccacacttcttgataatgccgtaaagatgttggtacaattaataaatcagtggaaacaagcagcccaaatgcataataaaaaccaggacactcagcatggtgtagctaatggagcttctcatccccctcctctggaaaggagcccatattccaatgtattccatgtggttgaaggctttgcgcttgtcattctctgtagcagtcgacctgccactaggagactagccgtcagtgtccttagagaaatacgggctttatttgcacttctggaaatacctaagggtgatgatgaattagccatagatgtgatggacaggctaagcccatccattcttgagagcttcatacatctcactggggctgatcagactactttgctctattgccctagctcgatagatttacaaactttagcagaatggaactcttctcctattagccaccagtttgatgtgattagtccatcacatatatggatatttgcacatgtgacccaaggccaagacccatggattataagtctctccagttttttaaagcaagaaaatcttcctaaacactgctctacagctgtgagctatgcttggatgtttgcatacacaagacttcagttgttgtcccctcaggtcgatataaatagccccatcaatgctaagaaagtaaataccaccacaagcagtgactcatacattggcctgtggagaaactatctgatcctttgctgcagtgcagcaacatcgtcatcttccacatctgcaggttctgtgagatgttctcctcctgagacgctggcgtctaccccagatagcggctatagcattgattctaaaattattggcatcccatccccttcatccttgtttaagcacatagttccaatgatgcgttctgagagcatggaaatcacagaatcccttgttctaggtcttggcaggaccaacccaggagcttttagggaactaatagaggaattacatcccataattaaagaagcactcgaaagaaggccagagaatatgaaacggcgcaggcgtcgagacattttacgagtacaactggtacgaatatttgaactgctggcagatgctggtgtcattagtcacagtgcaagtggtggccttgataatgaaacacattttctcaacaacactttattggaatatgtagatttaactagacaactcctggaagcagaaaatgaaaaagactctgacacactgaaggatatacgatgccattttagtgccttagtggcgaatattattcagaatgttccagtgcaccagagaagaagtatttttcctcaacagagccttcgtcacagtctatttatgctgttcagtcactgggcaggtccttttagcatcatgtttacgcccttggacagatacagtgatagaaatatgcaaattaatagacatcaatactgtgcgttaaaggctatgtctgctgtactgtgttgtggccctgttgcagataatgtaggactttcatcagatggctatttgtacaaatggttggataacattttggattctctggacaaaaaggttcaccagctgggctgtgaagcagttacgttgttactggagctgaaccctgatcagagcaacctgatgtactgggctgtggaccgctgctacacgggctccgggagggtggcggccggctgctttaaagccattgctaatgttttccagaacagggattatcaatgtgacacagtgatgcttctaaatctgatactgtttaaagcagctgattcttctagaagtatctatgaagttgctatgcaacttttacagattctggaaccgaagatgtttcgctatgctcacaaattggaggttcagagaacagatggagtactcagccagctgtctcctctaccacatctctattctgtttcatattatcagttgtccgaggaactagcaagggcgtatcctgagctaactctcgccatattctcagagataagccagagaatccagacagctcaccctgctgggcggcaggtgatgctgcactacctgctaccatggatgaacaacatcgagctggtggacttaaaacctctccccacagcaaggcgacatgatgaagatgaagatgattccttaaaagaccgagaacttatggtgactagtaggcgctggttacggggagaaggatggggatctccacaagccactgcaatggttttgaacaatctgatgtatatgacagcaaagtatggcgatgaactggcctggtcggaggtggagaatgtgtggaccacacttgcagatggctggcccaaaaacctgaaaataattttgcactttttgatcagcatttgtggggtgaatagcgaaccaagcctcttgccttacgtgaagaaggtcattgtatatttaggtagagataaaacaatgcagttgctagaagagctggtgagtgagcttcagctgaccgatcctgtcagttcaggggtcactcacatggataatcccccgtattatcgcatcacttccagctataaaatcccttctgtcacctcaggaactacttccagtagcaatacaatggtagctcccacagatggcaatcctgataataagcccattaaagagaatattgaagagagctatgtgcacctggacatttacagtggactaaacagtcatttgaatcggcaacatcacagactagaatcccgatacagtagcagctctggaggatcttatgaagaagaaaaaagtgattcaatgccactttattctaattggcgactgaaagtgatggagcataaccaaggagagccactgcccttcccaccagctggaggctgctggtcaccactggtggattacgtgcctgaaacgtcatcacctggattacctcttcacaggtgtaacatagcagtgatccttttgactgatctcatcattgatcatagtgtgaaggtggaatggggaagctacctccatcttcttcttcatgcaatttttatagggtttgaccactgccaccctgaggtgtatgaacattgtaaacgcctgcttctgcacttattaatagtaatgggacccaatagtaacatccgaactgttgcttctgtccttctcaggaacaaggagtttaatgagcccagggtgcttacagtcaaacaagttgcacacttagattataatttcacagcaggcattaacgattttatacctgattaccagccctcccctatgactgactcagggcttagctcaagttctacctcttctagtatcagcttaggaaataacagtgctgccatttcacatctgcacaccactatcctcaatgaggttgacatctcagtggagcaggatggaaaagtcaaaaccctcatggaattcattacctcaagaaaaagagggcccctttggaaccatgaggatgtttctgccaagaatcctagcataaagagtgctgaacagttaactacatttttgaaacatgtggtttctgtttttaagcagtcaagctcagaaggaattcatctggaacatcatcttagtgaagttgctctgcaaacagcactttcctgttcttctcgacactatgctgggagatcctttcagattttcagggccctaaagcagcctctcactgcaactacactttctgatgttctctccagacttgtagaaactgtaggggatccaggagaagatgcacagggatttgtgattgagcttcttctcacattggaatctgcaattgatactttggctgaaaccatgaagcattatgatcttctttctgccctttctcaaacctcatatcatgatcctataatgggaaacaagtatgcagctaacaggaaaagcactggacaactcaatctaagcacaagtcccattaatagtagcagttatttgggatataacagtaatgcaagaagtaactctttgagattaagtttgattggtgaccgacgaggtgaccggcggcggagtaacacactggatataatggatggacggataaaccatagcagtagtttagcaaggactagaagcctttcctctctaagagagaaaggaatgtatgacgtgcagtccactactgagcctaccaacttgatggccaccattttttggatagcagcatctttattagaatcagattatgaatatgaatacctcctggctctcaggcttctcaacaaactgcttatccatttgcctttggataaatcagagagtcgagagaagattgaaaatgtacaaagcaaattgaaatggactaattttccaggacttcagcagctcttccttaagggttttacctcagcatctacacaagaaatgaccgtgcacctcctcagtaaactcatttctgtctccaaacatacattggtggatccttcccaattgtcaggctttcctcttaacatcctttgcttattgcctcacttaatccagcattttgacagcccaactcagttttgcaaagaaacagctagtcgaatagcaaaggtttgtgcagaagaaaaatgcccaacacttgtcaatctggcacacatgatgagtttgtacagtacacacacgtattccagagactgttctaactggatcaatgtcgtgtgcagatacctgcatgactccttctcagatacaacatttaatcttgtgacttatcttgcagagctgttagagaaaggattgtccagtatgcagcaatcattactacagattatttatagtctattgagtcatattgacctgtctgcagccccagccaagcagtttaatctggagatcataaagattattggcaaatatgtacagagtccttactggaaggaagcccttaacatattaaagctggtggtgtcacgctctgcgagtcttgtcgtacccagtgatatccccaagacctatggaggagatacaggttctcctgaaatatccttcactaaaatttttaataatgtttctaaggagttgcctgggaagaccttagattttcattttgatatatctgagacaccaattattggaaacaaatatggtgatcagcacagtgcggctggaagaaatgggaaaccaaaagttattgctgtcactagaagtacttcctcaacttcttctggttctaattctaatgccttggttcctgttagttggaaaaggccacagttatcacagcgaagaacaagagaaaagctaatgaatgtgctttctctctgtggtccagaatctggcctcccaaagaacccatcagttgtattttcttctaatgaggatttggaagtcggtgaccaacagactagcctaatttctacaacagaagacataaatcaagaggaagaagtagctgtggaagataatagcagtgaacaacagtttggtgtttttaaggattttgactttttagatgttgaattggaagatgcagagggtgaaagtatggacaatttcaactggggagttcgcaggcgctcactggacagtattgacaaaggggacactccatccctccaggagtaccagtgctctagtagcacccccagcctgaacctcaccaatcaggaggatacagatgagtcctcggaagaagaagcggcacttacagcaagccagatactctcacgcacacagatgttaaacagtgattctgccactgatgaaacaataccagaccatcctgacttacttctccagtctgaagattccactggcagcatcacaacagaggaagtgcttcaaatcagggatgagaccccaactttggaggcttctctagataatgctaacagccggctgcctgaggatacaacttcagtattaaaggaggaacatgttacaacctttgaagatgaaggatcctatataattcaagaacagcaggaatctcttgtgtgtcaaggaattcttgatttagaagaaactgaaatgccagagcctctagctcctgaaagttaccccgagtcagtctgtgaagaggatgttaccttagctctgaaagagctagatgaaagatgtgaagaagaagaagcggatttctccggactgtctagtcaagatgaagaagagcaagatggttttccagaagtacagacgtcgcctctgccgtcaccatttctttctgccatcatagccgcctttcagcccgtggcatatgatgatgaagaggaagcctggcgctgccacgtcaatcagatgctgtctgacaccgacgggtcctctgcagtgtttacttttcatgtgttttctaggctgtttcagacaattcaaagaaagtttggagaaataactaatgaggcagtcagctttcttggtgatagtctgcaacgcattggtaccaaatttaaaagttccttggaagtgatgatgctgtgttcagaatgcccaacagtctttgtggatgctgaaacactgatgtcatgtggtttgctggaaacactcaagtttggtgttttggagttgcaagaacacctggatacatacaatgtgaaaagagaagccgctgagcagtggctagatgattgtaagaggacatttggtgccaaagaagacatgtataggataaacacagatgcacaacaaatggaaatactagcagaattggagctctgccgaagattatacaaattgcattttcaattgctgcttctgttccaggcctactgtaaacttatcaaccaagtaaatacgataaaaaatgaagcagaggtcatcaacatgtcagaggaacttgcccaactggaaagtatcctcaaagaagctgagtccgcttccgaaaacgaagaaattgacatttccaaagctgcacaaactactatagaaactgccattcattctttaattgaaactttgaaaaataaagaatttatatcagctgtagcacaagtcaaagctttcagatctctctggcccagtgatatctttggcagttgtgaagatgaccctgtacagacactgttacatatatatttccatcatcagacgctgggccagacaggaagctttgcagttataggctctaacctggacatgtcagaagccaactacaaactgatggaacttaatctggaaataagagagtctctacgcatggtgcaatcataccaacttctagcacaggccaaaccaatgggaaatatggtgagcactggattctgagacacttcaggcctttaggaaagaaactaaactgaagatgatgaagaatattaaccaagcaccttttatggacccttgcattcactgataactttctggcagcatctactttttagtgtaactaatgtcaaactgtatcatcaaaaacaaagatctgaaagaaaaaaacatctgatattttaacagctgccaatatctcccacaataactgcgtgaagaaggaattttttaattacttaacctacgtgaaaagaaaagggctaaaagtgatgcctacaaatacattactttctggggaaagaaaagaattccaagaatgtttgcaataatggcctccaatactgaaacaaccaaaagcaggtgaaatgaggctgaaatcaaggctgtttcattttagctgaagacctgcaaagctgcttggatttctagcagttgaaaacctaacctgcaattgatgcttaatcatccatccacatgaacatgcagtcagctatacgcatcaagactcgtttgcaaaaaccattgatttttcagtatgtgggataagggtttgggtttttttgttttttggtctgtataaggaattatgtgtgtgtgagttgggatgtatggatatgtgatagtcatattttcaaggtatggatgtttggtgataacgtctcagagcatgcctaaaagagcactgcaagattatttttgaagaaatgttattttattagatctaactcttcatagtatgtaaatgttagaacattttaataatattttaaaactgggctttcccagtatttcaaaaagaaataatatatctgttaacgttattggaatgctgctcagttctctgatcagtgcttatgttatgattgttgataactaaccaaagtagatgcctgcagagactttaaaatgtaaaataaagatgtatgctgcctgtcagctattctcattagaaaagttttaacttattttactccatatagaaactgtagagactaaaaccagttattttcttgtacatttgtgccatgcactgttgttatacaagaataggtgtacaaagctaaagaaaaattgtggtcattgatgatggaatatatgacttgcaggctttgaagtctgcagaattcaagaaaagagctgcaaatgcatttttgtatctttattcaggactcacatgctttaccctaaagaaacctggggctaggggaaatgaaaggaagcctgaagactgactaccaaaacatgcaatatacttattcactgtctaagtctgtagtataacatgaactggagtctctatccttttctaaaatcgcattttgtaagaaaagaaagaaaaaaaaaaaaaaagaatgtagtcccacaactcctgatttgaaagaaacaccttgtattttttatatacatctcttatccactgtgacttttcttttaaactgggctctgtgattccagagtttagaatgtagaaatgaaatgcttagctttaccttttcttggggggtgtggaccctgccagaaatgtaattacgtatgctcaagtgcattaattgaaggcactgtgcacaccattggactgctgaccacagttaaacatttccagtaaaatttcgtaactggtcacagctcattcataatcactgtattttttgaccctgataaagacaattattttgatggtgttctggtactgtaattggtatcctttaaattatttaaaacttttgggtgtggggcaggcagagagggatggtgtccagagatacatcacactttacatcctatcttactgtcctctgtttttcttaccctccttacatcctttttgttaaaaataaaaagcattgtagctgttggtttgtgttgtattttaacaaagaatgaatgattacagtgtgcatcatttagaaacctttcaaatgttaccttcttgaattgccctagaaaagaacaaaattagttgactacccaaccaaacctttcagttgatatttgctttttgtgtttatttatatgtaactaagtctattaatataataaaaatgaatatacctgcagcaa

SEQ ID NO: 3904 - DNA, 7033 bp, Homo sapiens
ccagagaatccagacagctcaccctgctgggcggcaggtgatgctgcactacctgctaccatggatgaacaacatcgagctggtggacttaaaacctctccccacagcaaggcgacatgatgaagatgaagatgattccttaaaagaccgagaacttatggtgactagtaggcgctggttacggggagaaggatggggatctccacaagccactgcaatggttttgaacaatctgatgtatatgacagcaaagtatggcgatgaactggcctggtcggaggtggagaatgtgtggaccacacttgcagatggctggcccaaaaacctgaaaataattttgcactttttgatcagcatttgtggggtgaatagcgaaccaagcctcttgccttacgtgaagaaggtcattgtatatttaggtagagataaaacaatgcagttgctagaagagctggtgagtgagcttcagctgaccgatcctgtcagttcaggggtcactcacatggataatcccccgtattatcgcatcacttccagctataaaatcccttctgtcacctcaggaactacttccagtagcaatacaatggtagctcccacagatggcaatcctgataataagcccattaaagagaatattgaagagagctatgtgcacctggacatttacagtggactaaacagtcatttgaatcggcaacatcacagactagaatcccgatacagtagcagctctggaggatcttatgaagaagaaaaaagtgattcaatgccactttattctaattggcgactgaaagtgatggagcataaccaaggagagccactgcccttcccaccagctggaggctgctggtcaccactggtggattacgtgcctgaaacgtcatcacctggattacctcttcacaggtgtaacatagcagtgatccttttgactgatctcatcattgatcatagtgtgaaggtggaatggggaagctacctccatcttcttcttcatgcaatttttatagggtttgaccactgccaccctgaggtgtatgaacattgtaaacgcctgcttctgcacttattaatagtaatgggacccaatagtaacatccgaactgttgcttctgtccttctcaggaacaaggagtttaatgagcccagggtgcttacagtcaaacaagttgcacacttagattataatttcacagcaggcattaacgattttatacctgattaccagccctcccctatgactgactcagggcttagctcaagttctacctcttctagtatcagcttaggaaataacagtgctgccatttcacatctgcacaccactatcctcaatgaggttgacatctcagtggagcaggatggaaaagtcaaaaccctcatggaattcattacctcaagaaaaagagggcccctttggaaccatgaggatgtttctgccaagaatcctagcataaagagtgctgaacagttaactacatttttgaaacatgtggtttctgtttttaagcagtcaagctcagaaggaattcatctggaacatcatcttagtgaagttgctctgcaaacagcactttcctgttcttctcgacactatgctgggagatcctttcagattttcagggccctaaagcagcctctcactgcaactacactttctgatgttctctccagacttgtagaaactgtaggggatccaggagaagatgcacagggatttgtgattgagcttcttctcacattggaatctgcaattgatactttggctgaaaccatgaagcattatgatcttctttctgccctttctcaaacctcatatcatgatcctataatgggaaacaagtatgcagctaacaggaaaagcactggacaactcaatctaagcacaagtcccattaatagtagcagttatttgggatataacagtaatgcaagaagtaactctttgagattaagtttgattggtgaccgacgaggtgaccggcggcggagtaacacactggatataatggatggacggataaaccatagcagtagtttagcaaggactagaagcctttcctctctaagagagaaaggaatgtatgacgtgcagtccactactgagcctaccaacttgatggccaccattttttggatagcagcatctttattagaatcagattatgaatatgaatacctcctggctctcaggcttctcaacaaactgcttatccatttgcctttggataaatcagagagtcgagagaagattgaaaatgtacaaagcaaattgaaatggactaattttccaggacttcagcagctcttccttaagggttttacctcagcatctacacaagaaatgaccgtgcacctcctcagtaaactcatttctgtctccaaacatacattggtggatccttcccaattgtcaggctttcctcttaacatcctttgcttattgcctcacttaatccagcattttgacagcccaactcagttttgcaaagaaacagctagtcgaatagcaaaggtttgtgcagaagaaaaatgcccaacacttgtcaatctggcacacatgatgagtttgtacagtacacacacgtattccagagactgttctaactggatcaatgtcgtgtgcagatacctgcatgactccttctcagatacaacatttaatcttgtgacttatcttgcagagctgttagagaaaggattgtccagtatgcagcaatcattactacagattatttatagtctattgagtcatattgacctgtctgcagccccagccaagcagtttaatctggagatcataaagattattggcaaatatgtacagagtccttactggaaggaagcccttaacatattaaagctggtggtgtcacgctctgcgagtcttgtcgtacccagtgatatccccaagacctatggaggagatacaggttctcctgaaatatccttcactaaaatttttaataatgtttctaaggagttgcctgggaagaccttagattttcattttgatatatctgagacaccaattattggaaacaaatatggtgatcagcacagtgcggctggaagaaatgggaaaccaaaagttattgctgtcactagaagtacttcctcaacttcttctggttctaattctaatgccttggttcctgttagttggaaaaggccacagttatcacagcgaagaacaagagaaaagctaatgaatgtgctttctctctgtggtccagaatctggcctcccaaagaacccatcagttgtattttcttctaatgaggatttggaagtcggtgaccaacagactagcctaatttctacaacagaagacataaatcaagaggaagaagtagctgtggaagataatagcagtgaacaacagtttggtgtttttaaggattttgactttttagatgttgaattggaagatgcagagggtgaaagtatggacaatttcaactggggagttcgcaggcgctcactggacagtattgacaaaggggacactccatccctccaggagtaccagtgctctagtagcacccccagcctgaacctcaccaatcaggaggatacagatgagtcctcggaagaagaagcggcacttacagcaagccagatactctcacgcacacagatgttaaacagtgattctgccactgatgaaacaataccagaccatcctgacttacttctccagtctgaagattccactggcagcatcacaacagaggaagtgcttcaaatcagggatgagaccccaactttggaggcttctctagataatgctaacagccggctgcctgaggatacaacttcagtattaaaggaggaacatgttacaacctttgaagatgaaggatcctatataattcaagaacagcaggaatctcttgtgtgtcaaggaattcttgatttagaagaaactgaaatgccagagcctctagctcctgaaagttaccccgagtcagtctgtgaagaggatgttaccttagctctgaaagagctagatgaaagatgtgaagaagaagaagcggatttctccggactgtctagtcaagatgaagaagagcaagatggttttccagaagtacagacgtcgcctctgccgtcaccatttctttctgccatcatagccgcctttcagcccgtggcatatgatgatgaagaggaagcctggcgctgccacgtcaatcagatgctgtctgacaccgacgggtcctctgcagtgtttacttttcatgtgttttctaggctgtttcagacaattcaaagaaagtttggagaaataactaatgaggcagtcagctttcttggtgatagtctgcaacgcattggtaccaaatttaaaagttccttggaagtgatgatgctgtgttcagaatgcccaacagtctttgtggatgctgaaacactgatgtcatgtggtttgctggaaacactcaagtttggtgttttggagttgcaagaacacctggatacatacaatgtgaaaagagaagccgctgagcagtggctagatgattgtaagaggacatttggtgccaaagaagacatgtataggataaacacagatgcacaagaattggagctctgccgaagattatacaaattgcattttcaattgctgcttctgttccaggcctactgtaaacttatcaaccaagtaaatacgataaaaaatgaagcagaggtcatcaacatgtcagaggaacttgcccaactggaaagtatcctcaaagaagctgagtccgcttccgaaaacgaagaaattgacatttccaaagctgcacaaactactatagaaactgccattcattctttaattgaaactttgaaaaataaagaatttatatcagctgtagcacaagtcaaagctttcagatctctctggcccagtgatatctttggcagttgtgaagatgaccctgtacagacactgttacatatatatttccatcatcagacgctgggccagacaggaagctttgcagttataggctctaacctggacatgtcagaagccaactacaaactgatggaacttaatctggaaataagagagtctctacgcatggtgcaatcataccaacttctagcacaggccaaaccaatgggaaatatggtgagcactggattctgagacacttcaggcctttaggaaagaaactaaactgaagatgatgaagaatattaaccaagcaccttttatggacccttgcattcactgataactttctggcagcatctactttttagtgtaactaatgtcaaactgtatcatcaaaaacaaagatctgaaagaaaaaaacatctgatattttaacagctgccaatatctcccacaataactgcgtgaagaaggaattttttaattacttaacctacgtgaaaagaaaagggctaaaagtgatgcctacaaatacattactttctggggaaagaaaagaattccaagaatgtttgcaataatggcctccaatactgaaacaaccaaaagcaggtgaaatgaggctgaaatcaaggctgtttcattttagctgaagacctgcaaagctgcttggatttctagcagttgaaaacctaacctgcaattgatgcttaatcatccatccacatgaacatgcagtcagctatacgcatcaagactcgtttgcaaaaaccattgatttttcagtatgtgggataagggtttgggtttttttgttttttggtctgtataaggaattatgtgtgtgtgagttgggatgtatggatatgtgatagtcatattttcaaggtatggatgtttggtgataacgtctcagagcatgcctaaaagagcactgcaagattatttttgaagaaatgttattttattagatctaactcttcatagtatgtaaatgttagaacattttaataatattttaaaactgggctttcccagtatttcaaaaagaaataatatatctgttaacgttattggaatgctgctcagttctctgatcagtgcttatgttatgattgttgataactaaccaaagtagatgcctgcagagactttaaaatgtaaaataaagatgtatgctgcctgtcagctattctcattagaaaagttttaacttattttactccatatagaaactgtagagactaaaaccagttattttcttgtacatttgtgccatgcactgttgttatacaagaataggtgtacaaagctaaagaaaaattgtggtcattgatgatggaatatatgacttgcaggctttgaagtctgcagaattcaagaaaagagctgcaaatgcatttttgtatctttattcaggactcacatgctttaccctaaagaaacctggggctaggggaaatgaaaggaagcctgaagactgactaccaaaacatgcaatatacttattcactgtctaagtctgtagtataacatgaactggagtctctatccttttctaaaatcgcattttgtaagaaaagaaagaaaaaaaaaaaaaaagaatgtagtcccacaactcctgatttgaaagaaacaccttgtattttttatatacatctcttatccactgtgacttttcttttaaactgggctctgtgattccagagtttagaatgtagaaatgaaatgcttagctttaccttttcttggggggtgtggaccctgccagaaatgtaattacgtatgctcaagtgcattaattgaaggcactgtgcacaccattggactgctgaccacagttaaacatttccagtaaaatttcgtaactggtcacagctcattcataatcactgtattttttgaccctgataaagacaattattttgatggtgttctggtactgtaattggtatcctttaaattatttaaaacttttgggtgtggggcaggcagagagggatggtgtccagagatacatcacactttacatcctatcttactgtcctctgtttttcttaccctccttacatcctttttgttaaaaataaaaagcattgtagctgttggtttgtgttgtattttaacaaagaa

SEQ ID NO: 3905 - DNA, 11706 bp, Homo sapiens
gaagacctcgcagcacagccgggcgcccgtcgggctctgggagagagcgagagagaaatccggttaaaatcagagtcggagggaggtttaaccacagatcggttccgatcggattattccttaaaggggacgcgccattgtcaagagaacggagccaggggcccgagggcggggaccggcggcgctggaggagcgaggcagctgtactaggactgggaacggcctagaacattccatattctgcttcacacacggtgactcactcactactgctttgtaccagtgtgcccactcgagtgcctgtaaagtacaagctccagatcaaaaaagcttctagatggatcctttccaaacttggtgtcttttctacaaactctgtgcctcaacaaccatttctaagtgagctgaagccatttattggtatcttggatggttaacatctaaatgcttaattcctgaaaccactcaagagtcataggattagatgatccaagtcaccaagaaattactgtctcaagtgatacgcttcagcgccagtcagcaaagtaaataaatactgtgcttcttccaactttcattccacttggggaaaaaaaaatatcatcatgtcaaacattacgattgacccagatgtcaaacctggtgaatatgtcatcaagagcctctttgcagaatttgctgttcaagctgaaaagaaaattgaagttgtaatggccgaacccttggagaagctattgtccagatctcttcagaggggtgaagatcttcagtttgatcagttgataagctctatgagctcagtagcagagcactgtctcccttccttacttcgcaccttgtttgactggtacagacgccaaaatggaacggaagatgaatcttatgaatataggcctcggtctagcacaaagtctaagggggatgaacagcaacgtgaaagagattatcttcttgaaaggagggacttagcagtagacttcattttttgtttagttttagttgaagttctaaagcagattcctgttcatcctgtacccgatcccttagttcatgaagttctaaacttagcttttaagcactttaaacataaggaaggatattcaggaaccaacactgggaatgtgcatattattgctgatttatatgcagaggtgataggggttcttgcccaatcaaagtttcaggctgtaaggaagaagtttgtgacagaattaaaagaactgcgacaaaaggaacaaagcccacatgtggtacaaagtgtcatcagcttaataatgggaatgaaattttttcgagtaaaaatgtatcctgtagaagattttgaagcatcatttcaatttatgcaggaatgtgctcagtatttcttagaagtgaaagataaagatataaaacatgcacttgctggtttatttgtggagattcttatccctgtagctgctgctgttaaaaatgaagtgaatgttccctgtttgaaaaattttgtggagatgctttatcagactacttttgaactgagctcgagaaagaagcattcattggctttatatccactaattacctgccttttatgtgtcagtcagaaacaattttttttaaataactggcatattttcctacagaactgtttgtcacatttaaagaataaagatccgaaaatgtctcgagttgcactggaatctttgtatagattattgtgggtttatgtaattagaataaaatgtgaaagcaacactgtaactcaaagtcgtcttatgagcatagtgtcagcactttttccaaaaggctcacgaagtgtggttcctcgtgacacacctctcaatatatttgtgaagattattcagttcattgctcaggaacgcttggattttgcaatgaaagaaataatatttgatcttctcagtgttggaaaatctactaaaactttcaccattaatccagagagaatgaacataggtctcagagtcttccttgtaatagcagacagtttgcagcagaaagatggtgaaccacccatgccaacaacaggagttattcttccctcaggaaatactcttcgtgtaaagaaaatatttctcaataaaaccttgacagatgaagaagcaaaagtcataggaatgtcagtttactatcctcaagtaagaaaagcattagatagcatcctcagacatttggacaaagaagttgggagaccaatgtgtatgaccagtgtgcagatgtctaataaggagcctgaagacatgattacgggggaaagaaaacccaagattgatttgtttagaacttgtattgctgcgattccaaggttgattcctgacggtatgagcagaactgacctgattgaattgttagcaaggctcacaattcatatggatgaagaactgcgtgctctggctttcaatactctgcaggcactaatgcttgattttccagattggcgggaggatgttctttcaggatttgtttattttattgttcgtgaagtgactgatgtccatcccacacttcttgataatgccgtaaagatgttggtacaattaataaatcagtggaaacaagcagcccaaatgcataataaaaaccaggacactcagcatggtgtagctaatggagcttctcatccccctcctctggaaaggagcccatattccaatgtattccatgtggttgaaggctttgcgcttgtcattctctgtagcagtcgacctgccactaggagactagccgtcagtgtccttagagaaatacgggctttatttgcacttctggaaatacctaagggtgatgatgaattagccatagatgtgatggacaggctaagcccatccattcttgagagcttcatacatctcactggggctgatcagactactttgctctattgccctagctcgatagatttacaaactttagcagaatggaactcttctcctattagccaccagtttgatgtgattagtccatcacatatatggatatttgcacatgtgacccaaggccaagacccatggattataagtctctccagttttttaaagcaagaaaatcttcctaaacactgctctacagctgtgagctatgcttggatgtttgcatacacaagacttcagttgttgtcccctcaggtcgatataaatagccccatcaatgctaagaaagtaaataccaccacaagcagtgactcatacattggcctgtggagaaactatctgatcctttgctgcagtgcagcaacatcgtcatcttccacatctgcaggttctgtgagatgttctcctcctgagacgctggcgtctaccccagatagcggctatagcattgattctaaaattattggcatcccatccccttcatccttgtttaagcacatagttccaatgatgcgttctgagagcatggaaatcacagaatcccttgttctaggtcttggcaggaccaacccaggagcttttagggaactaatagaggaattacatcccataattaaagaagcactcgaaagaaggccagagaatatgaaacggcgcaggcgtcgagacattttacgagtacaactggtacgaatatttgaactgctggcagatgctggtgtcattagtcacagtgcaagtggtggccttgataatgaaacacattttctcaacaacactttattggaatatgtagatttaactagacaactcctggaagcagaaaatgaaaaagactctgacacactgaaggatatacgatgccattttagtgccttagtggcgaatattattcagaatgttccagtgcaccagagaagaagtatttttcctcaacagagccttcgtcacagtctatttatgctgttcagtcactgggcaggtccttttagcatcatgtttacgcccttggacagatacagtgatagaaatatgcaaattaatagacatcaatactgtgcgttaaaggctatgtctgctgtactgtgttgtggccctgttgcagataatgtaggactttcatcagatggctatttgtacaaatggttggataacattttggattctctggacaaaaaggttcaccagctgggctgtgaagcagttacgttgttactggagctgaaccctgatcagagcaacctgatgtactgggctgtggaccgctgctacacgggctccgggagggtggcggccggctgctttaaagccattgctaatgttttccagaacagggattatcaatgtgacacagtgatgcttctaaatctgatactgtttaaagcagctgattcttctagaagtatctatgaagttgctatgcaacttttacagattctggaaccgaagatgtttcgctatgctcacaaattggaggttcagagaacagatggagtactcagccagctgtctcctctaccacatctctattctgtttcatattatcagttgtccgaggaactagcaagggcgtatcctgagctaactctcgccatattctcagagataagccagagaatccagacagctcaccctgctgggcggcaggtgatgctgcactacctgctaccatggatgaacaacatcgagctggtggacttaaaacctctccccacagcaaggcgacatgatgaagatgaagatgattccttaaaagaccgagaacttatggtgactagtaggcgctggttacggggagaaggatggggatctccacaagccactgcaatggttttgaacaatctgatgtatatgacagcaaagtatggcgatgaactggcctggtcggaggtggagaatgtgtggaccacacttgcagatggctggcccaaaaacctgaaaataattttgcactttttgatcagcatttgtggggtgaatagcgaaccaagcctcttgccttacgtgaagaaggtcattgtatatttaggtagagataaaacaatgcagttgctagaagagctggtgagtgagcttcagctgaccgatcctgtcagttcaggggtcactcacatggataatcccccgtattatcgcatcacttccagctataaaatcccttctgtcacctcaggaactacttccagtagcaatacaatggtagctcccacagatggcaatcctgataataagcccattaaagagaatattgaagagagctatgtgcacctggacatttacagtggactaaacagtcatttgaatcggcaacatcacagactagaatcccgatacagtagcagctctggaggatcttatgaagaagaaaaaagtgattcaatgccactttattctaattggcgactgaaagtgatggagcataaccaaggagagccactgcccttcccaccagctggaggctgctggtcaccactggtggattacgtgcctgaaacgtcatcacctggattacctcttcacaggtgtaacatagcagtgatccttttgactgatctcatcattgatcatagtgtgaaggtggaatggggaagctacctccatcttcttcttcatgcaatttttatagggtttgaccactgccaccctgaggtgtatgaacattgtaaacgcctgcttctgcacttattaatagtaatgggacccaatagtaacatccgaactgttgcttctgtccttctcaggaacaaggagtttaatgagcccagggtgcttacagtcaaacaagttgcacacttagattataatttcacagcaggcattaacgattttatacctgattaccagccctcccctatgactgactcagggcttagctcaagttctacctcttctagtatcagcttaggaaataacagtgctgccatttcacatctgcacaccactatcctcaatgaggttgacatctcagtggagcaggatggaaaagtcaaaaccctcatggaattcattacctcaagaaaaagagggcccctttggaaccatgaggatgtttctgccaagaatcctagcataaagagtgctgaacagttaactacatttttgaaacatgtggtttctgtttttaagcagtcaagctcagaaggaattcatctggaacatcatcttagtgaagttgctctgcaaacagcactttcctgttcttctcgacactatgctgggagatcctttcagattttcagggccctaaagcagcctctcactgcaactacactttctgatgttctctccagacttgtagaaactgtaggggatccaggagaagatgcacagggatttgtgattgagcttcttctcacattggaatctgcaattgatactttggctgaaaccatgaagcattatgatcttctttctgccctttctcaaacctcatatcatgatcctataatgggaaacaagtatgcagctaacaggaaaagcactggacaactcaatctaagcacaagtcccattaatagtagcagttatttgggatataacagtaatgcaagaagtaactctttgagattaagtttgattggtgaccgacgaggtgaccggcggcggagtaacacactggatataatggatggacggataaaccatagcagtagtttagcaaggactagaagcctttcctctctaagagagaaaggaatgtatgacgtgcagtccactactgagcctaccaacttgatggccaccattttttggatagcagcatctttattagaatcagattatgaatatgaatacctcctggctctcaggcttctcaacaaactgcttatccatttgcctttggataaatcagagagtcgagagaagattgaaaatgtacaaagcaaattgaaatggactaattttccaggacttcagcagctcttccttaagggttttacctcagcatctacacaagaaatgaccgtgcacctcctcagtaaactcatttctgtctccaaacatacattggtggatccttcccaattgtcaggctttcctcttaacatcctttgcttattgcctcacttaatccagcattttgacagcccaactcagttttgcaaagaaacagctagtcgaatagcaaaggtttgtgcagaagaaaaatgcccaacacttgtcaatctggcacacatgatgagtttgtacagtacacacacgtattccagagactgttctaactggatcaatgtcgtgtgcagatacctgcatgactccttctcagatacaacatttaatcttgtgacttatcttgcagagctgttagagaaaggattgtccagtatgcagcaatcattactacagattatttatagtctattgagtcatattgacctgtctgcagccccagccaagcagtttaatctggagatcataaagattattggcaaatatgtacagagtccttactggaaggaagcccttaacatattaaagctggtggtgtcacgctctgcgagtcttgtcgtacccagtgatatccccaagacctatggaggagatacaggttctcctgaaatatccttcactaaaatttttaataatgtttctaaggagttgcctgggaagaccttagattttcattttgatatatctgagacaccaattattggaaacaaatatggtgatcagcacagtgcggctggaagaaatgggaaaccaaaagttattgctgtcactagaagtacttcctcaacttcttctggttctaattctaatgccttggttcctgttagttggaaaaggccacagttatcacagcgaagaacaagagaaaagctaatgaatgtgctttctctctgtggtccagaatctggcctcccaaagaacccatcagttgtattttcttctaatgaggatttggaagtcggtgaccaacagactagcctaatttctacaacagaagacataaatcaagaggaagaagtagctgtggaagataatagcagtgaacaacagtttggtgtttttaaggattttgactttttagatgttgaattggaagatgcagagggtgaaagtatggacaatttcaactggggagttcgcaggcgctcactggacagtattgacaaaggggacactccatccctccaggagtaccagtgctctagtagcacccccagcctgaacctcaccaatcaggaggatacagatgagtcctcggaagaagaagcggcacttacagcaagccagatactctcacgcacacagatgttaaacagtgattctgccactgatgaaacaataccagaccatcctgacttacttctccagtctgaagattccactggcagcatcacaacagaggaagtgcttcaaatcagggatgagaccccaactttggaggcttctctagataatgctaacagccggctgcctgaggatacaacttcagtattaaaggaggaacatgttacaacctttgaagatgaaggatcctatataattcaagaacagcaggaatctcttgtgtgtcaaggaattcttgatttagaagaaactgaaatgccagagcctctagctcctgaaagttaccccgagtcagtctgtgaagaggatgttaccttagctctgaaagagctagatgaaagatgtgaagaagaagaagcggatttctccggactgtctagtcaagatgaagaagagcaagatggttttccagaagtacagacgtcgcctctgccgtcaccatttctttctgccatcatagccgcctttcagcccgtggcatatgatgatgaagaggaagcctggcgctgccacgtcaatcagatgctgtctgacaccgacgggtcctctgcagtgtttacttttcatgtgttttctaggctgtttcagacaattcaaagaaagtttggagaaataactaatgaggcagtcagctttcttggtgatagtctgcaacgcattggtaccaaatttaaaagttccttggaagtgatgatgctgtgttcagaatgcccaacagtctttgtggatgctgaaacactgatgtcatgtggtttgctggaaacactcaagtttggtgttttggagttgcaagaacacctggatacatacaatgtgaaaagagaagccgctgagcagtggctagatgattgtaagaggacatttggtgccaaagaagacatgtataggataaacacagatgcacaactcaatgaaatactggttgaattggagctctgccgaagattatacaaattgcattttcaattgctgcttctgttccaggcctactgtaaacttatcaaccaagtaaatacgataaaaaatgaagcagaggtcatcaacatgtcagaggaacttgcccaactggaaagtatcctcaaagaagctgagtccgcttccgaaaacgaagaaattgacatttccaaagctgcacaaactactatagaaactgccattcattctttaattgaaactttgaaaaataaagaatttatatcagctgtagcacaagtcaaagctttcagatctctctggcccagtgatatctttggcagttgtgaagatgaccctgtacagacactgttacatatatatttccatcatcagacgctgggccagacaggaagctttgcagttataggctctaacctggacatgtcagaagccaactacaaactgatggaacttaatctggaaataagagagtctctacgcatggtgcaatcataccaacttctagcacaggccaaaccaatgggaaatatggtgagcactggattctgagacacttcaggcctttaggaaagaaactaaactgaagatgatgaagaatattaaccaagcaccttttatggacccttgcattcactgataactttctggcagcatctactttttagtgtaactaatgtcaaactgtatcatcaaaaacaaagatctgaaagaaaaaaacatctgatattttaacagctgccaatatctcccacaataactgcgtgaagaaggaattttttaattacttaacctacgtgaaaagaaaagggctaaaagtgatgcctacaaatacattactttctggggaaagaaaagaattccaagaatgtttgcaataatggcctccaatactgaaacaaccaaaagcaggtgaaatgaggctgaaatcaaggctgtttcattttagctgaagacctgcaaagctgcttggatttctagcagttgaaaacctaacctgcaattgatgcttaatcatccatccacatgaacatgcagtcagctatacgcatcaagactcgtttgcaaaaaccattgatttttcagtatgtgggataagggtttgggtttttttgttttttggtctgtataaggaattatgtgtgtgtgagttgggatgtatggatatgtgatagtcatattttcaaggtatggatgtttggtgataacgtctcagagcatgcctaaaagagcactgcaagattatttttgaagaaatgttattttattagatctaactcttcatagtatgtaaatgttagaacattttaataatattttaaaactgggctttcccagtatttcaaaaagaaataatatatctgttaacgttattggaatgctgctcagttctctgatcagtgcttatgttatgattgttgataactaaccaaagtagatgcctgcagagactttaaaatgtaaaataaagatgtatgctgcctgtcagctattctcattagaaaagttttaacttattttactccatatagaaactgtagagactaaaaccagttattttcttgtacatttgtgccatgcactgttgttatacaagaataggtgtacaaagctaaagaaaaattgtggtcattgatgatggaatatatgacttgcaggctttgaagtctgcagaattcaagaaaagagctgcaaatgcatttttgtatctttattcaggactcacatgctttaccctaaagaaacctggggctaggggaaatgaaaggaagcctgaagactgactaccaaaacatgcaatatacttattcactgtctaagtctgtagtataacatgaactggagtctctatccttttctaaaatcgcattttgtaagaaaagaaagaaaaaaaaaaaaaaagaatgtagtcccacaactcctgatttgaaagaaacaccttgtattttttatatacatctcttatccactgtgacttttcttttaaactgggctctgtgattccagagtttagaatgtagaaatgaaatgcttagctttaccttttcttggggggtgtggaccctgccagaaatgtaattacgtatgctcaagtgcattaattgaaggcactgtgcacaccattggactgctgaccacagttaaacatttccagtaaaatttcgtaactggtcacagctcattcataatcactgtattttttgaccctgataaagacaattattttgatggtgttctggtactgtaattggtatcctttaaattatttaaaacttttgggtgtggggcaggcagagagggatggtgtccagagatacatcacactttacatcctatcttactgtcctctgtttttcttaccctccttacatcctttttgttaaaaataaaaagcattgtagctgttggtttgtgttgtattttaacaaagaatgaatgattacagtgtgcatcatttagaaacctttcaaatgttaccttcttgaattgccctagaaaagaacaaaattagttgactacccaaccaaacctttcagttgatatttgctttttgtgtttatttatatgtaactaagtctattaatataataaaaatgaatatacctgcagc

SEQ ID NO: 3906 - DNA, 1029 bp, Homo sapiens
gaaacctggaagtggaaatctcgggcattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgaggtgaagagctggaagaaaaagagcaaagataagaagagaaaaagagaagatgaagaaacccagcttgatacgttggaatctggtgaacagtaacaaactttggtgaaatttcaggaaccatagccattgaaatggatgagggaacctatatacatgcactcgacaatggtctttttaccctgggagctccacacaaagaagggccctagtcctccagagcagtttatggctgtcaaattatctgattccagaatcgccctgaaatctggctatggaaaatatcttggtataaattcagatgaacttgttgggcattcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagattagatcctgtgctgaaaaagaaaccaagaaaaaagatgacattccagaagaagacaaaggaaatgtaaaacaatgtgaaatcaattatgtaaagaaatttcagagcttccaagaccacaaacttaaaataagtaaagaagagagtaaaattcttaaaaaggctcagaaagatggatttttgcatgagacgcttctggacagagaaccaaattgaaagccgacagatactgcaaatgactggaatttttgtttctgccttatctttttgtgttttttttttctgaataaaatattcagaggaaatgcttttacag

SEQ ID NO: 3907 - DNA, 995 bp, Homo sapiens
gggcattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgagtaagaagaaaaagagcaaagataagaagagaaaaagagaagatgaagaaacccagcttgatacgttggaatctggtgaacagtaacaaactttggtgaaatttcaggaaccatagccattgaaatggatgagggaacctatatacatgcactcgacaatggtctttttaccctgggagctccacacaaagaagggccctagtcctccagagcagtttatggctgtcaaattatctgattccagaatcgccctgaaatctggctatggaaaatatcttggtataaattcagatgaacttgttgggcattcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagattagatcctgtgctgaaaaagaaaccaagaaaaaagatgacattccagaagaagacaaaggaaatgtaaaacaatgtgaaatcaattatgtaaagaaatttcagagcttccaagaccacaaacttaaaataagtaaagaagagagtaaaattcttaaaaaggctcagaaagatggatttttgcatgagacgcttctggacagagaaccaaattgaaagccgacagatactgcaaatgactggaatttttgtttctgccttatctttttgtgttttttttttctgaataaaatattcagaggaaatgctttt

SEQ ID NO: 3908 - DNA, 712 bp, Homo sapiens
gggcattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgagtaagaagaaaaagagcaaagataagaagagaaaaagagaagatgaagaaacccagcttgatacgttggaatctggtgaacagtaacaaactttggtgaaatttcaggaaccatagccattgaaatggatgagggaacctatatacatgcactcgacaatggtctttttaccctgggagctccacacaaagaagatattgatgagggccctagtcctccagagcagtttatggctgtcaaattatctgattccagaatcgccctgaaatctggctatggaaaatatcttggtataaattcagatgaacttgttgggcattcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagatgttaagtcatcattta

SEQ ID NO: 3909 - DNA, 2084 bp, Homo sapiens
cacactctgcctttggacgtgagagagagcgcacctttcacttgagcttcaacatgggaaagggaaatgaagactccgatctccactgctcctccatccagtgctccactgaccagccccctttccaacagatctcctttacagaaaagggctcagatgagaagaaaccattcaaagaaaaaggcaagaccgccttctcccattccagtgagaagcacatacaaaggcaaggatcggagcccaatccaaacaaggagaattctgaggaaaccaagctcaaggccgggaacagcactgctggatcagaaccagagtccagctcatatcgggaaaactgcaggaaaagaaaaatgagttccaaggacagctgccaagacacagcagggaactgtccagaaaaggagtgcagcttgtcattgaataaaaaatcaagatcctccactgctgtgcacaacagtgaaatccaggagacctgtgatgcccaccataggggacattccagggcttgcactgggcacagcaagcggcataggtctcgggccctaggagtccaaacaccgtcaattcgaaaaagcttggtgacttctgtgcgagctatgtcagaggctgtttatcaagacctagcccaggtgtgggcacagcagatccattctccacttacctgtgagcagctgacactgctcactcggctccgggggcctctgtgtgcccaggtgcagaccttgtattccatggccacccaggcagcttatgtcttccctgctgagagctggcttgtcccagccacactgccaggtcctggggaatcagccctggatagagaagcccatcccttccctgggcaggagataactgagactgtcagtggatcagatgaggctaagctgtgagcaccctgaccctattcagcagagatgcagctctgggaatgagaacaaggatctgcttcttctcagattcttccagatgaccagcagtgacaattttagacacactgtgttaataaatgacagaacctgaagaagtcataggaaagaaacttgagcggtatactcagaatggtgagagccctgaattttgcagaccgctaagactatagacaaattttatatttcatgttagacatttgatgccttttggatgtctgatgacagtcatgcatttctatataatcagaaaaacattagaatgtaatcgtgaatttgcatattttagattgtagaaaagtaaatataaaattatgtgctccttttttgtttttttttttttttgagacagtcttgctatgttacccaggctggagtgcagtggcacaatcttagctcactgcaacctctgcttcctgggttcaaacaattctcatgcctcagcctcccaagcagctgggactacaggcatgtactgctatgcctggctaattttttttttcctgtattgttagtagagacagagttttgtcactttggccaggttggcctcgaactcaggtgatctgccagcctccgcctcccaacgtgctgggattacaggcatgagccgccttaccaagaaattgcttctcttttaatccagaaaaggttgtaggctctcactcttccagcctgaacccatggagtactaatatccacaaaccattaatagcactccctgtgggaaaatgtctatatatttttagtttgatataattatagtaaaattactatgcaagctgtttacttttaatatttctacataaaatttaagtcaagatatagtaaatggtaaatgattgtacttatttattgacctgcctcatgtttcatttcattttaaacatcctaaatttatattttattatattttatacatttcaattgattgtactatattgcaggatatggagatttcatcacgtactacaatacagtgtattttgttatatttgacgtatattctacttgtattttgtactgagatcatacactatttcattatctaagtgtattaattgtttggttgctttataattttcattttatgtaatgaaataaacaatgttgtttggaattttaaatttctttcatatggaatttgtatttaataaa

SEQ ID NO: 3910 - DNA, 2078 bp, Homo sapiens
actctgcctttggacatgtgagagagcgcacctttcacttgagcttcaacatgggaaagggaaatgaagaccccgatctccactgttcctccatccagtgctccactgaccagccccctttccaacagatctcctttacagaaaagggctcagatgagaagaaaccattcaaaggaaaaggcaagaccgccttctcccattccagtgagaagcacacacaaaggcaagcaggatcagatcccaatccaaacaaggagaattctgaggaaaccaagctcaaggccgggaacagcactgctggatcagaaccagagtccagctcatatcaggaaaactgcaggaaaagaaaaatcagttccaaggatatctgccaagacagagcagggaactgtccagaagaggagtgcaacttgacgttgaataaaaaatcaagatcctccactgctgtgcacaacagtgaaatccaggagacctgtgatgcccaccataggggaagttccagggcttgcactgggcgcagcaagcggcataggtctcgggccctagaagtccaaacaccgtcacttcgaaaaagcttggtgacctctgtgcgagctatgtcggaggctgtttatcaagacctagcccaggtgtgggcacagcagatccattctccactgacctgtgagcagctgacactgctcactcggctccgggggcctctgtgtgcccaggtgcagaccttgtattccatggccactcaggcagcttatgtcttccctgctgagagctggcttgtcccagccacactgcctggtcctggggattcagccctggatagagaagcccatcccttccctgggcaggagataactgagcctgtcagtggatcagatgaggctaagctgggagcaccctgaccctattcagcagagatgcagctctgggaatgagaacaaggacctgcttcttctcagattcttccagacgaccagcagtgacaattttagatgcactgtgttaataaatgacagaacctgaagaagtcataggaaagaaacttgagcggtatactcagaatggtgagccctgaattttgcagaccgctaaggctatagacaaattttatatttcatgttagacatttgataccttttggatgtctgatgacagtcgtgcatttctatataatcagaaaaatattaggttgcaatcgtgaattttcatattttagattgtagaaaagtaaatataaaattatatgctctttttttttttgagacagtcttgctatgtcactcaggctggagtgcagtggcacaatcttagctcactgcaacctctgcttcctgggttcaaacaattctcatgcctcagcctcccaagtagctgggactacaggcatgtaccgccatgcctggctaatgtttttttcttgtattgttagtagagttttgtcacgttggccaggttggcctcggactcaagtgatccaccagcctccacctcccgacgtggtggggttacaggcatgagccgctttaccaagaaattgcttctcttttaattcggaaaaggttgtaggctcttccagcctgaacccatggagtactaacatccacaaaccattaatagcactccctgtgggaaaatgtttatacatttttacagtttgcatagtaaaattactatgcaagctgtttacttttaatatttctacataaaatttaagtcaagatatattaaatggtaaatgattgtacttatttattcatctgcctcatgttttatttcattttaaacatcctgaatttatattttattgtatttcatacatttcaattgattgtactgtattgcaggatatggagatttcatcacatactacaatacagtgtattttgttatatttgacgtatattctacttgtattttgtactgagatcatacaatctttcattatctaagtgtattaatgacttgtttggttgctttataattttcattttatgtaataatgaaataaacattaatgttgtttggaattttaaatttctttcatatggaatttgtatttaataaagatgtgaaaaagagaa

SEQ ID NO: 3911 - DNA, 1678 bp, Homo sapiens
gatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctcaattttgtttcaatttaatatatagtaataattgtaattcaatgtaattggcttccattgt

SEQ ID NO: 3912 - DNA, 1986 bp, Homo sapiens
ggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaagaaggggaccagtagacggggtggattcgaggtggggacatgggacgcagcggtcggagccgcctggaggggtacccggtggtcccgatggagctatcatctttgagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggcgtgacacgggcagttgacctgtgtgcagccccaggcagctggagccaggtgctgagccagaagatcgggggccaagggtccggccacgtggtggctgtggacctgcaggctatggctccactaccaggtgtggtacagatccagggggacatcacccagctgtccactgccaaggagatcatccagcactttaagggctgccctgcggacctagtggtgtgtgacggggctcctgatgtaaccggtctccatgatgttgatgagtatatgcaggcccagctcctcctagctgctctgaacattgctacacatgtcctgaagccagggggctgctttgtggccaagatattccgaggccgggatgtgacgctcctctacagccagctgcaggtcttcttctccagcgtgctgtgtgccaagcccaggagcagccggaactctagcatcgaggccttcgctgtctgtcagggctatgaccctcccgagggcttcatcccggacctgagcaaacccctgctggaccattcttacgatttcaaccagctggatggtcccacccgcatcattgtgccttttgtgacctgtggggacctgagctcctatgattcggaccgcagttacccactggacctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgagatggaagacaatgaaatgagttgttcaccttaacccattacgctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgca

SEQ ID NO: 3913 - DNA, 411 bp, Homo sapiens
ctccttggggaaagggcaatcccccgagccggttcccaggccgggtggagaccaactctggggtctgttggtgggagagtggggagcccgtcttctgctgagtgctgccgccccttcccaggacagcggaggtggaacttcgtcgcgctgcaacccccggctcggagatgggatctcactatgttacccagattggtcttgaactcctgggcgcaagccatcctcccacctcagcctcccaaagtgctgggattacaggatcctggggcgtcctttggcagtcgattgcaccctgcactagagagaagtccaggaatgatatattcttgggctgtatttctctaccctggagttcatccagttcatcccagaaacactgacctgattactgtgacaaagtctgatggatag

SEQ ID NO: 3914 - DNA, 1690 bp, Homo sapiens
gagcaggaaggctcggaccggcggctgactcctggaagtctgctgacagaggctcaacacggctcggacgcccttgccccggttcctaagccccaaggcgggcaagtgccggctgatcacctccacctcacagtgtagcttcatctcgcccaacggccacaaccacgtcaagctggctttgaaacttcctccttcccgccacccggcgccgccatcggggtcctcgcgcacgcgggctgcccactgatctgcctgcctgttggactggtccgcgactcgggctgtcttagcaccgtgtctgtatgaagcccgcgggaaacggcttcccttctcccttagcagggccgggttctcgccgtggttgcgtaccgggactgaccacctggatccgggctcgcgcccgggaaaccggcagtcggcgggggcgcaacgtcttttcccccgagcgcgcagctggcagcggtggttgtttctgttcggggaggattccgagggtttcagctgttgacgctttacgcgttgcgggcgcacgtcgggccgctgtttcccgagggaaggcaggtgtgcctctgcgttacagggaaaggcacttagaactgtctgagtggccccgtaagccagcgagggcgcatttcccggcgcggacgggctgctggtggttttggtggctgctctccggaggcacacctggcacgtcgaaggggggctttatatggctgtatttgacttggcaattcctgctgaacaaataatttttcatggcgggtaggtggatggagtgtgactggcttaactgcacctgagacgtggaaagaccgtccagaccgcacaaggccttcgtactcttgattttcttgattgattgaactaggacggggcccggctggggagtgggaagcgcctggggagcaaatgttaagcaggcgctcacggtcggggtcgtggtcttgcctccttaaaatttgtgctctaggcgcctctctcaccttaacctaatcctagccgtatattaaacattttattgtgtctgagttatacttccgtaatggtaaaatgacgttcagaaataccgatttttcaatacaactgtgacaaaatgtgatttattctcaaatgagcgtccctatttacatgttgaacctgaagtgttgtcagttaattcctcattctttgaaacgtaatagttcctggaaaaaagtgattaagataaaattatggccgggcgcggtggctcacgcctgtaatcccagcactttgcggggctgaggcaggcaggtcgcttgagcccaggagttcaagaccagtttgggcaacatggcaaaacccagtctctaagaaaaatacaaaaaaattagccgggcgtggtggcgcgtgtctgtagtcccagctattggggaggctgaggtggcaggatcacttgagcctggggaggtcgagaggctccggtgagctgtaatcgcgcactggcactccagcctgagtgaccccgtctcaaaaaaaaaaaagaaattactttccctccatttagtattcttatatgtacatctagtagagcattaaaacgcgactcagcatttaagcaaaactttatggctaaagagaaaacggacactacaattttcagactattagactttataggagttacctgcttttgttctttgagagggtaataatgtagaaaagataa

SEQ ID NO: 3915 - DNA, 1964 bp, Homo sapiens
cacgggccgggagacgggcctgggagcggcggcggcggcccgagagctgcgccgggagagctgtgccgcgagcctccgcctcttttttggcaccgcacagtggatccctggaggccgagcgccacgccgcccgggtacccggcagatcgcgaggtggaacgggccgtcgctgcgggggacagcgttccgaggcagttggtcctctccgggatgccgtaggcatcagctgaccggcccagcccacgtgactacaggggcacttgatgggaatcatggcagcatccaggccattgtcccgcttctgggagtggggaaagaacatcgtctgcgtggggaggaactacgcggaccacgtcagggagatgcgcagcgcggtgttgagcgagcccgtgctgttcctgaagccgtccacggcctacgcgcccgagggctcgcccatcctcatgcccgcgtacactcgcaacctgcaccacgagctggagctgggcgtggtgatgggcaagcgctgccgcgcagtccccgaggctgcggccatggactacgtgggcggctatgccctgtgcctggatatgaccgcccgggacgtgcaggacgagtgcaagaagaaggggctgccctggactctggcgaagagcttcacggcgtcctgcccggtcagcgcgttcgtgcccaaggagaagatccctgaccctcacaagctgaagctctggctcaaggtcaacggcgaactcagacaggagggtgagacatcctccatgattttttccatcccctacatcatcagctatgtttctaagatcataaccttggaagaaggagatattatcttgactgggacgccaaagggagttggaccggttaaagaaaacgatgagatcgaggctggcatacacgggctgagacagggtctcactctgtcgcccaagctggagtgcagcagtgctatcacagctcactgcagcctcgaactcccggggtcaagcaatcctccctcagcttcccgtttctgaggttacagcccaaagtctcctcagcaacacttcctgtgagactacaggaatgaagggtgcctgtgtgatcagtcagatcaatcagcacatggaaactgagaaagacagatttaaagtccaaggagtttttgttgcaagttgtgcacatgttagatgcttcatttacaatataaccacagctggaactgaaaagaaacaaagacaatgataaaatgtgatgccctaagctacaaatttcatctgtagcagaaaaagaattgtcactaaaaactctacgacagtgtgtggaaaacttactgagtgttcagtgctatgcggtctacaagacagtcgtaaaaaacagtaaaacacactttctacgcagccattctcaggagtcatctgaaactgcgtacaccagtcctctgcctgccctccttccctccctctgccaagccctcgaggtccatcccagtctcatttccttgctggggccctcccttctcgtatcccagcctgcagcctttctctcttggaacagcagcagagtgcacgcctcaggactgactggtgctgttgcatcagctccttattctcacctccctggctgggagttctgagggcaggaactgtgtcttgtgcctggaaagcacgagttcaacagctgctcactggatgggcctgcacggggccttctctacaaatacagaaagccttgcaaggctggccgggtagcacccagatgctattaacactgctggtgatacactctcctctctttcagtgatttatgctattccatatttctgaagcaagccttactttagcaattttaaacagggaaactaattcaaatttctcaaataggggaaatgaactgaagatagtggtttcttatctagccacagatcacttggtctagcaaattttagatgcttttcctcagatatcaataataaatgtacaggaaaaaaa

SEQ ID NO: 3916 - DNA, 1845 bp, Homo sapiens
cacgggccgggagacgggcctgggagcggcggcggcggcccgagagctgcgccgggagagctgtgccgcgagcctccgcctcttttttggcaccgcacagtggatccctggaggccgagcgccacgccgcccgggtacccggcagatcgcgaggtggaacgggccgtcgctgcgggggacagcgttccgaggcagttggtcctctccgggatgccgtaggcatcagctgaccggcccagcccacgtgactacaggggcacttgatgggaatcatggcagcatccaggccattgtcccgcttctgggagtggggaaagaacatcgtctgcgtggggaggaactacgcggaccacgtcagggagatgcgcagcgcggtgttgagcgagcccgtgctgttcctgaagccgtccacggcctacgcgcccgagggctcgcccatcctcatgcccgcgtacactcgcaacctgcaccacgagctggagctgggcgtggtgatgggcaagcgctgccgcgcagtccccgaggctgcggccatggactacgtgggcggctatgccctgtgcctggatatgaccgcccgggacgtgcaggacgagtgcaagaagaaggggctgccctggactctggcgaagagcttcacggcgtcctgcccggtcagcgcgttcgtgcccaaggagaagatccctgaccctcacaagctgaagctctggctcaaggtcaacggcgaactcagacaggagggtgagacatcctccatgattttttccatcccctacatcatcagctatgtttctaagatcataaccttggaagaaggagatattatcttgactgggacgccaaagggagttggaccggttaaagaaaacgatgagatcgaggctggcatacacgggctgcccaaagtctcctcagcaacacttcctgtgagactacaggaatgaagggtgcctgtgtgatcagtcagatcaatcagcacatggaaactgagaaagacagatttaaagtccaaggagtttttgttgcaagttgtgcacatgttagatgcttcatttacaatataaccacagctggaactgaaaagaaacaaagacaatgataaaatgtgatgccctaagctacaaatttcatctgtagcagaaaaagaattgtcactaaaaactctacgacagtgtgtggaaaacttactgagtgttcagtgctatgcggtctacaagacagtcgtaaaaaacagtaaaacacactttctacgcagccattctcaggagtcatctgaaactgcgtacaccagtcctctgcctgccctccttccctccctctgccaagccctcgaggtccatcccagtctcatttccttgctggggccctcccttctcgtatcccagcctgcagcctttctctcttggaacagcagcagagtgcacgcctcaggactgactggtgctgttgcatcagctccttattctcacctccctggctgggagttctgagggcaggaactgtgtcttgtgcctggaaagcacgagttcaacagctgctcactggatgggcctgcacggggccttctctacaaatacagaaagccttgcaaggctggccgggtagcacccagatgctattaacactgctggtgatacactctcctctctttcagtgatttatgctattccatatttctgaagcaagccttactttagcaattttaaacagggaaactaattcaaatttctcaaataggggaaatgaactgaagatagtggtttcttatctagccacagatcacttggtctagcaaattttagatgcttttcctcagatatcaataataaatgtacaggaaaaaaa

SEQ ID NO: 3917 - DNA, 1684 bp, Homo sapiens
cacttgatgggaatcatggcagcatccaggccattgtcccgcttctgggagtggggaaagaacatcgtctgcgtggggaggaactacgcggaccacgtcagggagatgcgcagcgcggtgttgagcgagcccgtgctgttcctgaagccgtccacggcctacgcgcccgagggctcgcccatcctcatgcccgcgtacactcgcaacctgcaccacgagctggagctgggcgtggtgatgggcaagcgctgccgcgcagtccccgaggctgcggccatggactacgtgggcggctatgccctgtgcctggatatgaccgcccgggacgtgcaggacgagtgcaagaagaaggggctgccctggactctggcgaagagcttcacggcgtcctgcccggtcagcgcgttcgtgcccaaggagaagatccctgaccctcacaagctgaagctctggctcaaggtcaacggcgaactcagacaggagggtgagacatcctccatgattttttccatcccctacatcatcagctatgtttctaagatcataaccttggaagaaggagatattatcttgactgggacgccaaagggagttggaccggttaaagaaaacgatgagatcgaggctggcatacacgggctggtcagtatgacatttaaagtggaaaagccagaatattgagttatttcttaacaagtttcgagagagaagggagcaagacaagagcaagcaacggctattaaatgtcacaatcctttaattagaaaccatttattggccggacgcggtggctcacgcctgtaatcgcagcactttgggaggccgaggcgggcggctcacgacgtcaggagatccagaccatcttggctaacagggtgaaaccccgtctctactaaaaatacaaaaaattagccgggcgtggtggcgggcgcctgtagtcccagctactctggaggctgaggcaggagaatcaattgaacccgggaggcggagcttacagtgagctgagattgcgccactgtactcctgggcaacagcgagactccgtctcaaaaaaaaaaaaaaaaaaagaaaccatttattttaaaaatgattagattgctatgcctcaactcatagaagatgaacccttcaagaaaacgtgaagtagaacgggtgggccagaaatgaaaacaggcaagtaaagtatttcttcggaaaacattttatcaaaccaaatgttaaaaagactttccttttgtaaaactggattagagaagacttttcagtgggttatctctaggatgatcagtagttcagcacttaaaaactgcagagaaaactgaaagttatgttccagataactttccgttgtttaccaaattttcttagatttggtcatcatcaggaagcatttgtaaaaataaaaatctccacaaattactggcccatctcggacttgctgaatcaatttgataggattaatctccagtgaagctgtgtttacagggcattccaagtgattcttatcaggaaatgtgaaaaacactcctgtacataatcggttaatttaaaattttacttaataagtgaacaagtaatgaagatttcacctgtttacttagggtatctacccagacccatcgattctgagttcgggagatgattttgaaattactgttttccaaataaaggtgctcccttc

SEQ ID NO: 3918 - DNA, 4757 bp, Homo sapiens
ccggccgagtggccctgggttagcagctgctgcatttccccggctggctgcggtcactggtggcagtgctcaggcgcccgccgcccttgaccttcggccccgcgagctctaaccctacagcgcaggaagatcggccgccgcggccaggctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgctatggcccacgtggccggcttcactgtggctcatgacgtgagtgctcgtgactggcaaatgagacgtaatgggaaacaatggctgctgggaaaaaccttcgacaccttctgccctctgggccctgccttggtgaccaaggacagtgtagcagatccacacaacttaaagatctgctgccgagtgaatggggaagtggtccagagcggcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggccctgcacataggatgagggcatctgctcccactcagcctagcccagggaaaggcccagtgacaggtgtggacaggtgccagccctgcaagccgcctcttctcggtagaagggagaaggacagagctctcttcaataaattcgtcaggtcaaagcagcagctttgcttctgctgtttgtcttcttttgggctttgtttcatgggacaagttggggcattttgtgggactggggaagaagagagcaaatacacacacatatgccaaaaagatgctgctgggctggggaaaagacaattcgtgtcgtccccttgtttatcacatcaaagaagggaaaaagcaagagatggcaagggacaatcaagcctcaatgattatatttatagctaagggtttgcagcctcctctccatcttctggctctaggacacagctgtgttctggggctcagaagtctcagcacaggctccttctcacagttctagctacaagtgaactgccggatgaactgttctagtttttcctgattgtccaggctggcaaaagtaggggacaggtggagcctggggcctgcagggctcggcgtctgctgcagaacctgggccatggaagatgggccgtgagtgcactcaccacagggactgtgtccacatggcccaggggccaggcctgtcccccagaaacctgccttgagacctctgaccccttaggcctcagtgtttgagtgcaaatgctgcctcaaagcagccccaataccccacctagaaggatgagccagtgatttgggagaccaagaggcaggaaaccatcccaccttctccaacccatcaccacgtctattgctggaagacaccaagtaaatcccagggtcttaatgaggcaccatcaggccagccctgtggggtgatgggaacatagctgggtttccctgagccactctattggggtgggagcagggggacagaagatggtgacactggctcctctcacccctaggtctctgaaggtccagatagcactgatggcaagctttgggtctgcacactctggaaagaagagagaagtgaaggctctaggtagggaggacagggagacactgggcacaggcttctctcctcttgtttaaagaagcccagggagggatagatctccgactggacagaagactactctgcagcccgccttcctagagttgggttgtcactgtccggcagggggcagcagccaccagcaaacaccactgcctgcaggagcctgggctgactggttgggactcaccaaagatcccttcttcctgggcggtggcctgcaggaactggaacagctgttggagaggagaagaaaaagaagacatcaaaaagaaaatctagtgctgggtggatatagagtatgaagatgtggagctgggaaaacagaggatgtggtgggatggggaaggaaaggttgtggaaggcctgcaccccgtctcagttcctccactgcttcgtcccagattctgtttttgttttcctgaatcagacttagtctccctccattctcccgtcccctgtgtgcccccatcctggtcctgcctcactggacagcctctccgcggccttcctcctccctgctccagaattctacttggtgccccccaaccccactcgactcattgtccacctggcctctgaggccaggcaccctcattcccctctcccacccaccccacccaaggaagcccagcacagaccatctcatctcactccaccatcacttctttgccaaatgcatttccaaacaccctcatgagctttgctgatctctttgccatctctccctgccccactccgatggctcctcctgcctggtgaagactgccctgggtatcccagaactgaacctgcagcagccagcacagctgaccttggggcgataagcagccagggaaaggctttcttaaaaaaaaacaaaaaacaaaaccaataactcagtaagcagattaaacaaaggtagagacggagccctccacccctctcacacactcatcctcacacccagctataccacaccccacaaatgttgcttatgtttccttggtcattctgtccatcctcctgtctgtccaaagccaaggacactgctctactctaaattttttgtcccgaagcccccaaatactgcaaccctgacccaatgcacgaagccaccccaaaatacagcagaggacaccaggactttcattttccctcagtatggcccatcctttgggtatgccaactccatgtccaccaagcactgcatgtaggacagggcacagtttggaggccttggtccagccactgccccagacccaccttggctctctcctcactaacacccgagaagcccagacttcccagtgtttagcaacagattaaactctaagccaacaacaacagaacagggtggagtgagtggaaagcaaatgaaatgttaaaaaaaaaaaaaaagcaatacttgcattctcattagtaggaacatgtgagatgaagcatgttatgttattaggcattctcttgattcggtaaacacaagctgaataaatttataaatatcagcattaagcgagatttaacggggagctgtttatcttctgcctgtcaggcaggcggcaacactctccatgtatcactcgccagccgtgcagtcctcactctcttgcccaggtaagctggggaagagcctgctgccgcccagctctggttgtggaagggctggcaccaaggagctgcgagcttacctcaactcatctcacctcaccatgccggctgcgaggcggcccgtgcagtccgtgcgcaggaggtcacactcccatgctgcatcccagcccctccagaagcagagcatgacctgggtgactttgaggatgctatttaacctctctaagctaaagctcctcgactgcagcatcaacagatcagtgccgacctgttaaggccgtcgagagcatcaaatgctactgttcagcaggtgcctgacacatagtaggtccacaagcaaatgattttcctgcttgcatcatttctagcacagagctggaggaaatggcgaggtgcaggtggccgctgggccctgctgttctacatgggagcaagacagctgctaggtgaaggggaatgaccaggcagccacagggaggacatgtggcctcaggaagcctgggtgtgtatcctggttctgctaggaacacgtgtggggctttgtgtgggtgactctctggctccccaagcctccctttcctactgttatatccttaaagtgcctctgaggccaaagcctttgtggcaattgtcaaatgagtccatatgcagtgagtaccgtgttgagggaggacaaggtcaccaagagctgagaatgtttctccgactgatgagacctagatattgggtacatggaggtccccggtccctttgtgattcctgcagcctgttgcctccttgcctggaccccgcctcagctcagaaagccaattccctagattccaaaggccttcccagaccaattagcatgtcctgcagctgtcagctccctgtgcctagcctggacctcagctcatgtctagcacccagtctcccaaccccacacatattcacaaataaaagaaaataacaaatgacatgaattcttca

SEQ ID NO: 3919 - DNA, 715 bp, Homo sapiens
gtgctcaggcgcccgccgcccttgaccttcggccccgcgagctctaaccctacagcgcaggaagatcggccgccgcggccaggtaggacgagcctggctgggtctaggccagaagggtgtccgtggcgccggtctcccgcggagcgcagaactagtaccggatccccagccgcttctgaccacacagacggggcggacctgtcagagccaagcacagtgggaactttcagaaagcactggttgaaggaacgctggaatccctgggacttactgcgtagcatgtagtagttgctcctctagaaaagtttcaccttatgaagtatagcaggctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgccc

SEQ ID NO: 3920 - DNA, 522 bp, Homo sapiens
gtgatccggccgagtggccctgggttagcagctgctgcatttccccggctggctgcggtcactggtggcagtgctcaggcgcccgccgcccttgaccttcggccccgcgagctctaaccctacagcgcaggaagatcggccgccgcggccaggtaggacgagcctggctgggtctaggccagaagggtgtccgtggcgccggtctcccgcggagcgcagaactagtaccggatccccagccgcttctgaccacacagacggggcggacctgtgctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaa

SEQ ID NO: 3921 - DNA, 1366 bp, Homo sapiens
gatccggccgagtggccctgggttagcagctgctgcatttccccggctggctgcggtcactggtggcagtgctcaggcgcccgccgcccttgaccttcggccccgcgagctctaaccctacagcgcaggaagatcggccgccgcggccagcagagccaagcacagtgggaactttcagaaagcactggttgaaggaacgctggaatccctgggacttactgcgtagcatgtagtagttgctcctctagaaaagtttcaccttatgaagtatagcaggctctgatgctggtgtctggtagaagaaggttactcacagttctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccgaagacgatgacgcagttcctagagcagggagaggccaccctctcagtggcaagaagagccctggctgcccagttgccagtcctaccacggtcggaggtaaccttcctggctccagtcacacgaccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgctatggcccacgtggccggcttcactgtggctcatgacgtgagtgctcgtgactggcaaatgagacgtaatgggaaacaatggctgctgggaaaaaccttcgacaccttctgccctctgggccctgccttggtgaccaaggacagtgtagcagatccacacaacttaaagatctgctgccgagtgaatggggaagtggtccagagcggcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggccctgcacataggatgagggcatctgctcccactcagcctagcccagggaaaggcccagtgacaggtgtggacaggtgccagccctgcaagccgcctcttctcggtagaagggagaaggacaga

SEQ ID NO: 3922 - DNA, 1305 bp, Homo sapiens
acaggacgcgcccgcttctcgctggagtgcgcaccgagcggcagtgacttcgccgctgctgtagttccccggctggatgcggtgactggtgccagtgctcaggcgcccgctgcccttgacctcccgccccgcgagccctaactcagcgcaggaggaccggctgccgccgccgccgccgccaggctctgatgctggtgtctggtagaagaagattactcacagctctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccaaagacgatgacgcagttcctagagcagggagaggccaccctctcagtggcaagaagagccttggctgcccagttgccagtcctaccatggtcggaggtaaccttcctggctccagtcacatggccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgccatggcccacgtggccggcttcactgtggctcatgacgtgagtgctcgtgactggctaacaagacgcaatgggaaacagtggctgctgggaaaaaccttcgacaccttctgccctctgggccctgccttggtgaccaaggacagtgtagcagatccacacaacttaaagatctgctgccgagtgaatggggaagtcgtccagagcagcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggcccgacataggatgagggcatctgctcccactcagcctagcccagggaaaggcccagtggcaggtgtgggcaggtgccagccctgcaagccgcctcttctcggtagaagggagaaggacagagctctcttcaataaatgcgtcgggtcaaagcagca

SEQ ID NO: 3923 - DNA, 1388 bp, Homo sapiens
gtgacttcgccgctgctgtagttccccggctggatgcggtgactggtgccagtgctcaggcgcccgctgcccttgacctcccgccccgcgagccctaactcagcgcaggaggaccggctgccgccgccgccgccgccagcagagccaagcacagtgggaactttcagaaagcactggttgaaggaacgctggaatccctgggacttactgcgtagcatgtagtagttgctcctctacaaaagtttcaccttatgaagtatagcaggctctgatgctggtgtctggtagaagaagattactcacagctctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccaaagacgatgacgcagttcctagagcagggagaggccaccctctcagtggcaagaagagccttggctgcccagttgccagtcctaccatggtcggaggtaaccttcctggctccagtcacatggccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgccatggcccacgtggccggcttcactgtggctcatgacgtgagtgctcgtgactggctaacaagacgcaatgggaaacagtggctgctgggaaaaaccttcgacaccttctgccctctgggccctgccttggtgaccaaggacagtgtagcagatccacacaacttaaagatctgctgccgagtgaatggggaagtcgtccagagcagcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggcccgacataggatgagggcatctgctcccactcagcctagcccagggaaaggcccagtggcaggtgtgggcaggtgccagccctgcaagccgcctcttctcggtagaagggagaaggacagagctctcttcaataaatgcgtcgggtcaaagcagca

SEQ ID NO: 3924 - DNA, 1113 bp, Homo sapiens
atgctggtgtctggtagaagaagattactcacagctctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccaaagacgatgacgcagttcctagagcagggagaggccaccctctcagtggcaagaagagccttggctgcccagttgccagtcctaccatggtcggaggtaaccttcctggctccagtcacatggccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgccatggcccacgtggccggcttcactgtggctcatgacgtgagtgctcgtgactggctaacaagacgcaatgggaaacagtggctgctgggaaaaaccttcgacaccttctgccctctgggccctgccttggtgaccaaggacagtgtagcagatccacacaacttaaagatctgctgccgagtgaatggggaagtcgtccagagcagcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggcccgacataggatgagggcatctgctcccactcagcctagcccagggaaaggcccagtggcaggtgtgggcaggtgccagccctgcaagccgcctcttctcggtagaagggagaaggacagagctctcttcaataaatgcgtcgggtcaaagc

SEQ ID NO: 3925 - DNA, 1196 bp, Homo sapiens
agaaggtcctgcgctgagagaagggggcggagacaggactacgcgcctggagtaggagaaggaggaaaaaagagaccatagacttccatcctggcctagagcggcccttaaagtgccagggagaggagggcgggtggggaccactccagaattggccgctggcggtatcatggcgacccggaacccccctccccaagactatgaaagtgatgacgactcttatgaagtgttggatttaactgagtatgcaagaagacaccagtggtggaatcgagtgtttggccacagttcgggacctatggtagaaaaatactcagtagctacccagattgtaatgggtggcgttactggctggtgtgcaggatttctgttccagaaagttggaaaacttgcagcaactgcagtaggtggtggctttcttcttcttcagattgctagtcatagtggctatgtgcagattgactggaagagagttgaaaaagatgtaaataaagcaaaaagacagattaagaaacgagcgaacaaagcagcacctgaaatcaacaatttaattgaagaagcaacagaatttatcaagcagaacattgtgatatccagtggatttgtgggaggctttttgctcggacttgcatcttaaggacatgaatattctcccataacggattcaactatgagaagagaagtggcagcaataaggcagtctctcaaaagtcatactgccagagtctctagggcaaggagaaacaactagctggacaatactcaattcacaacttagcattttgccatctgaagcttggcaaactagtatctgctgtaaaacaacctatatggtatgtgaaccgtagtattcctgagcaaaacgtggctttcatcgctttgtaaaaatttgcatctgtttagaaactagcctataaaatatcaccattggatgtagatatggagagaaaagaaatatgttgggtttattgcttagcgaaatattctctttttatttaaataaaatgttcttcattgtgttttatggtatgtgtccataatttaaaattcatgttatagtttcagtattaaggctgactttttttttttaagatatgtttgcaataagttaaaaaactgtaatacccttttgtggaaagctttagaaatgatataattattaaagatattaaacagactctgctgatgtaatatga

SEQ ID NO: 3926 - DNA, 670 bp, Homo sapiens
cccagccccgccactcccaggctcctcgggactcggcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaaggccccaggagatgaggaagcccaggtggagaacctcatcaccgccaatgcaacagagccccagaaagcagagaactgaagtgcagccatcaggtggaaggcggcagccccaagggggacgtggacccgttctactatggcagaagattccgctgtgggggcaataagaagcgcaggcaaatcaatgaagatgagccgtaacagcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaactcctgcctcgtgccacctcatgcttataataaagccggcgt

SEQ ID NO: 3927 - DNA, 670 bp, Homo sapiens; identical to SEQ ID NO: 3926

SEQ ID NO: 3928 - DNA, 5108 bp, Homo sapiens
gggaacaaagccctggtgtctcccgagtcctctgcggaagaggaagaggagcgtgaagagggaggcgaggcatgtggcctggagggtacaggagctggtgaggattcagtggcccctgctgctccgggtgcaggagcgctgagcagggagggtgaggaaggcacagaccttgctcttgaggatgaaggggagggctgcgctgatgagccagggacactggagcaggtgtccagaagtgaggaggaagagaagctagtgcagccacacagggagtgcagcctggaggacagtgggccttgggctggagagggggtcttccagagcgacctcctcctgcctcacatccatggagaggaccaggagccccccgacacccccggggaggcagaggaggatgatgaggaaggctgtgccagcacagacccagcaggggcagatgagggttcgggtcctgacaggcccacggaggacatgggacaggatgctgaggacaccagtgaggagccccctgagaaggaggagctggccggggtccaggaggcagagacagccacagactgccctgaagttcttgaggagggatgtgaagaggccacgggtgtcacaggtggggaacaggttgacctcagtgaaccacctgaccacgagaagaaaaccaaccaagaagtggcagccgccaccctggaggaccatgcacaggatgagtccgccgaggagagctgccagattgtcccttttgagaatgactgcatggaggacttcgtgacttccctcacaggaagcccctatgagttcttcccaactgagagcacctctttttgcagcgagagctgttctcctctttctgaatcagcgaaaggtttagaatcagagcaggcaccaaagctggggctgcgtgcggaggagaaccccatggtgggggctttgtgtggccagtgtggctccctacagggtggagcggccgagggtcccgcagcccctgatgtggtggtcgtgctggaggaggaggccttggatgatgcactggccaacccctatgtgatgggagtgggcctgcccggtcaggcggcccctggagaaggagggcaggctgcatcggacgccctgggtggttatggctcgaaagaagaattgaactgtgaggcagagggtggcctggttcccgcggacaggaagaacaccagcacgagggtccggccccactctgggaaggtggccggctatgtcccagaaaccgtccctgaagaaaccggacctgaggcgggctcgtcagcccctggcattggaggtgccgcagaggaggtgggaaagacgcttttgtcattggaggggaagcccttggaagccagcagggccttgccagcaaagcccagggcctttactttataccctcggtcgttctccgtggaaggccgagagattccagtgtccgtgtaccaggagcctgaggggtcagggttggatgaccacaggataaagaggaaagaggacaatctctctctgtcgtgtgtaattggctcctctgggagtttctcccagagaaaccaccttccgtccagcggcacctccacgccttcttccatggtcgacatcccacctcctttcgacctggcctgcatcaccaagaagcccatcacaaagagctctccctcactcctgatcgagagcgactccccggacaagtacaagaagaagaagtcatcctttaagcgcttcctggcactgacgtttaagaagaagacggagaacaaattgcatgtggatgtgaacgtgtcttcctctaggtcctcttcagagtccagctaccacgggccttccaggattctggaagttgaccggagaagcctcagcaactcccctcagcttaagtctcggactgggaagctccgggcttctgaatccccctcctccctcatcttttatagagatggcaagaggaaaggtgtccccttcagcaggacggtgtccagagtggagtcctttgaagaccgctcccggccgcccttcctgcccttgccactgaccaagccacggtccatctccttccccagcgctgacacttcagactatgagaacattccagccatgaactcggactatgagaatatccagattccaccccggagacctgccagggctggcgcgttcacgaagctgtttgaagatcagagcagagccctgtccacagcaaacgaaaatgatggctacgtggacatgagcagcttcaacgcctttgagagcaaacagcagagtgcagaccaggacgcagaaagcgcctacacagagccctacaaagtctgtcccatctcgtcggcagcccccaaagaggaccttacgtcggatgaagagcagagaagctcggaggaggaggacagtgcttcaagagaccccagtgtcacccacaaggtggaaggacagtccagagcccttgtcatcgcacaggaactgctatcttcagagaaagcatacgtggagatgctccagcacttaaatctggatttccatggagctgtcatgagggccttggatgacatggaccatgaaggcagagacacattggcccgggaggagctgaggcagggcctgagtgaactcccagccatccacgaccttcatcaaggcatcctggaggagctggaggaaaggctgtcaaattgggagagccagcagaaggtagctgacgtcttcctggcccgggagcaggggtttgatcaccacgccactcacatcctgcagttcgacaggtacctaggtctgctcagtgagaattgcctccactctccccggctggcagctgctgtccgtgaatttgagcagagtgtacaaggaggcagccagactgcgaagcatcggctgctgcgggtggttcaacgcctcttccagtaccaagtgctcctcacagactatttaaacaacctttgtccggactccgccgagtacgacaacacacagggtgcactgagcctcatctccaaagtcacagaccgtgccaacgacagcatggagcaaggggaaaacctgcagaagctggtccacattgagcacagcgtccggggccaaggggatctcctccagccaggaagggagtttctgaaggaagggacgctgatgaaagtaacagggaaaaacagacggccccggcacctatttctgatgaacgatgtgctcctgtacacctatccccagaaggatgggaagtaccggctgaagaacacattggctgtggccaacatgaaggtcagccgccctgtgatggagaaagtgccctacgctctaaagattgagacttccgagtcctgcctgatgctgtctgcgagctcctgtgcagagagggacgagtggtatggctgtctgagcagagccctccctgaggactacaaggcccaggcgctggctgcattccaccatagcgtggagatacgagagaggctgggggttagccttggggagaggccccccaccctggtgcctgtcacacacgtcatgatgtgcatgaactgcggctgcgacttctccctcaccctgcggcgtcatcactgtcacgcctgtggcaagatcgtgtgccggaactgttcgcggaacaagtacccgctgaagtacctgaaggacaggatggccaaggtctgcgacggctgcttcggggagctgaagaagcggggcagggctgtcccgggcctgatgagagagcggcctgtgagcatgagcttcccgctgtcttcaccccgcttctcgggcagtgccttttcatccgtcttccagagcattaacccctcgaccttcaagaagcagaagaaagtcccttcagccctgacagaggacaaagtggccttggagagtatgcctctgctaggcttcaccattgctccagaaaaggaagagggcagcagtgaagtaggacctatttttcacctttaccacaagaaaaccctattttatagcttcaaagcagaagataccaattcagctcagaggtggatcgaggccatggaagatgcgagtgtgttatagcagttatcaagcatgtggacttgtaacaaattcttaggtcaatatgtgaatgcttttagaagctaagctgtggctcaactcatccggacacacacctggattcagcaatgaggcctgaccttttttgctataaccgccccaccactcccctgcccttgccaacatcttcatgaatggaatccttaagggatatttatggacctctccttttctgtgttttccacccctacccccacccgccacccagtaataaactatttccttaccccgcagtgagttaaaatttagtaagatgaagatgtggaaaccaatgaaaagtacatttagaaatgcaggctttttagtagaaagaagctcttacagtttttactcatgataaatcttatcacctttcaaaaattgattgtggtgcctcaggtgaaatgagaagctatcagtaacagctactctcatcgaaagcactttattattttacggagctgcaacctccaattttgtgttttctaagtgatttacttaagtcaataacagatggaatcctgtggactaatgtgccaccagttttctaacaagggtgtacataaaatggatttgtgcagacctggctgtggcttgctggtgtgcaagcacacatcactttagaggggctgcgccccaccagataggaaggggaggattttctcctccagtcgaccttgtgacctgtatactaacataacttattaaaggaggggtccctcctcccccagagcagtcctcaacactatgtcagtgctggaaatgcagccactggcagatctggccccccagacgtcaccgcagggcctctgaagagtcaaggtctgctttaatttattgtgtgcctttctgtgtttacctcactcaagctgacaacattgtttatgggaatctatccttcttttagacacacggtaatccttgggctgtattactgaaggctttttattttttgagaggtgaaaaaaagagaaaacaagttagactccaaaggtgaattcctggtcttggcagatggctctgggaacagcgagggagcacagaagtcgtggcctgaggctgttctatgggcacttggggct

SEQ ID NO: 3929 - DNA, 117 bp, Homo sapiens
gtgaaaagcaatcacagtgttaaaagaagacacgttgaaatgatgcaggctgctcctatgttggaaatttgttcattaaaattctcccaataaagctttacagccttctgcaaagaa

SEQ ID NO: 3930 - DNA, 527 bp, Homo sapiens
cgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaatgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgcaaa

SEQ ID NO: 3931 - DNA, 527 bp, Homo sapiens; identical to SEQ ID NO: 3930

SEQ ID NO: 3932 - DNA, 527 bp, Homo sapiens
cgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgcaaa

SEQ ID NO: 3933 - DNA, 527 bp, Homo sapiens; identical to SEQ ID NO: 3932

SEQ ID NO: 3934 - DNA, 520 bp, Homo sapiens
ctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctatgttggaaatttgttcattaaaattctcccaataaagctttacagccttctgcaaagaa

SEQ ID NO: 3935 - DNA, 354 bp, Homo sapiens
atgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtgaagggcaatcacagtgttaa

SEQ ID NO: 3936 - DNA, 3218 bp, Homo sapiens
ccggaagctcatctcaaaatgctgaactgctctttggaagtcgccggtgctgttgtagttggagtctgttcacgggcctgagcttcgaggccaggctcccgggtgtcgttaatgttcggggccgccgggcgccaaccgatcggagctccagcagccgggaacagctggcatttcagtagaaccatggaggagctggttcatgaccttgtctcagcattggaagagagctcagagcaagctcgaggtggatttgctgaaacaggagaccattctcgaagtatatcttgccctctgaaacgccaggcaaggaaaaggagagggagaaaacggaggtcgtataatgtgcatcacccgtgggagactggtcactgcttaagtgaaggctctgattctagtttagaagaaccaagcaaggactatagagagaatcacaataataataaaaaagatcacagtgactctgatgaccaaatgttagtagcaaagcgcaggccgtcatcaaacttaaataataatgttcgagggaaaagacctctatggcatgagtctgattttgctgtggacaatgttgggaatagaactctgcgcaggaggagaaaggtaaaacgcatggcagtagatctcccacaggacatctctaacaaacggacaatgacccagccacctgagggttgtagagatcaggacatggacagtgatagagcctaccagtatcaagaatttaccaagaacaaagtcaaaaaaagaaagttgaaaataatcagacaaggaccaaaaatccaagatgaaggagtagttttagaaagtgaggaaacgaaccagaccaataaggacaaaatggaatgtgaagagcaaaaagtctcagatgagctcatgagtgaaagtgattccagcagtctcagcagcactgatgctggattgtttaccaatgatgagggaagacaaggtgatgatgaacagagtgactggttctacgaaaaggaatcaggtggagcatgtggtatcactggagttgtgccctggtgggaaaaggaagatcctactgagctagacaaaaatgtaccagatcctgtctttgaaagtatcttaactggttcttttccccttatgtcacacccaagcagaagaggtttccaagctagactcagtcgccttcatggaatgtcttcaaagaatattaaaaaatctggagggactccaacttcaatggctacaaactggaccagtgagattcccctataaaccaaatcttctaatgctaataaattagttacgttttgaacatctggggaatgacattcgagggaacctggctcctgtcctcttccctggaggaatatcattgaagtgagagcctctttgatgaaaagatggggctgtttttgctggaggactggtattcttccttttagtcagaagtgaacctgactggggaggctttctagggatttaggttggcccagggtggatagaaactactgtaaattatatatttttctcttttatggttttttttttacattgaatccatttatgtatacttgctttgccaaaatgctaacaaagctagaaaattttaaacttccagatcgacaagtattccttaatgtttatattgtgactgattaagaattaatttttacatatctgactgttgtaaataaaaatcatgatgcattgacatttatggttcatttttagagaagtcttatataaccagcattatttaaaatatttgcattttactcagggtattttaacaagggctaagatgagtagtaggtaaggttgataatctttgctggagtttgtattttgttcagcttcctttctacttgggtaatctgcttgtattgcaaactcattgtattttatagtatagctttcattgtactgcaaaaatcatcctcgttttaaattagccacagtgataactagtctgcactagtagaatcatttaccttttaaattatctgctttgtctgatacctgaaacacatcaaaattattattttggtttagagcttaatgaaacatgtgaaagctggtatttttaacaaatgctgtgtgattctgaatcatattgtcatgtttaaaagtgagagctgcttgtacatctttagaatggcagaccatatgtgtcactgtgagtgtcagaaatacttgcatgagctcattttcaccaactggggggaaaatgtaatgtttctattgatggtataatttagacactataataagttcagccatttgagttcttcaaaatggttatattaaaatgatatttttattaagcttcaataatgaaaaacaatgtgatttaatatgtgtatttttatattattgtatggattaattgttaattcagcatttaatggctaacttaaatatgattggaaaagaaacttcaagttgccattgcttttacctaaagtttttaaagtctgaaagatttcagcaaatgcattaaacaggaatgtgtgacatcttcttttagattgcttgtctaatttggagagattaaaaatggtaaaatgcaactttgagtctctttacctttgcatatttaaaggtacaatagtgtggtgttggtaattgtaagtaagcttttctgtgctatgtctttggagtgaaaattcatgttttttttctgaattacataaatgcttttgttttattttgtataatgactgtcttttagatctgaataagtcactttaaaaccttggcctatgaactttgccttatcaatcatgaatctagatgaatgctatctagttcttggttcagttttacctatttttatttttggttcactgcttgcttgagcatagctgggatttgtagcccattttctaggcttattgcaatctcactgtggtattttatagaagctattacaactgataggctagcttcatggtattgatgatacatggcttaaccatactaaaagctgctttccctctctaaattgtaaaaaggtgatgaagtttcacttgatggagacatactatatatgtgtgtttatcatggaactagtgcattaggccataagctgtttttctggtctatgttttttgtatttaaaactttactgaagacaatggactccttcgggttttctttctttcaaccctgaattgtccttgtttgaatttttaagtactgtaatttttttttttcaataaaatctctgacttgggcaagaaaggtaa

SEQ ID NO: 3937 - DNA, 5851 bp, Homo sapiens
ccggaagctcatctcaaaatgctgaactgctctttggaagtcgccggtgctgttgtagttggagtctgttcacgggcctgagcttcgaggccaggctcccgggtgtcgttaatgttcggggccgccgggcgccaaccgatcggagctccagcagccgggaacagctggcatttcagtagaaccatggaggagctggttcatgaccttgtctcagcattggaagagagctcagagcaagctcgaggtggatttgctgaaacaggagaccattctcgaagtatatcttgccctctgaaacgccaggcaaggaaaaggagagggagaaaacggaggtcgtataatgtgcatcacccgtgggagactggtcactgcttaagtgaaggctctgattctagtttagaagaaccaagcaaggactatagagagaatcacaataataataaaaaagatcacagtgactctgatgaccaaatgttagtagcaaagcgcaggccgtcatcaaacttaaataataatgttcgagggaaaagacctctatggcatgagtctgattttgctgtggacaatgttgggaatagaactctgcgcaggaggagaaaggtaaaacgcatggcagtagatctcccacaggacatctctaacaaacggacaatgacccagccacctgagggttgtagagatcaggacatggacagtgatagagcctaccagtatcaagaatttaccaagaacaaagtcaaaaaaagaaagttgaaaataatcagacaaggaccaaaaatccaagatgaaggagtagttttagaaagtgaggaaacgaaccagaccaataaggacaaaatggaatgtgaagagcaaaaagtctcagatgagctcatgagtgaaagtgattccagcagtctcagcagcactgatgctggattgtttaccaatgatgagggaagacaaggtgatgatgaacagagtgactggttctacgaaaaggaatcaggtggagcatgtggtatcactggagttgtgccctggtgggaaaaggaagatcctactgagctagacaaaaatgtaccagatcctgtctttgaaagtatcttaactggttcttttccccttatgtcacacccaagcagaagaggtttccaagctagactcagtcgccttcatggaatgtcttcaaagaatattaaaaaatctggagggactccaacttcaatggtacccattcctggcccagtgggtaacaagagaatggttcatttttccccggattctcatcaccatgaccattggtttagccctggggctaggacagagcatgaccagcatcagcttctgagagataatcgagctgaaagaggacacaagaaaaattgttctgtgagaacagccagcaggcaaacaagcatgcatttaggatccttatgcacgggagatatcaaacggagaagaaaagctgcacctttgcctggacctactactgcaggatttgtaggtgaaaatgcccagccaatcctagaaaataatattggaaaccgaatgcttcagaatatgggctggacgcctgggtcaggccttggacgagatggcaaggggatctctgagccaattcaagccatgcagaggccaaagggattaggacttggatttcctctaccaaaaagtacttccgcaactactacccccaatgcaggaaaatccgcctaagaaaagcaaagaagaaatgttttacagactttattcactatgtcccattgttctaaaatgataacatgacttctgtttttgaagcaaaaatctacattgcctcaaacacatcactctagcttccttactgcatacagtcctgccatagtgagagaaatgggatttcatcacaattcatggtgctaaaatgaaaacctctgcactttaatttttttcagtaatttccagctatttctaggtataaagagcagctcgtttctcttatttattttagtctcatgtgtcaatactttccgatgctttgcttaattcatgtatgtgtgcagtgctgcaatgcccagacaaacgtgagcacacccaccagtttctaaaatggaatagacaggaaaagattgtgttttatatcatccctatctattgtaacccaaaagacctaccatcgcatcagtgaagtccgaacacatctttgtttgaaaggcttgtcaatttcatattccttgaattggcttcttggtgaggattttctgacagagtgatacccatcaattttctatccttagacaatgtagtgtgaagttcacagttgacaaacaacaattaatgtttcccttggatgttttgacaaaaataaacctcatcgttgttatcaccagagtgccctctaccttactttaatgcagattttataaattttacctcatttagaacataaaataattattgaaagaaaaatgtattttttaaattcaccgtgattgaactgtaaattctattaatccagatgtacttctacctctgttttcccaaagattgatattatttttaagatcaactcaagtgtagtaaacggatttaaaattttaatcattggagtaatttattacaatattgaatcaatttacatgaaaagttaaatggctctcccagaactcagatttctggcaatgacccaacccatttagaaggtgaacaaaagaagtaaatggtactgatttgccctttctaggacccaagatgttactttaaaacctagcaaaagaggtcgtttgtattacgtgcctagtattgagctgtttctgagtcatttgcttcatagtatcagaaattctaaattgcttttagtttagaagatctttatttattatcttcattattaacaacttattatgatgatgattattatcattctatttataatggcctttgctggttgagtaaagactgagataacacatgtgaatcacctttctaatgggtttttaaaatcttgtcactttccaaaagagtttttttgtttctttttttttttttttttttttgacagagtctgcctctgtcgcccaggctggagtgcagtggcgcactctcggctcactgcagcctccccctcctgggttcaagtgattgttctgcctcagcctcccaaatagcagggattacaggcacccacgaccatacccggataatttttgtatttttagtatagacggagtttcaccatgttggccaggctggtctcgaactcctgacctcaagtgatccgcccaccttggcctcccaaagagctgggattacaggcatgaaccacagcgcccagcccccagaagagtttttaaaaggtgttaaaggaggtttatgcacgtaacagacctttctcaggtggtcccctaaaaaaaatcctgccaactagggaggggaagtccaacctgctatttgaaagccttcacggtttgccaaatgtacatttcttgagaattatcttctttcccagggatattgtacctagaggacaggttggttagggaactatggacgaccagaagagatgttcttttgaagcattcttactggataaagtaaccccatggtatcattactttctacaagttttttacttacaaatttgccatttttttaactgatattttctaaatgctcattctgtctatgtagccggggggagattatatacaagttttaaaacttctttgtgatagtgtattgtgctctggggtctattcaaaatttggtgtttgaggttttgttaatttgattgcctggagatctgctaaaatcctagaatctcaaaaagccaagtttgaagccactgagagcaaacaatgaggtcattgttagcctggttccacactcctgaggacttggctgttctttttcaccttattatgttctaatggaagtaaaaaccctcatagtgaagaagagcagtatatacaccagactagtgtataggaacttcttcattaaatattgcagtccttatgagtgctctttattgttgctgttctggacaggtacaaatcttctgaagcaacttctgtgggatgttaacttagcttctctaacacctaaaaaaattcttctttgtattttcagctaatagaagacagttcttcttcatcttgacacctagagccctctatgtgattcacagaggacttaaaatacttcttactctgttgaagtgtttaattgtacagaatatatgtactctacagtatatgtgaatcagcactcaaagcagagaagtgataacatcccaagcttcccccatacttctactgacatgccctcagtctttaagaaaactcagtacagacctgatgttctggttgtacctgaacttaattggagaaacaaacgcaattaaaatacgaattttttagtgcaaatcaaatgtctttcaccatctgaagcccactaatttgtcttttatatatagttaattttttgccagttacaacgtccatagaaccccaagatttagaatgtatcatttatatttcctctaaaaggtagtaagatatttcttctgctgttttgtgaagccactcttctacagtatctgtagccttatagcaaattaattggttgtactaaaaattttagagactgcataggtctcccttttctatcctaattacctgcaatagcctagagacgctgagcatgattacattagcaacttgactgtttaaaaaatttgttatacttgataatgaccagactgtgtgctggagtcatttgtttccttcttttctgctccccgaatacactatttaatttggttacttttatttttaaactatatggcacccttttaaataaacattcattgctaattaaaatctgccaataaattggtctcagcatttaaataccatatattttataactcatactgtggctatcaaacagaagttaacacagtaggggtaaagatatacataatgtgtacctataggtgtatttataatgcctgtgtgcagtatacagacataattacaaaatactgcattttattaatgtttattttaatattgagaattggcattcttgtaaattgaactgacaattgcttctattcagtacactttattttgagcagatatttccgaaaagagaaaaaatcactgttgacatgctttttaaaactgttttcacctgtattttgtctttcaaaaagaaaagtgatctaagttggcattgtaaagaaattgttagcaaagaatatttttttttattttttcttttggtagaaagtcatgttaatagtacaacaaagaatcaaagaataaaacataatgtttaagaacattatttataagtagtcattgtctttgtgctttaaatgtttcccttttaccttagagttattttttaaaagttgaaagtactttaaaaattggtttaaatgagtacccattgacaattatcatttaatagtgcagttaagttcagcgaaaaatttcaatatctcaaaaaaattagagaaaaatattggtaaatgtatttgattcacaaatgtattcatagccgattgtgagctgctctaccacattttcctgtttttattgtttctgtgaagcttgattagactaacttgcttaaggtctctttcccctcaaggattctgtgattctaatgtaacaaggtacacacgctctctctgaccacttaaagtatcagagttcaaatctgttacaatcactccatttccttttggaaagttgtgcctctcataaagctgcttggacattttaagtgttttgtaatatgcattgaagtgttgagttttgtttgctgtaagaggcatttcactatgttgattaaacttatcttttctcccaaaaaa

SEQ ID NO: 3938 - DNA, 2123 bp, Homo sapiens
tagctgatcatgtgacaatccaagatggcggtgcccggcgaggcggaggaggaggcgacagtttacctggtagtgagcggtatcccctccgtgttgcgctcggcccatttacggagctattttagccagttccgagaagagcgcggcggtggcttcctctgtttccactaccggcatcggcctgagcgggcccctccgcaggccgctcctaactctgccctaattcctaccgacccagccgctgagggccagcttctctctcagacttcggccaccgatgtccggcctctctccactcgagactctactccaatccagacccgcacctgctgctgcgtcatctcggtaagggggttggctcaagctcagaggcttattcgcatgtactcgggccgccggtggctggattctcacgggacttggctaccgggtcgctgtctcatccgcagacttcggctacctacggaggcatcaggtctgggctcctttcccttcaagacccggaaggaactgcagagttggaaggcagagaatgaagccttcaccctggctgacctgaagcaactgccggagctgaacccaccagtgctgatgcccagagggaatgtggggactcccctgcgggtctttttggagttgatccgggcctgccgcctaccccctcggatcatcacccagctgcagctccagttccccaagacaggttcctcccggcgctacggcaatgtgccttttgagtatgaggactcagagactgtggagcaggaagagcttgtgtatacagcagagggtgaagaaataccccaaggaacctacctggcagatataccagccagcccctgtggagagcctgaggaagaagtggggaaggaagaggaagaagagtctcactcagatgaggacgatgaccggggtgaggaatgggaacggcatgaagcgctgcatgaggacgtgaccgggcaggagcggaccactgagcagctctttgaggaggagattgagctcaagtgggagaagggtggctctggcctggtgttttatactgatgcccagttctggcaggaggaagaaggagattttgatgaacagacagccgatgactgggatgtggacatgagtgtgtactatgacagagatggtggagacaaggatgcccgagactctgtccaaatgcgtctggaacagagactccgagatggacaggaagatggctctgtgatcgaacgccaggtgggcacctttgagcgccacaccaagggcattgggcggaaggtgatggagcggcagggctgggctgagggccagggcctgggctgcaggtgctcaggggtgcctgaggccctggatagtgatggccaacaccccagatgcaagcgtggattggggtaccatggagagaagctacagccatttgggcaactgaagaggccccgtagaaatggcttggggctcatctccaccatctatgatgagcctctaccccaagaccagacggagtcactgctccgccgccagccacccaccagcatgaagtttcggacagacatggcctttgtgaggggttccagttgtgcttcagacagcccctcattgcctgactgaccgggttgggggcttcctttcatagctacatgatgaaaaccctctgccctggcctcatctaccactgaagcagaaaggagtctgggagcagcagtcttcgtggctggttcagggtgttttgttccgagcctgcctgcctgccggttctatacctcaggggcatttttacaaaaagccccctcccgtcccctccccttggatattaggggtaacgaccgcttgtctttggtctctaaccctaatctctgggcttgccctttgcctcctgcagaactttgaaaagctgggttgagtgaggctatcagcacagccttccttggggactctgaaggtgtccccacgaaggccagaaagggggaaagggacctgggcgaggagaggatttgtggtgcttggaagagccggccttgggtgggccctccaccgcctctaccctcactgggtgggactgccagcggagagtccgcgggaggtggcttgggtgtgcgacgtcacggaagaataaagacgtttactactgg

SEQ ID NO: 3939 - DNA, 1310 bp, Homo sapiens
ggttctagctgatcatgtgacaatccaagatggcggtgcccggcgaggcggaggaggaggcgacagtttacctggtagtgagcggtatcccctccgtgttgcgctcggcccatttacggagctattttagccagttccgagaagagcgcggcggtggcttcctctgtttccactaccggcatcggcctgagcgggcccctccgcaggccgctcctaactctgccctaattcctaccgacccagccgctgagggccagcttctctctcagacttcggccaccgatgtccggcctctctccactcgagactctactccaatccagacccgcacctgctgctgcgtcatctcggtaagggggttggctcaagctcagaggcttattcgcatgtactcgggccgccggtggctggattctcacgggacttggctaccgggtcgctgtctcatccgcagacttcggctacctacggaggcatcaggtctgggctcctttcccttcaagacccggaaggaactgcagagttggaaggcagagaatgaagccttcaccctggctgacctgaagcaactgccggagctgaacccaccagtgctgatgcccagagggaatgtggggactcccctgcgggtctttttggagttgatccgggcctgccgcctaccccctcggatcatcacccagctgcagctccagttccccaagacaggttcctcccggcgctacggcaatgtgccttttgagtatgaggactcagagactgtggagcaggaagagcttgtgtatacagcagagggtgaagaaataccccaaggaacctacctggcagatataccagccagcccctgtggagagcctgaggaagaagtggggaaggaagaggaagaagagtctcactcagatgaggacgatgaccggggtgaggaatgggaacggcatgaagcgctgcatgaggacgtgaccgggcaggagcggaccactgagcagctctttgaggaggagattgagctcaagtgggagaagggtggctctggcctggtgttttatactgatgcccagttctggcaggaggaagaaggagattttgatgaacagacagccgatgactgggatgtggacatgagtgtgtactatgacagagatggtggagacaaggatgcccgagactctgtccaaatgcgtctggaacagagactccgagatggacaggaagatggctctgtgatcgaacgccaggtgggcacctttgagcgccacaccaagggcatttttacaaaaagccccctcccgtcccctccccttggatattag

SEQ ID NO: 3940 - DNA, 546 bp, Homo sapiens
attttgatgaacagacagccgatgactgggatgtggacatgagtgtgtactatgacagagatggtggagacaaggatgcccgagactctgtccaaatgcgtctggaacagagactccgagatggacaggaagatggctctgtgatcgaacgccaggtgggcacctttgagcgccacaccaagggcatttttacaaaaagccccctcccgtcccctccccttggatattaggggtaacgaccgcttgtctttggtctctaaccctaatctctgggcttgccctttgcctcctgcagaactttgaaaagctgggttgagtgaggctatcagcacagccttccttggggactctgaaggtgtccccacgaaggccagaaagggggaaagggacctgggcgaggagaggatttgtggtgcttggaagagccggccttgggtgggccctccaccgcctctaccctcactgggtgggactgccagcggagagtccgcgggaggtggcttgggtgtgcgacgtcacggaagaataaagacgtttactactgga

SEQ ID NO: 3941 - DNA, 521 bp, Homo sapiens
attaaaatgaataagtcaatcttacgagggggtcctagaaacctgattcttcccccttctttgagagggacgcttccataaactgagctctgtttcctcagatggtggagacaaggatgcccgagactctgtccaaatgcgtctggaacagagactccgagatggacaggaagatggctctgtgatcgaacgccaggtgggcacctttgagcgccacaccaagggcattgggcggaaggtgatggagcggcagggctgggctgagggccagggcctgggctgcaggtgctcaggggtgcctgaggccctggatagtgatggccaacaccccagatgcaagcgtggattggggtaccatggagagaagctacagccatttgggcaactgaagaggccccgtagaaatggcttggggctcatctccaccatctatgatgagcctctaccccaagaccagacggagtcactgctccgccgccagccacccaccagcatgaagtttcggacagacatggcctttg

SEQ ID NO: 3942 - DNA, 1901 bp, Homo sapiens
tctagctgatcatgtgacaatccaagatggcggtgcccggcgaggcggaggaggaggcgacagtttacctggtagtgagcggtatcccctccgtgttgcgctcggcccatttacggagctattttagccagttccgagaagagcgcggcggtggcttcctctgtttccactaccggcatcggcctgagcgggcccctccgcaggccgctcctaactctgccctaattcctaccgacccagccgctgagggccagcttctctctcagacttcggccaccgatgtccggcctctctccactcgagactctactccaatccagacccgcacctgctgctgcgtcatctcggtaagggggttggctcaagctcagaggcttattcgcatgtactcgggccgccggtggctggattctcacgggacttggctaccgggtcgctgtctcatccgcagacttcggctacctacggaggcatcaggtctgggctcctttcccttcaagacccggaaggaactgccggagctgaacccaccagtgctgatgcccagagggaatgtggggactcccctgcgggtctttttggagttgatccgggcctgccgcctaccccctcggatcatcacccagctgcagctccagttccccaagacaggttcctcccggcgctacggcaatgtgccttttgagtatgaggactcagagactgtggagcaggaagagcttgtgtatacagcagagggtgaagaaataccccaaggaacctacctggcagatataccagccagcccctgtggagagcctgaggaagaagtggggaaggaagaggaagaagagtctcactcagatgaggacgatgaccggggtgaggaatgggaacggcatgaagcgctgcatgaggacgtgaccgggcaggagcggaccactgagcagctctttgaggaggagattgagctcaagtgggagaagggtggctctggcctggtgttttatactgatgcccagttctggcaggaggaagaaggagattttgatgaacagacagccgatgactgggatgtggacatgagtgtgtactatgacagagatggtggagacaaggatgcccgagactctgtccaaatgcgtctggaacagagactccgagatggacaggaagatggctctgtgatcgaacgccaggtgggcacctttgagcgccacaccaagggcattgggcggaaggtgatggagcggcagggctgggctgagggccagggcctgggctgcaggtgctcaggggtgcctgaggccctggatagtgatggccaacaccccagatgcaagcgtggattggggtaccatggagagaagctacagccatttgggcaactgaagaggccccgtagaaatggcttggggctcatctccaccatctatgatgagcctctaccccaagaccagacggagtcactgctccgccgccagccacccaccagcatgaagtttcggacagacatggcctttgtgaggggttccagttgtgcttcagacagcccctcattgcctgactgaccgggttgggggcttcctttcatagctacatgatgaaaaccctctgccctggcctcatctaccactgaagcagaaaggagtctgggagcagcagtcttcgtggctggttcagggtgttttgttccgagcctgcctgcctgccggttctatacctcaggggcatttttacaaaaagccccctcccgtcccctccccttggatattaggggtaacgaccgcttgtctttggtctctaaccctaatctctgggcttgccctttgcctcctgcagaactttgaaaagctgggttgagtgaggctatcagcacagccttccttggggactctgaaggtgtccccacgaaggccaga

SEQ ID NO: 3943 - DNA, 606 bp, Homo sapiens
ggaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaaggtattagaggctgtgggtaacagagtccatcctttttctcttccctggtttccctggggcctgaacagttgccttgtatgccttatcaattctcagaactttcctaacatagtgggatcctgtgaccagccttgctgttgcttacttagactgcccagaccctcagcaggaattgagatcttcaggttccgtggatcctgccatctgttaagggagcagcaatag

SEQ ID NO: 3944 - DNA, 1460 bp, Homo sapiens
ggaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaactttaggtggtggaaccagggaagcagagagcagagcatgcagtgatggaagaagcaggaaaagcaagaagaaaagacagcagcatcaagaggaggaggacatcttggatgtaagggatgagaaggatggcggggctagggaagcagagagcagagcacacactggctcaagcagcagaggtaagaggaagaggcagcagcatcccaagaaggaaagagctggagtcagcactgtccagaaagccaaaaagaaacagaagaagagagactaa

SEQ ID NO: 3945 - DNA, 1972 bp, Homo sapiens
cggcatttccgggaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaacttttaggtggtggaaccagggaagcagagagcagagcatgcagtgatggaagaagcaggaaaagcaagaagaaaagacagcagcatcaagaggaggaggacatcttggatgtaagggatgagaaggatggcggggctagggaagcagagagcagagcacacactggctcaagcagcagaggtaagaggaagaggcagcagcatcccaagaaggaaagagctggagtcagcactgtccagaaagccaaaaagaaacagaagaagagagactaaaggtctggtaaaggtagggctcaattgattgattttcaggagttgaagcctcaaagaccagggttgatgcaggtctgcaggtcttctgcacccccctcaatgaggagtccctcccagaaaggaaactgatctctgggacgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaaaacataaatttaggtctatgggctagatttagcccacagttgccagtttctagcgctaccaaatgaatgaataaacatgagcttgcgctcctagcctagagataaa

SEQ ID NO: 3946 - DNA, 1159 bp, Homo sapiens
aagatggcggcgcacaagtcaggtccggcacatgtttccgcggagcggacccagcaatgacgaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaacttttaggtggtggaaccagggaagcagagagcagagcatgcagtga

SEQ ID NO: 3947 - DNA, 2571 bp, Homo sapiens
cttcccttgtcctgggagtcatcacctgcgcgcctgagaggctcaacttccctgcttctgcctgtgccctcaaacgggcagcctggctgctgcggggccgtggggtcttccacaacggtctcaagatctgcgagaagtttgggcccaatctggacacgtgccctgaaggcaccatcctgggactgcggctggacagctctggggggctgcatcttcatgttaatggggtggaccagggggtagctgtgccagatgtgccccagccctgccatgcgcttgtggacctctatgggcagtgtgagcaggtgacaatcgtgaaccctgagccaggggctgccagtgggaaaagtgctggaacccaaggggacatggagaaagcagacatggtggacggtatcaaagagagtgtgtgctggggtccaccacctgccgctagtcctctaaagagctgcgagtaccatgccctttgctctcgcttccaagaactcctgctgcttcccgaagattatttcatgcctccgccaaagcgaagcctgtgctactgtgagtcttgccggaagctgcgaggagacgaggcccacaggcgcagaggggagcctccccgggaatatgcactgccctttggctggtgcaggttcaacctcagagtgaatccccgcctggaggctgggacactaaccaagaagtggcacatggcatatcacgggagcaatgttgccgctgtacggagagtgctggaccgaggggagctgggagcaggtactgcctccatcctgagctgccgtcctttgaagggagaacctggggtagggttcgaggagcctggcgagaactgtgcacctcctcgggaggagcagccccctcctgtgctgctttccccctcccttcaatatgctggggcggagaccctggcctccaaagtgcaattccgggaccccaaatcccagcggacgcaccaggctcaggtggcgttccagaggagtctctccctgtgcccacatgaagctgctttttccggggccaccgggcgggagtggggaagggtgggcgcacggaagatgggggcctctgtacagttgttactgactctgatttctaaggagccaataaacaccgtctcagagcctccgcctcggcctctctctcgcgcgcccctctccggagcccgcgtcccctggggtgccaccaggtgggcccgcgaaattaaagagagctgaggatgccaaggccagtctgcagccgtcgtcgctcacgttcccggcgacggggtttgtacgccgcgggcacccgtcgcagcgcgcttccgccttctttcacctgtgaggtcggccgccgccgtgactccggaaggactcggccgggccgccggatgtgacgcaggggccagggcgcgtcggagccgctgagaaagcgcagagaaggcgggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctaacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactg

SEQ ID NO: 3948 - DNA, 7718 bp, Homo sapiens
gtgggggacaatgaggatgcaggtacactgggcaagaggggattaaatgtcaggcaggataggtctgattgatggtactgggtgggcatcttatctcactgctgcaccgtccccaggggtacagaaaggtctgaatgaatcccatgttccctagccctacagctgggcacgcagtaggggctcaggagatgctgtggaatcaatgaccagatgctgaatgagtccctcatggaaaaagctgatgcatggggcctctccttgcccctggagctagaggtaggagtcagggaaccccagagacatgccagctcagcaaggctaggccaaggaggatgggggtggttgtggaagcccagggtgattctcagtgtcctctggtcattgctccctcgtcctgtgaactttctctgagctcccactctgtaccaaggagaccctgtccacagtgagttggatactgccagtcccaggaggaagtagcccagtattggcctgtccagctgtgcccgttaagaggccatagtgcttccgtgctggttgaccaagagctgttatcccacagccccaccccctagggctgcagtttcacccccaaagccccagcagatttggctctctcccttcccctcccacacaaaccagccagtaaagagttgagagctgatagagtggcggcctccaggaccccaccctagggcagattctaactgcttgagactgatgatgagataatttgcagtgtcatccttgtgtctaatgtgagatgaccttgatttgaagtgtctggtgtcttgtcactcactgccttgcatatggttctgaccagtcaggcaggctgggactgaaggtggctccctggtgaacctagcactgtgggagttcatagtagaatcggcttaggtgctgccacccaactcaactccactccctccctttctctcttctgcaggcagccatgagctccagccgccccgagccgggtccctgggcacccctgagcccccgccttcagcccctgtcccagagctcttccagcctgctgggtgaaggccgggaacagaggccagagctccgcaagactgccagcagcaccgtgtggcaggcccagctgggcgaggccagcaccagaccccaggccccggaggaagaggggaacccgcctgagagcatgaagccagcacgggcctctggccccaaggcgcgacccagtgctggaggccactggtggagcagcactgtgggcaatgtgtccaccatgggcggcagtgacctgtgtcgcctgcgggcccctagtgctgctgctatgcagaggagccattcagacctggtccgtagcacccagatgcggggacacagtggtgctcggaaggccagtctcagctgctcagcccttggcagcagccctgtccacagggctcagctgcagccaggtggtacttctggccagggtggccaggcccctgcaggcctggaaagggacctggctcctgaggatgagacttctaactcagcctggatgctgggggcgagtcagttgtcagtgccaccactagacctgggggacacaactgcccacagcagcagtgcccaggctgagcccaaagctgctgaacagctggctaccaccacctgccatgctctgcccccagctgctctactctgtggcatgagggaggtgagggctggtggctgctgccatgccctacctgccacagggatcctggcctttcccaaactagtggcgtcagtgagcgagtctgggctgcaggctcagcatggggtgaagatccactgtaggttgtctggggggctccctgggcattcccattgctgtgcccacctttggggtcccgctgggttagtcccagagcctggctctaggaccaaagatgtgtggaccatgacctcagccaatgacttggcccctgcagaggcatccccgctgtcagcccaggatgctggtgtgcaggcggccccagtggcggcctgcaaggctgtggccaccagtccgtccctggaagcgcctgcagccctgcatgtgttcccagaggtaactctggggtccagcctggaggaggtgccgtcccctgtgcgggatgtgcgatgggatgctgagggcatgacatgggaggtgtacggagctgcggtggacctggaggtgctcggtgtggccatccagaagcacctggagatgcagtttgagcagctgcagcgggcgcccgccagcgaggacagcctgtctgtggagggccggagggggccactgcgggctgtcatgcagtccctgcggcgccccagctgctgcggctgctccggcgcggcccccgagtgaggagctgtggcccttggagctggcctgggcccactgacttagtcctagacctgggccagggacggtgggggctccgtgccccctggacccaccggcagctgggcacatctctcacctgaatattggctgcctccagaccacaggactgcagcctggggcttccggccctacacagctgggctgttttcttaagggcttgatttccaagggccacatctctgcaccttccgggctctgaactttgagacagggctttagcactgtgcagaggggagatcctgagttttctgtaaaaaatgaccttttgttcactccaccctcagaactctgccatgttgcctcgtcagactcttggtggctttatttgaaatcagtgctgagaaatagtgaattctcgacatgaaatgtgaggccccagtgacagggactgcccaggtctttagggaaggggactgatgttatcagaggcctcctgtgtgccacatactgtgcttgtcctgtcttcacctcttcatcctggcaagccttcatttggcaaggctgtagccgatgtgccccacgctggacagcttgaagaggtgggactgagatccaaagccagggccagctgagccgtgggtgttgccctgtagcatgtgcccggtccagtcagtgcagtcatgtatgaggagaatttactgagctcatactctgtgctgggttctgtggattctgtggtgaatgagacagaggctgcccctgccctggctgagctcatggtgtgggttggggatggcaggggaggatgctgaccattacggagggctgccaggcttccagggtcattgtgtcagaggctggcctgaggaaggggagaatgggtggccacctgccctaatctcagttacaaagcctaaaattgcactattttcacctcattctgtcggctgaaggatttctccccagctggtgcagtttgtggaaggagggagggcaggaatggagggggacagggcaggagtttgccctggccctggggtaggggctgtgaggctgtgggggctcgcttgcccacatgacctgacctaggctaggcagtgggggccaggggccttggagagacagaaacatgggctttggcacagtctgacttcattgcccaaagatttctcgaggcctgtgaagaatgggagtgggcttgtgttcttgtcctgggtctttgtcttgaagatcctaagatcccgtgacacagccccccaatccacccgtgtgagggaccagagggctagtgtggggtcatggcccacgacctggcctgtttctggagcctcttctgcacctaggagcccaggacccccacagtggtggcttacttttccccatcctcaaggacctggtactcattgaggtggaaatgactcatgcaacagttggtgaatttgtaaagcaggagtggcatttcaacaggccacaaggacaaagtgacaaaggcgtgcgtcaggtcagatgcctcctgaagcccaacgatggaccattctcacccgtaaacatgcctttcccatatgcataggtgcaccccttgggattctggggctgtcagtccctttgtgtatggtgccagggcaggcagctcacgttctggggagtgacacatgggtatatgccatcttcatgcctggctccccatggagtctccaggaaccccagcctgttagggccacatgagagagaacaaatggctgtgggtgcatggggagggacctttcacacagggccatagctaagtagggtcttgaggatgcaggggttagacaggtgggtggagagagggcaggacctgcctggcagatggaacagcctggtcagatacttggatgtgcctgtcctgcctgggccataatgagtttctgcagtggcggctcatttggagcgtttgttgggttgggaggtgaccaggggtccccattgtgaagatcctgatgtaaatgaggaaaggaactttaagggaactgtggaaggggttctgaggtgggaccagatttcagtttagaaatatccatttggcttccagtggagatgtgccaggtgacaccaaggaggggcctgtttaggggcaatggagtgggcagctgggggctgggttcatacacgtgcacacacacgcatacacaggcacacatgtgtgcaatggatttggggaggaggcatttcaggatgctgaggtttccagtttgagcaagaggagggtgaggccactacctgggtcaaggtgaatggcatgttcagcaggtgcagaaagggccacctgccacagggtttggctgggaccagtgaaacctacttcatgaagagactttcttctgtgtcacgtgcagattcttatgcattcacgctggctgggtgccactctgtgctacctccatgctgccctggcttgccaggatggcaggccgggctgggctcagccaagctcccactcacctcatcgtcactgagatgagtatttgcagagcggtgctgaaatccaacacctgtgtcttggctggggccccagatgattctcctggctaaaccacgatccttgtctccctagcccagttgcacagctgctgctgacaggtctacctgaagtgactgcagcctcatttctgattggaactggagacccctcccaaccccctttgctgtgccctctcctggaacagccctgatgcctgcagtggtttagggccccagagcatggccagcggtttagtttacagatctcctccccttggactctagatttctggccagactttctgggtccctttcaggccctgctctgggaggtgttggagttcactgttgatgtgtttgtttggctttgaattcaaaacagatacaaatttggaggtgagagctttgccagaccccagcagggatggggcatcggtcctgactggtcttgtttattttgtcctggtaaattctgttctttggagcataaaccctggagtcctagagccccttgcctcagcaggaatcccccctctgtctgctccaggggctccctgcttctgcccacctgctctccttccatggcattcaggacccccgacagctgaagcctctcttcatatagcttgtcccctctgggcctgcctgtcttgtgtccaggacacaagacacgcatcccttgtctggccccaggctgccatcactgtcacaagaaactcatagagtagagctggtctgaggtcacagtgctggtggtggtggaaaagcagggatggcctgttccactgtgatcttacctcctgtgtcacctggattgggtctctgtccccttagacatgctagatcctaactttacaagggctgaaggggtcttctacacgcaggtcccaacactttgggctggggttggccaccgtagcttagtgggctaaagctggagtttgaatctggatatataggatccacacctatagccatgtgatcttgggcaagttacaagccttgatcatcttcctcatctgtaagatggggatgacaatggtgcctccttcacatgcttggtgtggagattaaatagaataacccaagtagtgcctggcactgagttagtgctcagcacacaggctggtagtgttgggcacccctctcatagccacattcaggggccacctcttaccctgccagcttggctgtgatcacagcccacatcccacttccttaaaagtcccttgttcagagcctctttccaggttcctcgccccacagctttgcaccctgcctgggacttggccctctggctggggcttctgaaaatgtagttcccagagtgcattgaggagggctaccctagccctcaccactcatcttgggctgggttccccagaagcttctgctgagatgaggatgctggagttattagggaggggagagcaagttaagggaggggcagaaggcaaggcagggtgtgatttcagtccaagtcagaccctaaaggggagccctggatgcagtcccacctcagagtaaggactacccaggggtgaagatgtagcctccaggcacttctgctctctggcaggcaggctaggaagctctaggagccccagggtaggtttctgctggagtcgtagggcctattttgggggaagttgtgcacagaaaccaccagagggagtcacaggcatctgggggtgcacccattgacatttgcatccatgtcatgccaagcttgtagcccacaaatgcccaacccttttctccatgcattgctctgtctcagttttgttcacgccaagcagccttggttagttaaatgcagagcttggcatttgcccatgttaaattccttctcctttttcattctggcctggcctggttttgccatctgaagctatgacaagtcctttatcagttttcatccaacttgtcaggcagggcagggctggtatgaagcccaggacatatcactgggacatcccataggtctgtgagattcccaggtccctccaaatccacacggtcatcatgggcaaattagtttaagtctgatctgttaagatccagatctctcacaccaacagcacacacccctttttcccatggccatggaaggagggtagcatagcctgactcgagtcctcgttctcagcagaactggttctgtggtggccacttccctttctcaacttttacctacttctgtttaataggttgttctgcaagtctgagagcaacagcaagcttagaagtgtggactcagcctggtacagtggctcatgcctgtaatcccagcactttgggaggctgaggtgggctgactgcttgagctcaggagttcgaaaccagcttgggcagcatggagaaatcccatctctacaaaaaatacaaaaattagctgggcatggtggtgtgcatctgtagcctcagctactcagggggttgaggtgggaagatggcttgagcccaggaggtggaggttgcagtgagccgagatagtgccactgtgctccagcctggatgacggagccagaccctgtttcaaaaaaagaaaaagacaagaaagaagtatggactctaccttcttgcccttgtggagattgggaactgcctgcccttggcctctttcctgtccatcttgtattatgaaaggctgtttctggcacacccgggctcctctgtgtggtttctgggaagtgactgagggtcaggggaatggagcccctctgcagccggccgctggtaccttccctattgaacccttctttaggtttgctcactctttttgatgggtgtctttccaaagctggctggggacctccctgattgagagacatggggccagttctgttgctgtggctacacgggaataataaagcagaagaacacctgaggaaagctgatgtttact

SEQ ID NO: 3949 - DNA, 1966 bp, Homo sapiens
ggaatgctgcctgctgctttgcccagagttggccctgagtgttcctatcaggccccgttcactctggggtggattaaaccacctcctggagggtgctgtatccccactgtgcaatgggggtttgtgctgtgtgcattcctgcctggtccttgagagttgctgacaggtggaacctgaggcagcaggacagcctggcattggccacgggacatcggccacaaccatagcaacttcggcatcaaatggggcaggagagagaacattaaggcagccatgagctccagccgccccgagccgggtccctgggcacccctgagcccccgccttcagcccctgtcccagagctcttccagcctgctgggtgaaggccgggaacagaggccagagctccgcaagactgccagcagcaccgtgtggcaggcccagctgggcgaggccagcaccagaccccaggccccggaggaagaggggaacccgcctgagagcatgaagccagcacgggcctctggccccaaggcgcgacccagtgctggaggccactggtggagcagcactgtgggcaatgtgtccaccatgggcggcagtgacctgtgtcgcctgcgggcccctagtgctgctgctatgcagaggagccattcagacctggtccgtagcacccagatgcggggacacagtggtgctcggaaggccagtctcagctgctcagcccttggcagcagccctgtccacagggctcagctgcagccaggtggtacttctggccagggtggccaggcccctgcaggcctggaaagggacctggctcctgaggatgagacttctaactcagcctggatgctgggggcgagtcagttgtcagtgccaccactagacctgggggacacaactgcccacagcagcagtgcccaggctgagcccaaagctgctgaacagctggctaccaccacctgccatgctctgcccccagctgctctactctgtggcatgagggaggtgagggctggtggctgctgccatgccctacctgccacagggatcctggcctttcccaaactagtggcgtcagtgagcgagtctgggctgcaggctcagcatggggtgaagatccactgtaggttgtctggggggctccctgggcattcccattgctgtgcccacctttggggtcccgctgggttagtcccagagcctggctctaggaccaaagatgtgtggaccatgacctcagccaatgacttggcccctgcagaggcatccccgctgtcagcccaggatgctggtgtgcaggcggccccagtggcggcctgcaaggctgtggccaccagtccgtccctggaagcgcctgcagccctgcatgtgttcccagaggtaactctggggtccagcctggaggaggtgccgtcccctgtgcgggatgtgcgatgggatgctgagggcatgacatgggaggtgtacggagctgcggtggacctggaggtgctcggtgtggccatccagaagcacctggagatgcagtttgagcagctgcagcgggcgcccgccagcgaggacagcctgtctgtggagggccggagggggccactgcgggctgtcatgcagtccctgcggcgccccagctgctgcggctgctccggcgcggcccccgagtgaggagctgtggcccttggagctggcctgggcccactgacttagtcctagacctgggccagggacggtgggggctccgtgccccctggacccaccggcagctgggcacatctctcacctgaatattggctgcctccagaccacaggactgcagcctggggcttccggccctacacagctgggctgttttcttaagggcttgatttccaagggccacatctctgcaccttccgggctctgaactttgagacagggctttagcactgtgcagaggggagatcctgagttttctgtaaaaaatgaccttttgttcactcca

SEQ ID NO: 3950 - DNA, 1966 bp, Homo sapiens; identical to SEQ ID NO: 3949

SEQ ID NO: 3951 - DNA, 2013 bp, Homo sapiens
ccgccgcggtcgggctgccccctcccctcgccccgaccgctcccctgctggtgagggcctgcggaggcggcggcggcggcgcccttggtggcagtggtggcggcggagcagcctcccgggatcgtgtccggagctcgaggagagggtggtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaagaaaaggattatagcagtctttgtgacaagcaaccgataggaagacgtctcttcaggcagttctgtgataccaaacccactctaaagaggcacattgaattcttggatgcagtggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactagagttgcccataactacctaagaggggaaccatttgaagaataccaagaaagctcatatttttctcagtttttacaatggaaatggctggaaaggcaacccgtaacaaagaacacatttagacattacagagttctaggaaaaggcggatttggagaggtttgcgcctgtcaagtgcgagccacaggaaaaatgtatgcctgcaaaaagctacaaaaaaaaagaataaagaagaggaaaggtgaagctatggctctaaatgagaaaagaattctggagaaagtgcaaagtagattcgtagttagtttagcctacgcttatgaaaccaaagatgccttgtgcttggtgctcaccattatgaatggaggggatttgaagtttcacatttacaacctgggcaatcccggctttgatgagcagagagccgttttctatgctgcagagctgtgttgcggcttggaagatttacagagggaaagaattgtatacagagacttgaagcctgagaatattctccttgatgatcgtggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgttactcaccaagaatccaagcaagcggctgggctgcaggggcgagggagcggctggggtgaagcagcaccccgtgttcaaggacatcaacttcaggaggctggaggcaaacatgctggagccccctttctgtcctgatcctcatgccgtttactgtaaggacgtcctggatatcgagcagttctcggtggtgaaagggatctacctggacaccgcagatgaagacttctatgctcggtttgctaccgggtgtgtctccatcccctggcagaatgagatgatcgaatctgggtgtttcaaagacatcaacaaaagtgaaagtgaggaagctttgccattagatctagacaagaacatacataccccggtttccagaccaaacagaggcttcttctatagactcttcagaagagggggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaacatgccttgggagtgtacagac

SEQ ID NO: 3952 - DNA, 2068 bp, Homo sapiens
ttcagctaagccgttagcgccgagcccgcccgggagcgggtcgccggccgcggcgggcgcccctgccagtgagcccctgtccgaagtgagccacggcattgactcggggctgcccgggggcagggcactgaggagggagttgcgcgcgcgaggcgagggcgatggggccaagaagaaccggggcgatagcgcggcagcggtgacagctgggacccgccgcggtcgggctgccccctcccctcgccccgaccgctcccctgctggtgagggcctgcggaggcggcggcggcggcgcccttggtggcagtggtggcggcggagcagcctcccgggatcgtgtccggagctcgaggagagggtggtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaagaaaaggattatagcagtctttgtgacaagcaaccgataggaagacgtctcttcaggcagttctgtgataccaaacccactctaaagaggcacattgaattcttggatgcagtggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactagagttgcccataactacctaagaggggaaccatttgaagaataccaagaaagctcatatttttctcagtttttacaatggaaatggctggaaaggcaacccgtaacaaagaacacatttagacattacagagttctaggaaaaggcggatttggagaggtttgcgcctgtcaagtgcgagccacaggaaaaatgtatgcctgcaaaaagctacaaaaaaaaagaataaagaagaggaaaggtgaagctatggctctaaatgagaaaagaattctggagaaagtgcaaagtagattcgtagttagtttagcctacgcttatgaaaccaaagatgccttgtgcttggtgctcaccattatgaatggaggggatttgaagtttcacatttacaacctgggcaatcccggctttgatgagcagagagccgttttctatgctgcagagctgtgttgcggcttggaagatttacagagggaaagaattgtatacagagacttgaagcctgagaatattctccttgatgatcgtggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgttactcaccaagaatccaagcaagcggctgggctgcaggggcgagggagcggctggggtgaagcagcaccccgtgttcaaggacatcaacttcaggaggctggaggcaaacatgctggagccccctttctgtcctgatcctcatgccgtttactgtaaggacgtcctggatatcgagcagttctcggtggtgaaagggatctacctggacaccgcagatgaagacttctatgctcggtttgctaccgggtgtgtctccatcccctggcagaatgagggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaaca

SEQ ID NO: 3953 - DNA, 1018 bp, Homo sapiens
tcccctgctggtgagggcctgcggaggcggcggcggcggcgcccttggtggcagtggtggcggcggagcagcctcccgggatcgtgtccggagctcgaggagagggtggtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaagtcctctgcatcccgccacaaaagcatcagttggtccagcccttcagcgggagacccccacaatcctctgtgcaatcctctgtctcggacctcatgtctcccttgcctgcgtctcaagagagctggcgacagagcctcggacctcaagtccctgtgctagccacggtagttcttcacaccccgtcactcttacggaattgctgatttcctctatttccttgcgtgatggagcagctctgctcggactgtgctccaggacagtgtaaatgccgactgaagatgccacagcagccggcgatgcatatttaaaggacagtctggagccgaaggtggcggccacgcttgtagtcccagctactctggaagctgaggtggaaggctcacttgggcccaggagagtccagcctgggcaaaacacagcaagaccatctctttaaaaaagtctaaaacaaagacttcatcttctcagtatttttgtgcaccaactcacactattttgaatagaagaactgagaatgggtgggaagagaatgggatctttttcccttaagataatcagggagtcccagagcagtatgcgttctcagcagccattttcagtggagcatttgactgtgcctcttatccctgactgtgaactccaaataggtcatggaaaataatcatccttagtggaagtcagattgaagctaagccagttttctttttacactaccttcctatctgcatgtaatttacaaaaaggaactataccaag

SEQ ID NO: 3954 - DNA, 1971 bp, Homo sapiens
ccgccgcggtcgggctgccccctcccctcgccccgaccgctcccctgctggtgagggcctgcggaggcggcggcggcggcgcccttggtggcagtggtggcggcggagcagcctcccgggatcgtgtccggagctcgaggagagggtggtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaaggaggatatggcaaaaaaagtggtcgtagtaaaaaatggaaggagatactgacactgcctcctgtcagccagtgcagtgagcttagacattccattgaaaaggattatagcagtctttgtgacaagcaaccgataggaagacgtctcttcaggcagttctgtgataccaaacccactctaaagaggcacattgaattcttggatgcagtggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactagagttgcccataactacctaagaggggaaccatttgaagaataccaagaaagctcatatttttctcagtttttacaatggaaatggctggaaaggcaacccgtaacaaagaacacatttagacattacagagttctaggaaaaggcggatttggagaggtttgcgcctgtcaagtgcgagccacaggaaaaatgtatgcctgcaaaaagctacaaaaaaaaagaataaagaagaggaaaggtgaagctatggctctaaatgagaaaagaattctggagaaagtgcaaagtagattcgtagttagtttagcctacgcttatgaaaccaaagatgccttgtgcttggtgctcaccattatgaatggaggggatttgaagtttcacatttacaacctgggcaatcccggctttgatgagcagagagccgttttctatgctgcagagctgtgttgcggcttggaagatttacagagggaaagaattgtatacagagacttgaagcctgagaatattctccttgatgatcgtggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgttactcaccaagaatccaagcaagcggctgggctgcaggggcgagggagcggctggggtgaagcagcaccccgtgttcaaggacatcaacttcaggaggctggaggcaaacatgctggagccccctttctgtcctgatcctcatgccgtttactgtaaggacgtcctggatatcgagcagttctcggtggtgaaagggatctacctggacaccgcagatgaagacttctatgctcggtttgctaccgggtgtgtctccatcccctggcagaatgagggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaacatgccttgggagtgtacagac

SEQ ID NO: 3955 - DNA, 3566 bp, Homo sapiens
gcggccctagtggctggtctttcctgtgcttgggatgttggccttgtagagttacttctgtaatctcaagacagaaactgacagctttgtttgatcaaaattgttacttcaccttgcacattttcaagagttctacaggtttaatgagcacagaaatctgggggaactttcactctccagggctccttcatagaggttctcaaatactccatcagcagaggggagccccagatggcaaaaggacacaggatatgtcatctttcaaatgaaccaataatccattatttgattcttctacctttgtcaaaattcctccagcaacgcctgcagaaaatcacaattcttgatacatagcttgttccaataaagcaccacagcatttctagtgactgcaggcccagctgtcaaactctttcaacttgatagagaatatgtacacaaaacctatagctgtcatcatacttaatagtgaaaaacagaatgttttccagctgacactggggacaaggtaacagtgtcagttcctgccgctcttattcaacacagaaattttagtcatcatactaagacacacaaaaaaaggaataaaaagccacgcagactggaaaggtagaaataaaactctccatatttgcagatgacatgattatctacatggaaaatgccaagtaatacacaaataacctcttaaaattaataggtgagtttgccaaggtcacaggatatgagatcaacatgagaaacacaatcacatttctgtatgctaacaacaaacatgtaaaaactgaaataaaaataataacagtttaaatctcttgagagcaaaggaaatatttaagtataaacctaacaaaacgtgataggatctgatgttgaaaaaatcacacaattctgatgaaagaagtgaaaaaaaaaaaactatttaaatagacagacataccatgttcgtgggttggaagattcaacataataaggatacaattctcaatttgatccataggttgattgcaattcctctcgaaataccaacatggctttttgtagaaacagacaagtttattctaaattttatgtgggaaggcacaagccctagaatactttaaacttgacaaagaagaataaagtgtgtggctgtaaaaccaaactgtaaaaaattaacagttcattgcttgcagtcgaaaaaatgaggaaaagatggacgatctaggaaactttcagggagctaaggtgtcggagagcaaagtatccttgtaaggaatgagacaagataaactccctcccccacacacagtattttcagagaactacattcttggtttcaacctgatgtcataggctgtgttctttgcaacggaagaagcaaagacttcaaagggagaaatcggaagatttcttttttcatcgtagggacttcacatcagcgtttccaaaaccgagtccatcgccttttccctctgcgcagcctctatcccttcctgtgtttcgcatctcaataaacgtccccgccaagtgacttcagcctgaaacatgcggcctcccggactcctctctgtgtcaccgacctcttgcgctcagttctccggagctgccggtttaacctcgcaagtcttcccggaacccgtgccctcctcctgggcagcgttaccaccacgagcgcctacctgagaggacgcctgttctcatccagcctccaccctgcagccgagcaatctccgtaaaacgaacacctggcttagtttctgctggaaaccgttgaatagtccccactgtcttctggaagggtctgggcagctcggcgtggcgtccacggccccaccaggcctctgcctcctgcaggtcccgctacttcgtcaccaaagcgcccgccgcgctcgcatctgctgtgaggctgtgctcgggccgctcccgccgagggaacggccctcccaaggctctgcgccccaattctcgctcgtttgccaagaggtagccgtgtcggggagctagagttctccggggactctctcctgcccctcgtggccctctgtggaaccctcgttttaggatctgcacgccgtttccagtcgcgcgcgcggcacggagaccgcccgctgtgccccgcgctgcgctctctccgcccctctcccgcgcaggcctccctgtgccagccggctgtcgacccaggttaggaagcccgaggtcggggcgttaccccaagggccctcccgcttcccctccgagggcagagaggcgtccgcgcccggacgcactgcgggaacacctggagcgccggcggagctcggctgtccccgcgggagggagcccgacgcgcatccttgggacccggacccggcgcccgcgcctcgggacggatttctgcctcggctgcaggcgcagcgcgcagacctgagcctgccccgcggaaccggggctcgagtcccggcccgagcgcggcgtcggggccagcggagaggggcggaagccgcaagggaccctcggcgcctcggcctggccgcgatgaagtccccgcccctcctcagcccgtgtctctcctggaagagaatggcgggcatctttttcctgccatttatctcatcaggttttgctcctcggtttaagcaggaagagaacttcatgcttggaagagcgcatccgtcccagcctaggtttaattggtctcatctgacccctctggagctgaagaatcgatctgtgggacttggaactgaaagcacaggtcggggtaagccccacttcacactggagggccacaagttcctgatcttcgggggctccatccactatttccgggtgcccagggagtactggagggaccgcctgctgaagctgaaggcctgtggcttcaatactgtcaccacctatgttccgtggaacctgcatgagccagaaagaggcaaatttgacttctctgggaacctggacctggaggccttcgtcctgatggccgcagagatcgggctgtgggtgattctgcgtccaggccgctacatctgcagtgagatggacctcgggggcttgcccagctggctcctgcaagacccccggttactgttgaggacaaccaacaagagcttcattgaagcagttgagaagtattttgaccacctgattcccagagtgattcctctccagtaccgccaggcaggccctgtcatcgcggtgcaagtggagaatgagtatggctcattcaataaggataaaacatacatgccgtatctccacaaggccctgctgagaagagggattgtggagcttctcttgacctctgatggtgagaaacatgtgctgagtggccacaccaaaggagtgttggccgccatcaatttgcaaaaacttcaccaggatactttcaatcagcttcataaagtccagggagccagtatagatgcaggactgctctcagatgcctcacaagcagcaacttcttcctccttatagttcttatctgtgattcttccataattttgtccttctaagcttctgatgcactgaattatgtaaagtgcattcccttcaccagcttgtgcaccctattctgtaactgataataaatggttggtattgca

SEQ ID NO: 3956 - DNA, 2583 bp, Homo sapiens
atgaagtccccgcccctcctcagcccgtgtctctcctggaagagaatggcgggcatctttttcctgccatttatctcatcaggttttgctcctcggtttaagcaggaagagaacttcatgcttggaagagcgcatccgtcccagcctaggtttaattggtctcatctgacccctctggagctgaagaatcgatctgtgggacttggaactgaaagcacaggtcggggtaagccccacttcacactggagggccacaagttcctgatcttcgggggctccatccactatttccgggtgcccagggagtactggagggaccgcctgctgaagctgaaggcctgtggcttcaatactgtcaccacctatgttccgtggaacctgcatgagccagaaagaggcaaatttgacttctctgggaacctggacctggaggccttcgtcctgatggccgcagagatcgggctgtgggtgattctgcgtccaggccgctacatctgcagtgagatggacctcgggggcttgcccagctggctcctgcaagacccccggttactgttgaggacaaccaacaagagcttcattgaagcagttgagaagtattttgaccacctgattcccagagtgattcctctccagtaccgccaggcaggccctgtcatcgcggtgcaagtggagaatgagtatggctcattcaataaggataaaacatacatgccgtatctccacaaggccctgctgagaagagggattgtggagcttctcttgacctctgatggtgagaaacatgtgctgagtggccacaccaaaggagtgttggccgccatcaatttgcaaaaacttcaccaggatactttcaatcagcttcataaagtccagagagataagccccttctgattatggaatactgggtcggctggttcgacagatggggagataagcaccatgttaaagatgcaaaggaggttgaacatgctgtgtctgaattcatcaaatatgagatctccttcaatgtatatatgttccatggtggaaccaactttggtttcatgaacggggccacatatttcgggaagcactcgggcattgtcaccagctatgactatgatgcagtgctcacggaggctggagattacacagaaaaatatctgaagcttcaaaaactctttcaatctgtctcagcaactcccctgccccgagtacccaaacttcctcccaaggctgtgtatccccccgtgagaccgtcgctgtacctcccgctgtgggacgccctatcctacttaaatgagccagtcaggtcgcgtcagcccgtcaacatggagaaccttcccataaacaatgggagcggccagtcctacgggcttgtcctgtatgagaagtccatctgctccggaggccgcctccgtgcccacgctcatgacgtggcacaggtgtttttggatgagacaatgatagggattctgaatgagaataataaggacctgcacattcctgaactcagggactgccgatacctgaggatcctggtggagaatcaaggacgagtcaatttttcatggcaaatacagaatgagcagaaaggaataactggatctgtcagcatcaataactcttccctggagggctttaccatctattccctggagatgaaaatgagcttctttgagaggctccgctctgccacctggaagcctgtcccagacagccaccagggcccggccttctactgtgggaccttgaaggctggcccttctcccaaggacaccttcctgagcctgctgaactggaattatggatttgtgttcatcaatggacgtaaccttgggcgatattggaatattgggcctcagaaaacactgtaccttcctggagtttggcttcatccagaagacaatgaggtcatcttgtttgagaagatgatgagtggctcagatatcaaatctacagacaagcccacgctgtaaaactgtgtctgaacatttttttttttttttgagatggagtctcactttgtcgcccaggctggagtgcagtggcacaatctctgctcactgcaagctcagcctctcgggttcacgccattctcctgcctcagcctccccagcagctgggactacaggtgcacgccaccacgcctggctaattttttgtatttttagtagagatggggtttcaccaagttagccaggatggtcccaatctcctgaccttgtgatctgctctcctcagcctcccaaagtactgggattacaggcgtgagccaccactcccggccgtgaacatattttttgggttgctggagttcatctataagtcatttttgaggaataagatttatgttaagactatcaaacacagtgttgcctacaatagcaaaaatgtgaaaataacaacaacaacaaaacagcagaggaattgttatgtattttgtagtctatctatatgatgcctatttttaggctttaaaaagtcttcaaaatctttaatgactgatttatctagttaaatgcttaatccttagcaggctcttattctttaattaaacgtgcctttgagtagatgtgaataaaataaaaacaagtttc

SEQ ID NO: 3957 - DNA, 835 bp, Homo sapiens
tcatagtatatccgtgagtcaagcggctgtgggtttttggctcttgcatctgctatagttctgtctcgggtgccatttgctaactctgttctctgtgtagctgcttttggcagctcctcatctctcttctaatccaccactcacagtcctagagaacagaccacaagttaagaccgtcacctacagaatcccaagggccaaaactgggcagaggacaactccatccttcttacaaaagggcttctccacaagaagcatttccgttagactctagcagtgagataccctgcttcaagaatttctcatggagccagaagcctttgaaatttgcccttatgatcctcaccaccgaatcccactcagcagattccagtaccacctggcatcgtgcaggagaaagaaccccaagaaagccaaaaagatggccacctgcaaatacaacgcctgccacgtggtccccatcaaaaatctggaggaacatgaggctgtttgtgtcaacaggagcgctgtggaagaagaggacaccgagaaccctctgaaagtcagtcctcctagttcagagcagaacgatgacacccagcaggtctcaccctgccttcccagccccgatatctggaatgtcgatggcgctaattgccagcatgtgtttgtccttaagactttttttcctcaaaaggttgtttgtgaaaatgacacgaaagagtcagcaagagagaccagtccccagaagatcctcagaccaggacagtaaactgccagctgaggaaggagcacacgcctcatcaatgcatggaagaacgtgcaatgcatcagaataaaagacatgcaaagtaaa

SEQ ID NO: 3958 - DNA, 459 bp, Homo sapiens
ctcatggagccagaagcctttgaaatttgcccttatgatcctcaccaccgaatcccactcagcagattccagtaccacctggcatcgtgcaggagaaagaaccccaagaaagccaaaaagatggccacctgcaaatacaacgcctgccacgtggtccccatcaaaaatctggaggaacatgaggctgtttgtgtcaacaggagcgctgtggaagaagaggacaccgagaaccctctgaaagtcagtcctcctagttcagagcagaacgatgacacccagcagactttttttcctcaaaaggttgtttgtgaaaatgacacgaaagagtcagcaagagagaccagtccccagaagatcctcagaccaggacagtaaactgccagctgaggaaggagcacacgcctcatcaatgcatggaagaacgtgcaatgcatcagaataaaagacatgcaaagtaaa

SEQ ID NO: 3959 - DNA, 2436 bp, Homo sapiens
actccagtctcctgggactttgactcgccgtactcggcgcgctcctgctgagggtcgccggagatgtcgctcggccgccttctaccaggagcctgatccgtgccgcccgccgcccggatgggaccaccagagtgctctaaagtctccagtgaatattgaattgctgaggattttgggaaaagacaaatcaaagttcccattccatggatcccttaggtgcaccttcccagtttgtggatgtggatacactaccaagctggggtgactcatgccaagatgaattaaattcctctgatactacagctgaaatatttcaggaagacactgttcgatcaccttttctttataataaggacgtcaatggaaaagtggttctttggaaaggagatgtggcattactgaactgtacagccattgtgaataccagcaatgaaagtctcacagataagaatcctgtgtcagaaagtatcttcatgcttgcagggcctgatttgaaggaagatctccagaaacttaaagggtgccgaacaggtgaagcaaaattgacaaaaggattcaatctagctgcccggttcatcattcacacagtgggacctaaatataaaagccgctatcgcacagcagctgagagttccctttatagctgctacagaaacgtacttcaactagcaaaagagcagtcaatgtcttctgttggcttctgtgtcatcaattctgcaaaacgtggttatcctttagaggatgcaacacacatagcacttcgcactgtaagaagattcctagagattcatggggaaaccattgaaaaagtagtatttgctgtctctgatcttgaagagggtacttaccaaaagctgctacctctctacttcccaaggtcattaaaagaggagaatcgatcattgccctacctacctgcagatattggaaatgcagaaggggagcctgtggtacctgaacgacagattagaataagtgagaaacctggtgctccagaagataaccaagaagaggaggatgaaggcttgggagttgatctctctttcattggctctcatgcttttgctcgaatggaaggagatattgacaagcaaagaaaactgatccttcagggacaattatcagaggcagctctgcagaagcagcatcaaagaaattataatcgctggttatgtcaagcaagatctgaggatctgtctgatattgcttctctaaaagccttataccaaacaggtgttgataactgtggtcgaacagtgatggtggtagttggaagaaacattcctgtaacattaatagatatggacaaggctctcttatatttcattcatgtaatggatcacattgctgtgaaggagtatgtattagtgtattttcacaccctgaccagcgaatacaatcacctggactccgacttcctgaagaaactctacgatgttgttgatgtcaagtacaagaggaatttgaaggctgtttattttgtacatcccacatttcgttcaaaggtgtcaacatggttttttaccaccttttctgtctcaggactgaaggacaaaatccaccatgtggacagcctccaccagctgttttctgccatatcaccagaacagattgactttcctccttttgtccttgaatatgatgccagggtaagaagtaccagaagttctccctcacctggtatggtatattaactgttctatagagcagcacttacgagcacaacatcctgtcattaccagatattaatgtaaattagtgagtcttaataaacttggtaatatcatttaacatactttccctatgataactttaggaaaaggatttgtcccaagagaggcattttctccagataaacgtttcagtgggagatctctctgctgtgagttcagaaccaattttcgtttgtattgtaagttttctaccatatttaaaacagatacctctgcctaattttcttaagattgaatggctttccatctacacagagccagaagaatttattggtgatcacttttagaattaattgcaaatcatgtggcctatctcagtagtctttaccctgctaaaagtttcatttatctaaaaggttgtataatgtttttaagagcatcatctgataatattattgttgttatttatagatgcgtttatggatctgttacataagcactagtcacaggactactcgtgaatttcatcaatttattctattgtgtttattcatgatatcaccttagtaatttttgaaaaaaaaaaagtaacacacttggccaaaagctcatcaagctgattgtttaactgttgctgattgcttatctttatattgtatgaaccaggggatagatttgaaagttatattaagtttgaaatgaattattcttccctaattattgtgcagtgtttatacagcaaaataaaaattctgcaacacaa

SEQ ID NO: 3960 - DNA, 2898 bp, Homo sapiens
aggagcggaagccggtgtttcgcagcccagagcatttgcagctggtcactccagtctcctgggactttgactcgccgtactcggcgcgctcctgctgagggtcgccggagatgtcgctcggccgccttctaccaggagcctgatccgtgccgcccgccgcccggatgggaccaccagagtgctctaaagtctccagtgaatattgaattgctgaggattttgggaaaagacaaatcaaagttcccattccatggatcccttaggtgcaccttcccagtttgtggatgtggatacactaccaagctggggtgactcatgccaagatgaattaaattcctctgatactacagctgaaatatttcaggaagacactgttcgatcaccttttctttataataaggacgtcaatggaaaagtggttctttggaaaggagatgtggcattactgaactgtacagccattgtgaataccagcaatgaaagtctcacagataagaatcctgtgtcagaaagtatcttcatgcttgcagggcctgatttgaaggaagatctccagaaacttaaagggtgccgaacaggtgaagcaaaattgacaaaaggattcaatctagctgcccggttcatcattcacacagtgggacctaaatataaaagccgctatcgcacagcagctgagagttccctttatagctgctacagaaacgtacttcaactagcaaaagagcagtcaatgtcttctgttggcttctgtgtcatcaattctgcaaaacgtggttatcctttagaggatgcaacacacatagcacttcgcactgtaagaagattcctagagattcatggggaaaccattgaaaaagtagtatttgctgtctctgatcttgaagagggtacttaccaaaagctgctacctctctacttcccaaggtcattaaaagaggagaatcgatcattgccctacctacctgcagatattggaaatgcagaaggggagcctgtggtacctgaacgacagattagaataagtgagaaacctggtgctccagaagataaccaagaagaggaggatgaaggcttgggagttgatctctctttcattggctctcatgcttttgctcgaatggaaggagatattgacaagcaaagaaaactgatccttcagggacaattatcagaggcagctctgcagaagcagcatcaaagaaattataatcgctggttatgtcaagcaagatctgaggatctgtctgatattgcttctctaaaagccttataccaaacaggtgttgataactgtggtcgaacagtgatggtggtagttggaagaaacattcctgtaacattaatagatatggacaaggctctcttatatttcattcatgtaatggatcacattgctgtgaaggagtatgtattagtgtattttcacaccctgaccagcgaatacaatcacctggactccgacttcctgaagaaactctacgatgttgttgatgtcaagtacaagaggaatttgaaggctgtttattttgtacatcccacatttcgttcaaaggtgtcaacatggttttttaccaccttttctgtctcaggactgaaggacaaaatccaccatgtggacagcctccaccagctgttttctgccatatcaccagaacagattgactttcctccttttgtccttgaatatgatgccagggaaaacgggccttactatacatcatatcccccatcaccagatttgtgacctgccatctttcagtgcttcttggttcccaggatgccacttcctccacgaatagctacctgttgaagtgatattcattgttgctgtacagatccagagagccttttgtccccacctctctggtatttttttattgactgtatattttctggcacataagcaatctaaaaatggtaggccattctgaactgcacacattttaaatttgtatatttatatgaaatggaaatgttcatttttagattgttaatagaaattggggagcaacttttgagtatctttagtttcctgaaggacaccgaattctccattagataaaccaccaagactgttcacatcatctctctaacattgcacgcttcctttgtgtacttaagtgattctcgaaatatacagaaccaatgtatgctaaccagatgcattgtttgcttcagatccatggtgttaataccatgtatattttataaagataatttggctgtgttaaaagagaattacctgagtccaagaatgtggaaatgtatctgacaaaaaacatcaaaatcattagcaaaacataggacttagaatgttaatgtacaagttaagactaaagtttaaggactaaggttccttggattatatgacttgttaagattgccacagttccgatctcaacagtgtggggtgaaacaagaagactgtatcttcagcctttttcctataatcatggatgatttggtcttattcaaaaggaccgcacatattagtactcttaagagcatcttccaagactccagcagtgagcatttagagagtgtgttgtcttccagagtcatgaatgattttgtttagctatcaggtctactacctctaaggacatttcatagcagcatctcttgagttgcctgcatcagtgtggaggaagtgtgtcacagtgaacaaatccagggagctgataattggcaaaagaccacttttaccactcaggctctatttgtgccttagcttggttatgagtaaaaattagaattatgctgcctacctcacagaggtatcatgaagatagcatttagaaagggctttgttgtggtggggtatcttcagttagtttttaaatgggaataaatatatatgagggaatgctacacagcactcctcttgtccttgatacc

SEQ ID NO: 3961 - DNA, 1093 bp, Homo sapiens
gatgctgggcgagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggagagcacgtggtggccctgatgcccgaggtgggcagcctgcagcacgcacgggtgctgcagtaccgggagctgctggacgcactgcccatggatgcctacacgcatggctgcatcctgcatcccgagctcaccaccgactccatgatccccaagtacgccacggccgagatccgcagacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtctcaagatggaactgtggagactggttaggatctgagggaactcttccacaggacaaagccgacatcaagactcaactcctctaa

SEQ ID NO: 3962 - DNA, 2265 bp, Homo sapiens
gcaggctcggcgaggccatgtgatgctgggcgagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggagagcacgtggtggccctgatgcccgaggtgggcagcctgcagcacgcacgggtgctgcagtaccgggagctgctggacgcactgcccatggatgcctacacgcatggctgcatcctgcatcccgagctcaccaccgactccatgatccccaagtacgccacggccgagatccgcagacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctgactgtcggtgtctctgtgctgtgtgattccccgtgagctctcagtaactcactgtctcatgaacacttggacagccctccccgcccttcgttctgagtaataataccgtcagtgtgaaaacattccgtagtttagaagtagacgttgccaatgctgtgactcaaggccacggctctactaaaagagagagaggaagcgagagagagagagaaaaaacaaaaaacagaaaacacgaatgccttttctatcgattcaaggtctcaagatggaactgtggagactggttaggatctgaggtgagtcccaggatgtttcgtccaccagggcccagattctgggaggtgctggggactcagagggcctgacccctcacctccccttccctcttgcccagggaactcttccacaggacaaagccgacatcaagactcaactcctctaaccggtacctctgaatggggctggataaccggagaccccatgggaggtccctgaagatcagaaggggcttcacgcttctcctggacatggactagcttgagccaaggcagtggcacccaaaaaccaggctgcagtggggacggataccatgagcacaccctctcattgtccttctgatttggtccatgtgttgggtttggccttagtagaaatctctgaaggcagcagccatcatcctcttcctaccttgagtttttctaccctgtgaggtgggactttcagtaaaagccatgttgaccctctctcagaaggtcagtccagcccaagtgcaggggcggatctggaggtggacaaacctaggtccccctcctagcctctgtccaagccatctccttcaatatcccccccttcctgtcactcccggggctgtccctgtactacacggtgccatggagccggggagagcggggaagtctctgcatccatgccacccaccccagtcgggtctcactttcctgtgccttttgcatgttgggaaagggtcttggtgtcactgccgctcatgcatagaaaccaccaaaagccccaataaagcatccaggaggaa

SEQ ID NO: 3963 - DNA, 2070 bp, Homo sapiens
gatgctgggcgagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggaggacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctgactgtcggtgtctctgtgctgtgtgattccccgtgagctctcagtaactcactgtctcatgaacacttggacagccctccccgcccttcgttctgagtaataataccgtcagtgtgaaaacattccgtagtttagaagtagacgttgccaatgctgtgactcaaggccacggctctactaaaagagagagaggaagcgagagagagagagaaaaaacaaaaaacagaaaacacgaatgccttttctatcgattcaaggtctcaagatggaactgtggagactggttaggatctgaggtgagtcccaggatgtttcgtccaccagggcccagattctgggaggtgctggggactcagagggcctgacccctcacctccccttccctcttgcccagggaactcttccacaggacaaagccgacatcaagactcaactcctctaaccggtacctctgaatggggctggataaccggagaccccatgggaggtccctgaagatcagaaggggcttcacgcttctcctggacatggactagcttgagccaaggcagtggcacccaaaaaccaggctgcagtggggacggataccatgagcacaccctctcattgtccttctgatttggtccatgtgttgggtttggccttagtagaaatctctgaaggcagcagccatcatcctcttcctaccttgagtttttctaccctgtgaggtgggactttcagtaaaagccatgttgaccctctctcagaaggtcagtccagcccaagtgcaggggcggatctggaggtggacaaacctaggtccccctcctagcctctgtccaagccatctccttcaatatcccccccttcctgtcactcccggggctgtccctgtactacacggtgccatggagccggggagagcggggaagtctctgcatccatgccacccaccccagtcgggtctcactttcctgtgccttttgcatgttgggaaagggtcttggtgtcactgccgctcatgcatagaaaccaccaaaagccccaataaagcatccaggaggaa

SEQ ID NO: 3964 - DNA, 2229 bp, Homo sapiens
gatgctgggcgagagagagccgccgcgccggagcctccttctttcctgcctctgattccgggctgtcatggcgacccccaacaatctgacccccaccaactgcagctggtggcccatctccgcgctggagagctgcggccaagccagcggaggcccccgacgctcccgaggcggccagccccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggagagcacgtggtggccctgatgcccgaggtgggcagcctggcacgcacgggtgctgcagtacgggagctgctggacgcactgcccatggatgcctacacgcatggctgcatcctgcatcccgagctcaccaccgactccatgatccccaagtacgccacggccgagatccgcagacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgagggagctggagaagaggaagctggagaacgaggggcagaaatgcgagctgtggctctgtggctgtgccttcacgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctgactgtcggtgtctctgtgctgtgtgattccccgtgagctctcagtaactcactgtctcatgaacacttggacagccctccccgcccttcgttctgagtaataataccgtcagtgtgaaaacattccgtagtttagaagtagacgttgccaatgctgtgactcaaggccacggctctactaaaagagagagaggaagcgagagagagagagaaaaaacaaaaaacagaaaacacgaatgccttttctatcgattcaaggtctcaagatggaactgtggagactggttaggatctgaggtgagtcccaggatgtttcgtccaccagggcccagattctgggaggtgctggggactcagagggcctgacccctcacctccccttccctcttgcccagggaactcttccacaggacaaagccgacatcaagactcaactcctctaaccggtacctctgaatggggctggataaccggagaccccatgggaggtccctgaagatcagaaggggcttcacgcttctcctggacatggactagcttgagccaaggcagtggcacccaaaaaccaggctgcagtggggacggataccatgagcacaccctctcattgtccttctgatttggtccatgtgttgggtttggccttagtagaaatctctgaaggcagcagccatcatcctcttcctaccttgagtttttctaccctgtgaggtgggactttcagtaaaagccatgttgaccctctctcagaaggtcagtccagcccaagtgcaggggcggatctggaggtggacaaacctaggtccccctcctagcctctgtccaagccatctccttcaatatcccccccttcctgtcactcccggggctgtccctgtactacacggtgccatggagccggggagagcggggaagtctctgcatccatgccacccaccccagtcgggtctcactttcctgtgccttttgcatgttgggaaagggtcttggtgtcactgccgctcatgcatagaaaccaccaaaagccccaataaagcatccaggaggaa

SEQ ID NO: 3965 - DNA, 722 bp, Homo sapiens
tcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggaggaccccgcctggcagcaagtctggagctgagaggagctaaccctcggggacagcttggcagagcccagtgaggagagatggccgggccaccactagaatcccctgtccgccagcagccaagcccgagcatgggggtgcccagggcctctgggcagagacatcttggggctcagggatgccgggggcaggtggccggggcaggtgcccctctggcttccctgcccagcccctggcggtgcccacagagcacgtggtggccctgatgcccgaggtgggcagcctgcagcacgcacgggtgctgcagtaccgggagctgctggacgcactgcccatggatgcctacacgc

SEQ ID NO: 3966 - DNA, 880 bp, Homo sapiens
tgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggaggacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcc

SEQ ID NO: 3967 - DNA, 826 bp, Homo sapiens
gtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggagagcacgtggtggccctgatgcccgaggtgggcagcctgcagcacgcacgggtgctgcagtaccgggagctgctggacgcactgcccatggatgcctacacgcatggctgcatcctgcatcccgagctcaccaccgactccatgatccccaagtacgccacggccgagatccgcagacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgagggtgggtgccagccctgggggaggtgggggctgcagcccacccagcctactcttcccctgcccagtctcagcctcttttttccgcaaaagtctcagaggacctcccaggtggttaagaggatgggctatggagtcagactaaggttcaagtcataacttggccacttcctagcttagtaaatgtggtcaggttctcccctctctgaaattcagtttcccatctataaa

SEQ ID NO: 3968 - DNA, 538 bp, Homo sapiens
ttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtctcaagatggaactgtggagactggttaggatctgagggaactcttccacaggacaaagccgacatcaagactcaactcctctaaccggtacctctgaatggggctggataaccggagaccccatgggaggtccctgaagatcagaaggggcttcacgcttctcctggacatggactagcttgagccaaggcagtggcacccaaaaaccaggctgcagtggggacggataccatgagcacaccctctcatt

SEQ ID NO: 3969 - DNA, 952 bp, Homo sapiens
acccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgaggcggagctggagaagaggaagctggagaacgaggggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctgactgtcggtgtctctgtgctgtgtgattccccgtgagctctcagtaactcactgtctcatgaacacttggacagccctccccgcccttcgttctgagtaataataccgtcagtgtgaaaacattccgtagtttagaagtagacgttgccaatgctgtgactcaaggccacggctctactaaaagagagagaggaagcgagagagagagaga

SEQ ID NO: 3970 - DNA, 2231 bp, Homo sapiens
gatgctgggcgagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgctcccgaggcggccagccccattggcccagggagagcctggttctgtaccactggacccagtccttcagctcgcagaaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggagagcacgtggtggccctgatgcccgaggtgggcagcctggcacgcacgggtgctgcagtacgggagctgctggacgcactgcccatggatgcctacacgcatggctgcatcctgcatcccgagctcaccaccgactccatgatccccaagtacgccacggccgagatccgcagacatttagccaatgccaccacggacctcatgaaactggaccatgaagaggagccccagctctccgagccctacctttctaaacaaaagaagctcatggccaagatcttggagcatgatgatgtgagctacctgaagaagatcctcggggaactggccatggtgctggaccagattgagggagctggagaagaggaagctggagaacgaggggcagaaatgcgagctgtggctctgtggctgtgccttcacgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctgactgtcggtgtctctgtgctgtgtgattccccgtgagctctcagtaactcactgtctcatgaacacttggacagccctccccgcccttcgttctgagtaataataccgtcagtgtgaaaacattccgtagtttagaagtagacgttgccaatgctgtgactcaaggccacggctctactaaaagagagagaggaagcgagagagagagagaaaaaacaaaaaacagaaaacacgaatgccttttctatcgattcaaggtctcaagatggaactgtggagactggttaggatctgaggtgagtcccaggatgtttcgtccaccagggcccagattctgggaggtgctggggactcagagggcctgacccctcacctccccttccctcttgcccagggaactcttccacaggacaaagccgacatcaagactcaactcctctaaccggtacctctgaatggggctggataaccggagaccccatgggaggtccctgaagatcagaaggggcttcacgcttctcctggacatggactagcttgagccaaggcagtggcacccaaaaaccaggctgcagtggggacggataccatgagcacaccctctcattgtccttctgatttggtccatgtgttgggtttggccttagtagaaatctctgaaggcagcagccatcatcctcttcctaccttgagtttttctaccctgtgaggtgggactttcagtaaaagccatgttgaccctctctcagaaggtcagtccagcccaagtgcaggggcggatctggaggtggacaaacctaggtccccctcctagcctctgtccaagccatctccttcaatatcccccccttcctgtcactcccggggctgtccctgtactacacggtgccatggagccggggagagcggggaagtctctgcatccatgccacccaccccagtcgggtctcactttcctgtgccttttgcatgttgggaaagggtcttggtgtcactgccgctcatgcatagaaaccaccaaaagccccaataaagcatccaggaggaa

SEQ ID NO: 3971 - DNA, 1364 bp, Homo sapiens
gagaaagagcacatatttctccgtgggacactccttgtattggtgggtgagaaatgggcgactggagtttcctggggaacatcttggaggaggtgaatgagcactccaccgtcatcggcagagtctggctcaccgtgcttttcatcttccggatcctcatccttggcacggccgcagagttcgtgtggggggatgagcaatccgacttcgtgtgcaacacccagcagcctggctgcgagaacgtctgctacgacgaggcctttcccatctcccacattcgcctctgggtgctgcagatcatcttcgtctccaccccgtccctgatgtacgtggggcacgcggtgcactacgtccgcatggaggagaagcgcaaaagccgcgaggcggaggagctgggccagcaggcggggactaacggcggcccggaccagggcagcgtcaagaagagcagcggcagcaaaggcactaagaagttccggctggaggggaccctgctgaggacctacatctgccacatcatcttcaagaccctctttgaagtgggcttcatcgtgggccactacttcctgtacgggttccggatcctgcctctgtaccgctgcagccggtggccctgccccaatgtggtggactgcttcgtgtcccggcccacggagaaaaccatcttcatcctgttcatgttgtctgtggcctctgtgtccctattcctcaacgtgatggagttgggccacctgggcctgaaggggatccggtctgccttgaagaggcctgtagagcagcccctgggggagattcctgagaaatccctccactccattgctgtctcctccatccagaaagccaagggctatcagctcctagaagaagagaaaatcgtttcccactatttccccttgaccgaggttgggatggtggagaccagcccactgcctgccaagcctttcaatcagttcgaggagaagatcagcacaggacccctgggggacttgtcccggggctaccaagagacactgccttcctacgctcaggtgggggcacaagaagtggagggcgaggggccgcctgcagaggagggagccgaacccgaggtgggagagaagaaggaggaagcagagaggctgaccacggaggagcaggagaaggtggccgtgccagagggggagaaagtagagacccccggagtggataaggagggtgaaaaagaagagccgcagtcggagaaggtgtcaaagcaagggctgccagctgagaagacaccttcactctgtccagagctgacaacagatgatgccagacccctgagcaggctaagcaaagccagcagccgagccaggtcagacgatctaaccgtatgaagtgacgcc

SEQ ID NO: 3972 - DNA, 1762 bp, Homo sapiens
gttccgggagggcgtcctgggcgggccctgcgtcaggttgcagtttcacttttagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttggacgtccttctcttcccggataagaagcagaggaccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggaggaggcgctggagcagggccagagccttgggccggtggagcccctggacggtccagcaggtgctgtcctggagtgcctggtgttgtcctccggaatgctggtgccggaactcgctatccctgttgtctacctgctgggggcactgaccatgctgagtgaaacgcagcacaagctgctggcggaggcgctggagtcgcagaccctgttggggccgctcgagctggtgggcagcctcttggagcagagtgccccgtggcaggagcgcagcaccatgtccctgccccccgggctcctggggaacagctggggcgaaggagcaccggcctgggtcttgctggacgagtgtggcctagagctgggggaggacactccccacgtgtgctgggagccgcaggcccagggccgcatgtgtgcactctacgcctccctggcactgctatcaggactgagccaggagccccactagcctgtgcccgggcatggcctggcagctctccagcagggcagagtgtttgcccaccagctgctagccctaggaaggccaggagcccagtagccatgtggccagtctaccatggggcccaggagttggggaaacacaataaaggtggcatacgaaggaaa

SEQ ID NO: 3973 - DNA, 442 bp, Homo sapiens
acttttagctctgggcacctccagctcctgctcgccggacggctcccagggagagcagacgcgccagacgcgccaccctcggggcgccgacggtcacgcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctcca

SEQ ID NO: 3974 - DNA, 2496 bp, Homo sapiens
cttcccggctcggggattacctctctggctggtcccctcctccgtgctctgcgcgcctccaccctagcgcttgtcttggctcctagaaccaggggcctggacgctgctcagggcagaggcgccccctctgaggggctggcccctcagccgcactccgagacagccgcccccgggaccgcccttccttggagccccgccgcccgccgctcactctgcacacgcagcagaagggacgtggtgttccccaggctctggccccccaggacctgcgcggatctggcccagggcgcctcgccgacttccgtaaactgggcggagggatgaaccccgacccaggggacggaggcgctcgccctctcgctgcagggttctgccctcaacacttctggccccgcctgtgaatgggggccggagcgatggggcggggccggcctccctccctcctcccaggctgacctctgccctccttcgagcacttcccgttcggggtgatgattgaagaactgagtgtggacagagcacctgtcctcgccagcgcccagctggaagctgagttatttgtggctgcagcattccaacgcacacaccaccagaaatccccttcagcatactggcctcagacctaccagggcagagaccttgtcttgtttgctgctagaacccaggatcgctggaaaatcacctagcagcagccaggtgcggtgactcacgcctgtaatcccagcactttggaaggccaaggcgggtggatagcaaggtcaagagatcgagaccagcctggccaacatgctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttggacgtccttctcttcccggataagaagcagaggaccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggaggaggcgctggagcagggccagagccttgggccggtggagcccctggacggtccagcaggtgctgtcctggagtgcctggtgttgtcctccggaatgctggtgccggaactcgctatccctgttgtctacctgctgggggcactgaccatgctgagtgaaacgcagcacaagctgctggcggaggcgctggagtcgcagaccctgttggggccgctcgagctggtgggcagcctcttggagcagagtgccccgtggcaggagcgcagcaccatgtccctgccccccgggctcctggggaacagctggggcgaaggagcaccggcctgggtcttgctggacgagtgtggcctagagctgggggaggacactccccacgtgtgctgggagccgcaggcccagggccgcatgtgtgcactctacgcctccctggcactgctatcaggactgagccaggagccccactagcctgtgcccgggcatggcctggcagctctccagcagggcagagtgtttgcccaccagctgctagccctaggaaggccaggagcccagtagccatgtggccagtctaccatggggcccaggagttggggaaacacaataaaggtggcatacgaaggaaa

SEQ ID NO: 3975 - DNA, 511 bp, Homo sapiens
gaactgagtgtggacagagcacctgtcctcgccagcgcccagctggaagctgagttatttgtggctgcagcattccaacgcacacaccaccagaaatccccttcagcatactggcctcagacctaccagggcagagaccttgtcttgtttgctgctagaacccaggatcgctggaaaatcacctagcagcagccaggtgcggtgactcacgcctgtaatcccagcactttggaaggccaaggcgggtggatagcaaggtcaagagatcgagaccagcctggccaacatgctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatgg

SEQ ID NO: 3976 - DNA, 724 bp, Homo sapiens
aagttgtttgtttgcttgtttgtttttgagacggagtctcactctgtcgcccaggctggagtacaatggcatgatctcggctcactgcaacctacacctcccaggttcaagcgattctcttgcctcagcctcccagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgca

SEQ ID NO: 3977 - DNA, 576 bp, Homo sapiens
cagaaggccccgcgccgcacacgggggcggaagctccaggcttcgggaaaggctgcccctggccagcccaggggcccggcctttggacctgggcttgggcttgactcccaggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcgg

SEQ ID NO: 3978 - DNA, 3361 bp, Homo sapiens
tccgcgtcccccccaccccggccagatccctttcccagtcctgcttcccagtgcctcgggccagggaatcctggcctccgcctgcggagccggcggaacccgcttcccgcctccacggggcagcgccagcggcctggtcctttcaccggcagctccgtgccgacgctctcaccgctcttcctatcgccgggagtggcgggccgaccagggggcggccgggctaccgtccgccattcccgtgtctctgcgcccgcgggggccgcccgagccggccaccatgccgctgggcctgaagcccacctgcagcgtatgcaagaccacgtcgtcctccatgtggaagaagggagcgcagggggagatcctctgccatcattgcactggccggggcggcgcgggcagcgggggcgcaggctcgggggcggctggagggactgggggcagcggcggcggcggcttcggcgcggcgaccttcgccagcacctccgccacccctccgcagagcaacgggggcgggggcggcaagcagagtaagcaggaaattcacaggaggtctgctcggctcagaaacactaaatacaaatctgctccggctgctgaaaagaaagtctccaccaaaggaaaagggagaagacatatatttaaattgaaaaatcccatcaaagctcctgagtcagtttccactataatcactgcagaatcaatcttctacaagggagtatattaccaaattggtgatgttgtttctgtgattgatgaacaagatggaaagccctactatgctcaaatcagaggttttatccaggaccagtattgcgagaagagtgcagcactgacgtggctcattcctaccctctctagccccagagaccaatttgatcccgcctcctatatcatagggccagaggaagatcttccaaggaagatggaatacttggaatttgtttgtcatgcaccttctgagtatttcaagtcacggtcatcaccatttcccacagttcccaccagaccagagaagggctacatatggactcatgttgggcctactcctgcaataacaattaaggaatcagttgccaaccatttgtagttcacaaattaaaactgggtttccaggcctggtgtggtggctcacgcctgtagccccagctattgcaccactgctctccaagctgggcaatggagtcagattctctttcttaaaaaaccacaaaaaaactggatttccagttctctaatattcttagtaccacaagatatgtcataggtatctttaaatgaaattcttagctggaaaagtgactaaaaagtttttctcctgctacctagtaataaacaaatcattgtttattactggtcacttagaaaattaaaagggatagggccaggcacagtggcttatgcctgtaattgcagcacttttagaggccgaggcaggcggatcacctgaggtcgggaagtggatcgcctgaggtcaggagttcgagaccagcctggccaacatggcgaaaccccgtcgctactaaaaatacaaaaattagccaggtgtggtggcatgtgcctgtaatcccagctatttgggaggctgaggcaggagaatcgcctaaacccaggaggtggaggttgtagtgagccaagattgcaccgctgtgctccagcctgggcaacagagtgagactcttgtctcggaaaaaaaaaaaaaaaaaaaaggctgggcacagtggctcacgcctttaatcccagcactttgggaggctgaggcagatggatcgcctgaggttgggagttcgagaccagcctggccagcatggtgaaaccctgtctctactaaaaatacaaaaattagccaggtgtggtggcgcacacctgtagtcccagctactcgggaggctgaggcaggagaattggttgaacccaggaggcggaggttgcagtgagcagagatcgtgccactgcactccagcctgggtggacagagcaagactccgtctcaaagaaacaaacaaaaaattaaaagggatagaatataatgaaatatattttgaacttaaattatattctatatgtgtatcttcctaggcaaaagctgtaatttccagagagaccattaggaacaggtagtatctatttttctccattatttatttctagaaactcataaaatggattgtatttttctataagaacaaaatattaattaaggtatagatgactgaccaagggcttaatcaaataaaatgactaacagcatctatcataaagccacacaagccttatgttctcatctcaaaaatgctgtgacagctttttggctgctttaaccataagaaaaatgattggtggatgattttattagcccaggcttttaaaaactttcatctaggccacgtgcggtggctcatgcctgtaatcccggcactttgggaggcctgagtggatggatcacttgaggtcaggagttcaggaccagcctggccaacatgatgaaaccctgtctctactaaatatacaaaaattagttgggtgttatggtgcatgcctgtaatcccagctactcgggaggctgaggcaggagaattgcttgaactcgggaggtggagattgcagtaagccgagatcgtgccactgcactccagcctgggtgatagagcaagactgtctcaaaaaagaaaaaaaagaaaaaattttaatttaatccttctgtagaaacaggcattcagaaccattccattgatcttaataaagctgctctttactgtttctagtcaaaaatgagacttcgatcaaaccataagattttatactgcagatagtcagcttcaccaaagccgcagaggaaacatgtcgagatcaggcttcctgcttgatagtctcttgactaccattaaaacgaatattgggaggtcatgaaagtcattggtaggccattagcattgatatctttaaaacatctaccctaaaccatctgctatggacccataataagaggcctgttgtatatgaaattgtctagaattcaggtgcaggtctttgccggttaagtaagggagcaacacgtaaaatgggagaggagtggggtgtactcacttgcctcctcttttgtcctgatttaaccagcatttttcaaccctgggaaaatttgcagaatctaagttgattgtaatgattttgagctgcagcagctttaactcttaccctttttccacatagttatggtgtttgagttggaaagaaacaactataggtagctacacgtacataattatctctttattcacaaagggtatagtaaaattgattgtaaataactttctaagtgccaatattcaaaacttttggattaaaatgtatttttcaccgtgca

SEQ ID NO: 3979 - DNA, 990 bp, Homo sapiens
atggaactccacatcctggagcaccggctgcaagttgccagcgtcgccaacgagagtataccgctgttcacctacggcctgatcaaacttgccttcctgtcctccaagaccaggtgcaagttcttcagtctgactgagacgccagaggattacactatcattgtcgatgaggaaggattcctagagctgccctcctcggagcacctgagtgtggcagatgccacctggctggccctgaacgtggtgtccggcggtggcagcttctccagctcccagcccatcggcgtgaccaagatcgccaagtcagtcatcgccccactggctgaccagaacatatccgtgttcatgctgtccacgtatcagacagacttcatcctggtgcgcgagcgggacctgccctttgtcacccacacattgtcatcagagttcaccatcctgcgggtcgtcaatggcgagaccgtggcagccgagaacctcggcatcaccaatggcttcgtgaagcccaagctggtccagaggccagtcatccacccactgtccagcccgagcaacaggttctgtgtcaccagcctggaccctgacacgctgcctgctgttgccacactcctcatggatgtcatgttctactccaatggagtgaaggaccccatggccactggggatgactgcggccacatccgcttcttctccttctccctcatcgagggctacatctccctggtgatggacgtgcagacgcagcagaggtttcctagtaacttgctgttcacaagcgcatccggagagctctggaagatggtccggattggaggacagcccctggggtttgatgagtgtggcatcgtggcccagatctcagagcccttggctgctgcagacatcccagcctactacatcagtactttcaagtttgatcatgcacttgtccccgaagagaacatcaatggtgtcatcagtgccctgaaggtcagccaagcagagaagcactag

SEQ ID NO: 3980 - DNA, 1264 bp, Homo sapiens
gcctcctcccttttgtccggcccggcccggccgccgccgccccccgcgcccggcgccgagctcccgggtctccgggccggctgtcggtgccggcagggcgcggagggggcgggggccgcggctcgtccccccgcggatgagccgccgcggacggggcgcgggcggacgatggaactccacatcctggagcaccggctgcaagttgccagcgtcgccaaggagagtatcccgctgttcacctacggcctgatcaaacttgccttcctgtcctccaagaccaggtgcaagttcttcagtctgactgagacgccagaggattacactatcattgtcgatgaggaaggattcctagagctgccctcctcggagcacctgagtgtggcagatgccacctggctggccctgaacgtggtgtccggcggtggcagcttctccagctcccagcccatcggcgtgaccaagatcgccaagtcagtcatcgccccactggctgaccagaacatatccgtgttcatgctgtccacgtatcagacagacttcatcctggtgcgcgagcgggacctgccctttgtcacccacacattgtcatcagagttcaccatcctgcgggtcgtcaatggcgagaccgtggcagccgagaacctcggcatcaccaatggcttcgtgaagcccaagctggtccagaggccagtcatccacccactgtccagcccgagcaacaggttctgtgtcaccagcctggaccctgacacgctgcctgctgttgccacactcctcatggatgtcatgttctactccaatggagtgaaggaccccatggccactggggatgactgcggccacatccgcttcttctccttctccctcatcgagggctacatctccctggtgatggacgtgcagacgcagcagaggtttcctagtaacttgctgttcacaagcgcatccggagagctctggaagatggtccggattggaggacagcccctggggtttgatgagtgtggcatcgtggcccagatctcagagcccttggctgctgcagacatcccagcctactacatcagtactttcaagtttgatcatgcacttgtccccgaagagaacatcaatggtgtcatcagtgccctgaaggtcagccaagcagagaagcactagaagggtctcttctgctcctccctgccgccgcccgggcccagccctaaccctgaagattgatcttgcagtatttctctacagactggaaaatcagcctggggaccct

SEQ ID NO: 3981 - DNA, 1623 bp, Homo sapiens
agcctcgcagcgggcggcgtggacgcggcagcgcagcggctcctttaaggctcgggcaccacccccgccgccccgcctcccgtgcggcctgggtctagttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccggtgcaagttcttcagcctgacggagacccctgaggattacacgcttatggtggacgaggagggctttaaagagctgcccccatctgagttcctgcaagtagctgaggccacatggctggtgctgaacgtgtcgtctcacagcggtgcggcagtgcaggctgctggggtcaccaagatcgcccgttcggtcatcgcgccactggccgagcaccacgtgtctgtgctgatgctgtccacttaccagacggacttcatcctggtgcgggagcaggacctgtccgtggtgatccacacgctggcccaggagttcgacatttaccgcgaggtgggcggagagcctgtgcctgtgacgagggatgattccagcaatggctttccccgcactcagcatgggcccagccccacggtgcatcccatccagagcccacagaaccgcttctgtgtcctcacactggaccctgagacgcttccagccatcgccaccaccctcatagatgtcctcttctactcgcacagcacccccaaggaggcagcctctagcagtcctgaacccagctccatcacgttctttgccttctccctcatcgagggttatatctccattgtcatggatgctgaaacacagaaaaagttccccagtgacctcctgctgaccagctcctcgggggagctgtggaggatggtgcgcatcggtggacagcccctgggctttgatgaatgtggcatcgtggcacagattgcaggtcccctggctgccgctgacatctctgcctactacatcagcaccttcaacttcgaccacgccctggtgcccgaggacggtatcggcagcgtcatcgaggtcctccagcggcggcaggaaggcctggcttcctgaggcccatgggcaacagagcagcctccctgctctcccctcgacccaggcttccaaagacttctctaagctatttccttaagctctggaacgagccccctgttctgctggggaccctcgttccgctctctgtatgtaagctgcgtgcaggcaccggcttttacgcggacacctgtgtacactcacaggtggagtgggcaggtgctagcctgactgcgtgtctgcccatgcaggggaacacggtgctcggggcttaagcccccaacccatcactccctgcgcagcctcggcgtttgcacagtccctgcctgaggcctgagccattccccaaaggcttcctgggccagctgccccgctgacctccgttctgcctctggtggggttgccttccctggccaggtgagtcctgacagtgcctctccctcctggggcctccaaggaaagtattttgacatctctctctcttctgtttttattgacttgttaataaaggactttgtagtgac

SEQ ID NO: 3982 - DNA, 2733 bp, Homo sapiens
ggcaagttgtttgttacagcgaacaccagctgctccccgcgccggcacccgcgcgccgctgctccgccggcgctgcctccctcgacccgtggctccccctcgcaacttggcgggcctcctcccttttgtccggcccggtccggccgccgccgccccccgcgcctggcgccgagctcccgggtccccgggccggctgtcggtgccggcagggcgcggagggggcgggggccgcggctcgtcccccagcggatgagctgccgcggacggggcgcgggcggacgatggaactccacatcctggagcaccggctgcaagttgccagcgtcgccaaggagagtatcccgctgttcacctacgggcctgatcaaacttgccttcctgttctccaagaccaggtgcaagttcttcagtctgactgagacaccagaggattacactatcattgtcgatgaggaaggattcctagagctgccctcctcggagcacctgagtgtggcggatgccacctggctggccctgaacgtggtgtccggcggtggcagcttctccagctcccagcctattggcatgaccaagatcgccaagtcagtcatcgccccactggctgaccagaacatatccgtgttcatgctgtccacgtatcagacagacttcatcctggtgctcaagcgggacctgccctttgtcacccacacgttgtcatcagagttcaccatcctgtggtcagtggctagactgtagcagccgagaacctcggcatcaccagtggcttcgtgaagcccaagctggggccttggtgtaccttgttgtagtgtttgaaaacatctgaggctgcatccatctccagcaccccataaagcaacagcttgcagaacccggctaggaggcggcgccgctggtgtagccgctctatctgtaaatgatcctcctgggaatcacctggctcacatggaaggcaaaagggaatcacagacttaagcttcctgccctatatttctgagctacacccaagccccagcccttactgagccccaggtatagagtcactgcaccactgcccaggtctcccggctggatgaagacgtggtccatgaggaagctggctagctcagactggagagtagcttcaggaaaaaagacaagtggcctaaggaaatcacggcccccaacaatcatctgagggctaaagatgagaagtagatcacttaataagacaaaagcctgtagggggaaaagaaaggatgtttaaaaggacagaatgtttcccaaggtagaaatgacactgtcaatttctccttggaatgggggcagggatactcgccttgttgctcccacttgagtcagtactcacctgctcctggatctcagtatccacatctgagaggcaactctggcagagttcacagaaggccaccattctgtccctcaaactcgacagctgcttctgtgggcacagtggcttgaaggggaagaatgaagacacagactcctctgttcccattatcccatctaagacccacactcacctgggaagcatctgatttagaaatgtgggttagtgtccagagaatggaaaaatagacaagagtcaaggctggcaggataacctgtaacaacaaagggtttgaaaaatgaggtttgggttaggagagggagagacagatagccagaaacacaccagtgaagaggagagaaaatgagtaaagggagagctaattccttttccagtggaaaatgagtgatattctggacattcttcagaggcatctacacgaagtagaaatgtcaccgctccctaatttactctacgtcttctagaatccctcaatattatccttggcttccaggaaatccaagaagaccctggaagtagagtccaccttctaagagaggaatgtaagaggtgacccccacccacctgatcttcctcgctttgtccactccacgcactgagacttgacacacctagtggccacctagaacgtaggtccttaaaatctagccccccagcccccaacccatctctagcctgtccactcacctggtgaggaacctctcctgtgtccacagccttctgcaggagttggcaacatggctcatagagctcccagcgagtcaggtcatgagtgctttgggggagaaaggggaatgttatactggaaaagaacagagggaaccaactccacagacaccagtaaaaacgggatggggaagaggaggaaagccactcacttgtagaaggcagagaggcgtttcagagtggctgccagattatatacctcatcctcatctaggaaggacgactgagaaggaaagaagatccacaatagcatttcccccagaactcatcagtccacatcccccgtcttgcagcccctcccacccttgtttggggtgtcccattgtccagccccagctcctacctgtaacagctcttcaagctcctgctggaagcggtcagtcagcaaatctactagctggctgcgggcaaagtccgcccggctgaagaaagtgaattcgggattacagagcaggtagagggcatgcgccccagcctcaagcaccgctggctctgcatgcttcaccaccacctcctggagttgctgcaggaacagctccaggtgctgagaagaaaaggcagaagatggtgtgctgtggggatgggaggaggacactcttctggcgggaagtggaacggggttaaaagcattaaacttcaaggataagatgcct

SEQ ID NO: 3983 - DNA, 3217 bp, Homo sapiens
gagttcggggccagcagccgtctacccggtgtcgcgttctgtgttgtggcggccctggatccggcgtcagggcgaccgggcggacgaggtggagccagagtctgtcaggcgggttggtgaagggcgcggggccgggcacggcgttgggagtgcgcggcagggaccggccaggcgggctgcaggcacctcagagcccgggacaccccctcaacgtccgcaggcgcgatgaaggcactgatcttagtggggggctatgggacgcggctacggccgctgacgctgagcaccccgaagccactggtggacttctgcaataagcccatcttgctgcaccaagtggaggcgctagccgcggcaggcgtggaccacgtgatcctggccgtgagctacatgtcgcaggtgctggagaaggaaatgaaggcacaggagcagaggctgggaatccgaatctccatgtcccatgaagaggagcctttggggacagctgggcccctggcgctggcccgtgacctactctctgagactgcagaccctttcttcgtcctcaacagtgacgtgatctgcgatttccccttccaagccatggtgcagttccaccggcaccatggccaggagggctccatcctggtgaccaaggtggaggaaccctccaagtacggtgtggtggtgtgtgaggctgacacaggccgcattcaccggttcgtggagaagccacaggtgtttgtgtccaataagatcaacgcaggcatgtacatcctgagccctgcagtgctgcagcgcatccagctgcagcctacgtccattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggccccaatgtgagcctgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtaagcctgtgggctgggctgggtggggagaggggcggggagtgtgcctgcctccctgacaaggcctatcctctcctggaggtacgcatggagaacgtgacagtgctgggtgaggacgtcatagttaatgatgagctctacctcaacggagccagcgtgctgccccacaagtctattggcgagtcagtgccagagcctcgtatcatcatgtgaggggatgcagtggggctggccgagccccggttttcccatcagcaaggggagtgctggcctgacacatcagaagaccctggacttgtcattatttgtctggggggcactgggtgaagctgaagctgttggacacctgccttctcatgtggacatcatctggcaggatccctgctgggcacaccccacaaaccccactccctcaagaagggccagggccagggctgtatggaataataatttaatgctcactgtggccctgactgaaagtcaagctcaggcacaattagggccatggctgggctcccaccaatgaggatacaggcaggcaaggaggttggatgtggtggtgtgggatacaggagaagggcaaagggagctcataaatagggcccagcctggctctgggttcaaaggtggaggttccaggatggcacaggctgtgagggctaggcagctgaggaggtagtactcgtattggctcccttctcccagtcctctacagacacgatggtggttttgcagaagaagcagtccttgttgttcatcaggtgctggttgatacaggctctacaacaggggaggggatgaggactgccctgcatgtacctactgctctccccaccaccaagctgtggggcccacttacttgcaggacttgtggccacagggctggaacacagcagagatggggtgggcatagcagatggggcagaggtcctcctcactggtgggctgcagggaggagagtgaagggtgggctggagttggatgcctggctatgtggatgtccgttgtgcctgtgtaggagtgcacacatattcaagtggcatggacctgtgcaccgtgttcccactcaccagggaggcagctgctgcctgggcagatgcagaggtcaggtgcgccagcatctgttccacttgggccagctcatcggcactgatataatccgcatctggggagtggtaggtagtgtcaagtcagaggtagctgaggatgtgatgcctcttgaatattcccagcctaggactttgctgttcttaaggctcctgacccgacccagccccagatttccctgacctgccccaccagcccactcacagctctgcagggagaagcgcttccggtcaggggctggcagagcagtgccaggtgctgggggctctggctgtcccaggagatagcatattgagcgtagctggaagcagggatctgccaggagcactgatgtggcttgctctctcctaggtaggggagggtgcaagggcagtcagaaggcttggggcctggctaaaagtctctcttgggattgccaatgaggagtgccatggctcgtacatgatcaccccccctgcatcctttccgtctccctgcttcccaaaccccaagtcctgtattctagtaaggtgccacacagcctgttttttttttttttttcttgagacgagtctcgctctgttgcccaggctggagtgcgatggcacgatctcggctcactgcaacctccacctcccgggttcaagtgattctcctgctttagcctcccgagtagctggaattgcagacgcccaccaccacgcccggctaattgttgtatttttagtagagacagggtttcaccaggttggccaggctggtctcgaattcctgacctcaggtgatccacctgccttggcttcccaaagtgctgggattacaggcgtgagccaccgcgcccggcctggggtaccactttaagaaggctcaggcgaaccaccttaagatagtgagagtctgcctgccccataatattatcagtccttcaaagtcacttcaaataaacactaacagc

SEQ ID NO: 3984 - DNA, 1582 bp, Homo sapiens
gttcggggccagcagccgtctacccggtgtcgcgttctgtgttgtggcggccctggatccggcgtcagggcgaccgggcggacgaggtggagccagagtctgtcaggcgggttggtgaagggcgcggggccgggcacggcgttgggagtgcgcggcagggaccggccaggcgggctgcaggcacctcagagcccgggacaccccctcaacgtccgcaggcgcgatgaaggcactgatcttagtggggggctatgggacgcggctacggccgctgacgctgagcaccccgaagccactggtggacttctgcaataagcccatcttgctgcaccaagtggaggcgctagccgcggcaggcgtggaccacgtgatcctggccgtgagctacatgtcgcaggtgctggagaaggaaatgaaggcacaggagcagaggctgggaatccgaatctccatgtcccatgaagaggagcctttggggacagctgggcccctggcgctggcccgtgacctactctctgagactgcagaccctttcttcgtcctcaacagtgacgtgatctgcgatttccccttccaagccatggtgcagttccaccggcaccatggccaggagggctccatcctggtgaccaaggtggaggaaccctccaagtacggtgtggtggtgtgtgaggctgacacaggccgcattcaccggttcgtggagaagccacaggtgtttgtgtccaataagatcaacgcaggcatgtacatcctgagccctgcagtgctgcagcgcatccagctgcagcctacgtccattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggccccaatgtgagcctgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtacgcatggagaacgtgacagtgctgggtgaggacgtcatagttaatgatgagctctacctcaacggagccagcgtgctgccccacaagtctattggcgagtcagtgccagagcctcgtatcatcatgtgaggggatgcagtggggctggccgagccccggttttcccatcagcaaggggagtgctggcctgacacatcagaagaccctggacttgtcattatttgtctggggggcactgggtgaagctgaagctgttggacacctgccttctcatgtggacatcatctggcaggatccctgctgggcacaccccacaaaccccactccctcaagaagggccagggccagggctgtatggaataataatttaatgctcactgtggccctgactgaaagtcaagctca

SEQ ID NO: 3985 - DNA, 6108 bp, Homo sapiens
gagttcggggccagcagccgtctacccggtgtcgcgttctgtgttgtggcggccctggatccggcgtcagggcgaccgggcggacgaggtggagccagagtctgtcaggcgggcgcgatgaaggcactgatcttagtggggggctatgggacgcggctacggccgctgacgctgagcaccccgaagccactggtggacttctgcaataagcccatcttgctgcaccaagtggaggcgctagccgcggcaggcgtggaccacgtgatcctggccgtgagctacatgtcgcaggtgctggagaaggaaatgaaggcacaggagcagaggctgggaatccgaatctccatgtcccatgaagaggagcctttggggacagctgggcccctggcgctggcccgtgacctactctctgagactgcagaccctttcttcgtcctcaacagtgacgtgatctgcgatttccccttccaagccatggtgcagttccaccggcaccatggccaggagggctccatcctggtgaccaaggtggaggaaccctccaagtacggtgtggtggtgtgtgaggctgacacaggccgcattcaccggttcgtggagaagccacaggtgtttgtgtccaataagatcaacgcaggcatgtacatcctgagccctgcagtgctgcagcgcatccagctgcagcctacgtccattgagaaggaggtcttccccattatggccaaggaggggcagctatatgccatggagttacagggcttctggatggacattgggcagcccaaggacttcctcactggcatgtgcctcttcctgcagtcactgaggcagaagcagcctgagcggctgtgctcaggccctggcattgtgggcaacgtgctggtggacccaagtgcccgcatcggccagaactgcagcattggccccaatgtgagcctgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtacgcatggagaacgtgacagtgctgggtgaggacgtcatagttaatgatgagctctacctcaacggagccagcgtgctgccccacaagtctattggcgagtcagtgccagagcctcgtatcatcatgtgaggggatgcagtggggctggccgagccccggttttcccatcagcaaggggagtgctggcctgacacatcagaagaccctggacttgtcattatttgtctggggggcactgggtgaagctgaagctgttggacacctgccttctcatgtggacatcatctggcaggatccctgctgggcacaccccacaaaccccactccctcaagaagggccagggccagggctgtatggaataataatttaatgctcactgtggccctgactgaaagtcaagctcaggcacaattagggccatggctgggctcccaccaatgaggatacaggcaggcaaggaggttggatgtggtggtgtgggatacaggagaagggcaaagggagctcataaatagggcccagcctggctctgggttcaaaggtggaggttccaggatggcacaggctgtgagggctaggcagctgaggaggtagtactcgtattggctcccttctcccagtcctctacagacacgatggtggttttgcagaagaagcagtccttgttgttcatcaggtgctggttgatacaggctctacaacaggggaggggatgaggactgccctgcatgtacctactgctctccccaccaccaagctgtggggcccacttacttgcaggacttgtggccacagggctggaacacagcagagatggggtgggcatagcagatggggcagaggtcctcctcactggtgggctgcagggaggagagtgaagggtgggctggagttggatgcctggctatgtggatgtccgttgtgcctgtgtaggagtgcacacatattcaagtggcatggacctgtgcaccgtgttcccactcaccagggaggcagctgctgcctgggcagatgcagaggtcaggtgcgccagcatctgttccacttgggccagctcatcggcactgatataatccgcatctggggagtggtaggtagtgtcaagtcagaggtagctgaggatgtgatgcctcttgaatattcccagcctaggactttgctgttcttaaggctcctgacccgacccagccccagatttccctgacctgccccaccagcccactcacagctctgcagggagaagcgcttccggtcaggggctggcagagcagtgccaggtgctgggggctctggctgtcccaggagatagcatattgagcgtagctggaagcagggatctgccaggagcactgatgtggcttgctctctcctaggtaggggagggtgcaagggcagtcagaaggcttggggcctggctaaaagtctctcttgggattgccaatgaggagtgccatggctcgtacatgatcaccccccctgcatcctttccgtctccctgcttcccaaaccccaagtcctgtattctagtaaggtgccacacagcctgttttttttttttttttcttgagacgagtctcgctctgttgcccaggctggagtgcgatggcacgatctcggctcactgcaacctccacctcccgggttcaagtgattctcctgctttagcctcccgagtagctggaattgcagacgcccaccaccacgcccggctaattgttgtatttttagtagagacagggtttcaccaggttggccaggctggtctcgaattcctgacctcaggtgatccacctgccttggcttcccaaagtgctgggattacaggcgtgagccaccgcgcccggcctggggtaccactttaagaaggctcaggcgaaccaccttaagatagtgagagtctgcctgccccataatattatcagtccttcaaagtcacttcaaataaacactaacagcagcttggagacattcttccagactcccccttttactccccgaggaaaaacgagcggcggagagctgccagccaaaggctgacggggactttggggttggccttgctccccatctggcggtcatgcggggccattgggcacaaagggatgtagccgccccgcctcctcaaacgggaaccaataggagcccgggccccgcccctggggggagtatttaggagccgatcaggaactcgcttggagagggctagcgaagccgaagggagcgcggctaagagtgccgcaccgcctcacaacctgggaaccggagagtaggggccgtcggctggcaagaacccgccgtgcctcctcggcaagggccatccggtgccacccatgtcgcactagagcagaagagggtgagtcctggaactgcaacctgcacagagctgctctgtactgtccctggtggtcgccgccatgacctggttggtgctgctggggacactgctctgcatgctgcgcgttgggttaggcaccccggactccgagggtttcccgccccgtgcgctccacaactgcccctacaaatgtatctgcgctgccgacctgctaagctgcactggcctagggctgcaggacgtgccagccgagttacctgccgctactgcggacctcgacctgagccacaacgcgctccagcgcctgcgccccggctggttggcgcccctcttccagctgcgcgccctgcacctagaccacaacgaactagatgcgctgggtcgcggcgtcttcgtcaacgccagcggcctgaggctgctcgatctatcatctaacacgttgcgggcgcttggccgccacgacctcgacgggctgggggcgctggagaagctgcttctgttcaataaccgcttggtgcacttggacgagcatgccttccacggcctgcgcgcgctcagccatctctacctgggctgcaacgaactcgcctcgttctccttcgaccacctgcacggtctgagcgccacccacctgcttactctggacctctcctccaaccggctgggacacatctccgtacctgagctggccgcgctgccggccttcctcaagaacggcctctacttgcacaacaaccctttgccttgcgactgccgcctctaccacctgctacagcgctggcaccagcggggcctgagcgccgtgcgcgactttgcgcgcgagtacgtatgcttggccttcaaggtacccgcgtcccgcgtgcgcttcttccagcacagccgcgtctttgagaactgctcgtcggccccagctcttggcctagagcggccggaagagcacctgtacgcgctggtgggtcggtccctgaggctttactgcaacaccagcgtcccggccatgcgcattgcctgggtttcgccgcagcaggagcttctcagggcgccaggatcccgcgatggcagcatcgcggtgctggccgacggcagcttggccataggcaacgtacaggagcagcatgcgggactcttcgtgtgcctggccactgggccccgcctgcaccacaaccagacgcacgagtacaacgtgagcgtgcactttccgcgcccagagcccgaggctttcaacacaggcttcaccacactgctgggctgtgccgtgggccttgtgctcgtgctgctctacctgttcgccccaccctgccgctgctgccgccgtgcctgccgctgccgccgctggccccaaacacccagcccgctccaagagctgagcgcacagtcctcagtactcagcaccacaccgccagacgcacccagccgcaaggccagcgtccacaagcacgtagtctttctggagccaggccggaggggcctcaatggccgcgtgcagctggcagtagctgaggaattcgatctctacaaccctggaggcctgcagctgaaggctggctctgagtccgccagctccataggctccgagggtcccatgacaacctagactgcccagggctcccccacccaggcccccaccctcttgctgctcgccctgctccctgcttcggtccagagaactggcagatactggtgggaagcactgtgcctggccccccagcttcctgtatgggcctcgaaacacaatgggccttctcgctcactggtagagacaggggttgtggtccccaacctgccttctgctctgcccctgcacaggacccaaaggccccaggccctgcaaggtgtgctagttcctgctttcccgcggacttcctagtgcccaaatgccctgtgaggctgagagacccaggcccctgtggctttcaacacagcacagctgtggaagtggctgtgttcttctacagcctgtggaagaacccctgtagcagagcctcccgtccaccctcaggggctgagacagctctcgaggagtggtgctcaagagctgacgcagggccacctccccttcccaagggggtgggagggagtgggcccacagggaaaagaaggcggctctgaaggaagatctcgcccacaccccaggacagaaagaggaaacaagcccgccctctggtgaaatgggactccctccatccaccaacacccaacctcctgaaagcttcacaacttcacgcagagtccggtgggcaggcaccaggcaggaaaggctcctcaagaggttcctggtggtctggcctaagccccagccagaggccctgctctctctggcctggggcatccacccgttgttctgaaggcagagcccattctgtgggctcacaagacacagtgaaggggatcatggcctgcacccctgcttttcagcagtaaaaagcccgaaaagcctggcgagcatggccgagctgggagggccgagccggaactccacgtccctcgagagcaggagcctcttaagggctggcactggtctcagcctaatggctgaggcggtaccctggcttcatatgcatctcactgctcccactgcaggggggcagggaaggggggtctgggagcccttcatgtgtgggggccgagctgggggcccccatggccatcctggacctcgctgctccagagtttaataaaggtagcacatgcttattgctag

SEQ ID NO: 3986 - DNA, 1182 bp, Homo sapiens
gttagccccgcgcagccgccggcgtcgccgccatggacctaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacgtctggtgggagaggacgacccccaggaggtgtctgcaaccgtgtatctggacaaactggccacggtgatctctgtgtggaactcggacacccagaatccctaccaccagcaggcgctggcagagaaggtgaaggaggcagaacgggatgtcagcctgacctcgctggccaaactccccagtgagaccattttcgtgggctgcgagttcctgcaccacctgctgcgggagtggggggaggagttgcaggccgtgctccgcagcagccaggggacaagttacgacagctaccggctgtgcgacagtctgacttccttcagccagaacgcgacgctctacctgaaccgcaccagcctgtccaaggaggacaggcaggtggtctctgagctggcggagtgtgtcagggacttcctgaggaaaacgagcacggtgctgaagaacagggccttggaggatatcacagcttccattgccatggccgtcatccagcagaagatggaccgccatatggaagtgtgctacatttttgcctctgagaagaagtgggccttctcggacgagtgggtagcctgcctggggagtaacagggccctcttccgacagccagacttggtgttgaggctgctggaaacagtgatagacgtcagcacagctgacagagccat

SEQ ID NO: 3987 - DNA, 1958 bp, Homo sapiens
ggtgagtccgcgtgtggaagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatagctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacacctgtaatcccaacactttgggaggctgaggtgggcagatcacttgaggtcaggagttcgagaccagcctggccaacatggtgaaaccccgtcactactaaaaatacaaaaaataattagccgggcatggt

SEQ ID NO: 3988 - DNA, 1803 bp, Homo sapiens
gtccgcgtgtggaagtctgtgaggcgcagaggtggggcaggccgtctgactagctaggcggctgggagcgttttcgtggcggggaacggaggttgaattgccctgcctgggctcatagggaaggaggatgtgaaggagcttgtgaaggcagaggaaggctggagtgcagtggcacaaccttggctcgctccagtgtctacctcccaggttcaagtgattctcctgcctcagcctcccgagtagctgggattacagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaaggaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatttaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatcttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatcttta

SEQ ID NO: 3989 - DNA, 628 bp, Homo sapiens
caatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaa

SEQ ID NO: 3990 - DNA, 1383 bp, Homo sapiens
atgcgcgatctcccggagcatgcgcagcagcggcgccgacgcggggcggtgcctggtgaccgcgcgcgctcccggaagtgtgccggcgtcgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaa

SEQ ID NO: 3991 - DNA, 2055 bp, Homo sapiens
ggctggtgtctggccctcaggacatcctctccaatccaccacacaccaccttacccctctgctggcaagaggggacctgattcatcctcacgctaaacactcattctacccaactgattgagacagaacagaagataaactgaaacttctctgccttcccgctgcaagagtgaatgagcgatccctctcaactgactcaaaatgtttgcctcacccaggagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccagcactgctccatccccagtcctggaaacaatttagagcccttcggtccagtggtacagcggcagcaaaaggggagaggtgccgaagtttcattgaacttacaccaccagccaagagagaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctgatacatctagttattggtctggaaattggagaaatggaggtgagcaaattaacggtagtgtgactgtggctcaactttccatggtacgcgcgaattgttctggaagtcacagatgggaagacagaagcgcccctgagtgctttgtcatatagcacagaagtcctccacactgcctgggacagtgtcctgcatccacacagtaggtacccagtaaaagtgttattaaatattgtcccaggagcccttaggagagtggtttaacatgagaaggcgccaacagcacacagggtcagggtcacttctagaaatagcccaccaaggctattcagattggactgtggttcccttctggacagtcacaccagggacttcccagtgaacaagggggcataggctcctctctggatcccaccttttcatcccttctgagaaatgtaccctattatttccttcataaagaatgccaccca

SEQ ID NO: 3992 - DNA, 2390 bp, Homo sapiens
aaaccaaagggacttggagtgcagatggcatccttcggttcttccagacaagctgcaagacgctgaccatggccaagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccaggggagaggtgccgaagtttcattgaacttacaccaccagccaagagagaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctgatacatctagttattggtctggaaattggagaaatggaggtgagcaaattaacggtagtgtgactgtggctcaactttccatggtacgcgcgaattgttctggaagtcacagatgggaagacagaagcgcccctgagtgctttgtcatatagcacagaagtcctccacactgcctgggacagtgtcctgcatccacacagtaggtacccagtaaaagtgttattaaatattgtcccaggagcccttaggagagtggtttaacatgagaaggcgccaacagcacacagggtcagggtcacttctagaaatagcccaccaaggctattcagattggactgtggttcccttctggacagtcacaccagggacttcccagtgaacaagggggcataggctcctctctggatcccaccttttcatcccttctgagaaatgtaccctattatttccttcataaagaatgccacccatctgattcctcaagaatctagacctagaaataccatttgacccagccatcccattactgggtagatacccaaaggattacaaatcatgctgctataaagacacatgcacacatatgtttattacggcactatttataatagcaaagacttggaaccaacccaaatgtccatcagtgatagactggattaagaaaatgtggcacatatacaccatggaatactatgcagccataaagaaggatgagtttatgccctttgtagggacatggatgaagctggaaaccatcattctgagcaaactatcgcaaggatagaaaaccaaacactgcatattctcactcacaggtgggaattgaacaataaaaacacttggacacagggtggggaacatcacacaccgggcctgtcatggggtggggggaggggggagggatagcattaggagatatactaacgtaaatgacgagttaatgggtgcagcacaccaacatggcacatgtatacatatgtaacaaatctgcacgttgtgcacatgtaccctagaactt

SEQ ID NO: 3993 - DNA, 1422 bp, Homo sapiens
acacaccaccttacccctctgctggcaagaggggacctgattcatcctcacgctaaacactcattctacccaactgattgagacagaacagaagataaactgaaacttctctgccttcccgctgcaagagtgaatgagcgatccctctcaactgactcaaaatgtttgcctcacccaggagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccagcactgctccatccccagtcctggaaacaatttagagcccttcggtccagtggtacagcggcagcaaaaggggagaggtgccgaagtttcattgaacttacaccaccagccaagagaggtgagaaaggactactggaatttgccacgttgcaaggcccatgtcaccccactctccgatttggagggaagcggttgatggagaaggcttccctcccctcccctcccttggggctttgtggcaaaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaa

SEQ ID NO: 3994 - DNA, 1628 bp, Homo sapiens
aattattaaatgcccgtgttccctgtaaggcagcatttaatcatgaggcactccaaagaatatgagatagaaggggaggggtaggaggagagggaggagggtaggaagacagtttgcattcttgcaacattaaaccaaagggacttggagtgcagatggcatccttcggttcttccagacaagctgcaagacgctgaccatggccaagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccaggggagaggtgccgaagtttcattgaacttacaccaccagccaagagaggtgagaaaggactactggaatttgccacgttgcaaggcccatgtcaccccactctccgatttggagggaagcggttgatggagaaggcttccctcccctcccctcccttggggctttgtggcaaaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctga

SEQ ID NO: 3995 - DNA, 1858 bp, Homo sapiens
agcatttaatcatgaggcactccaaagaatatgagatagaaggggaggggtaggaggagagggaggagggtaggaagacagtttgcattcttgcaacattaaaccaaagggacttggagtgcagatggcatccttcggttcttccagacaagctgcaagacgctgaccatggccaagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccagcactgctccatccccagtcctggaaacaatttagagcccttcggtccagtggtacagcggcagcaaaaggggagaggtgccgaagtttcattgaacttacaccaccagccaagagaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgaccttaaggatctgatacatctagttattggtctggaaattggagaaatggaggtgagcaaattaacggtagtgtgactgtggctcaactttccatggtacgcgcgaattgttctggaagtcacagatgggaagacagaagcgcccctgagtgctttgtcatatagcacagaagtcctccacactgcctgggacagtgtcctgcatccacacagtaggtacccagtaaaagtgttattaaatattgtcccaggagcccttaggagagtggtttaacatgagaaggcgccaacagcacacagggtcagggtcacttctagaaatagcccaccaaggctattcagattggactgtggttcccttctggacagtcacaccagggacttcccagtgaacaagggggcataggctcctctctggatcccaccttttcatcccttctgagaaatgtaccctattatttccttcataaagaatgccaccca

SEQ ID NO: 3996 - DNA, 1200 bp, Homo sapiens
agcatttaatcatgaggcactccaaagaatatgagatagaaggggaggggtaggaggagagggaggagggtaggaagacagtttgcattcttgcaacattaaaccaaagggacttggagtgcagatggcatccttcggttcttccagacaagctgcaagacgctgaccatggccaagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccaggggagaggtgccgaagtttcattgaacttacaccaccagccaagagaggtgagaaaggactactggaatttgccacgttgcaaggcccatgtcaccccactctccgatttggagggaagcggttgatggagaaggcttccctcccctcccctcccttggggctttgtggcaaaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttag

SEQ ID NO: 3997 - DNA, 1231 bp, Homo sapiens
acacaccaccttacccctctgctggcaagaggggacctgattcatcctcacgctaaacactcattctacccaactgattgagacagaacagaagataaactgaaacttctctgccttcccgctgcaagagtgaatgagcgatccctctcaactgactcaaaatgtttgcctcacccaggagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccaggggagaggtgccgaagtttcattgaacttacaccaccagccaagagagaaatcctatggttatccctgggaacgcagatcacctacatcggacttcaattcatcagcttcctcctgctactaacagacttgctactcactgggaaccctgcctgtgggctcaaactgagcgcctttgctgctgtttcctctgtcctgtcaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaaca

SEQ ID NO: 3998 - DNA, 1183 bp, Homo sapiens
gcatccttcggttcttccagacaagctgcaagacgctgaccatggccaagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccaggggagaggtgccgaagtttcattgaacttacaccaccagccaagagaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaacatccgtctcttgagcatggtttttagaggctacgaataaggctatgaataagggttatctttaagtcctaagggattcctgggtgccactgctctcttttcctctacagctccatcttgtttcacccaccccacatctcacacatccagaattcccttctttactgatagtttctgtgccaggttctgggctaaaccatggagataaaaagaagagtaaaatacacttcccgacctt

SEQ ID NO: 3999 - DNA, 1028 bp, Homo sapiens
ttggagtgcagatggcatccttcggttcttccagacaagctgcaagacgctgaccatggccaagatggagctctcgaaggccttctctggccagcggacactcctatctgccatcctcagcatgctatcactcagcttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccagcactgctccatccccagtcctggaaacaatttagagcccttcggtccagtggtacagcggcagcaaaaggggagaggtgccgaagtttcattgaacttacaccaccagccaagagaggtctcctggggatggtggcccacatgatgtattcacaagtcttccaagcgactgtcaacttgggtccagaagactggagaccacatgtttggaattatggctgggccttctacatggcctggctctccttcacctgctgcatggcgtcggctgtcaccaccttcaacacgtacaccaggatggtgctggagttcaagtgcaagcatagtaagagcttcaaggaaaacccgaactgcctaccacatcaccatcagtgtttccctcggcggctgtcaagtgcagcccccaccgtgggtcctttgaccagctaccaccagtatcataatcagcccatccactctgtctctgagggagtcgacttctactccgagctgcggaacaagggatttcaaagaggggccagccaggagctgaaagaagcagttaggtcatctgtagaggaagagcagtgttaggagttaagcgggtttggggagtaggcttgagccctaccttacacgtctgctgattatcaacatgtgcttaagccaa

SEQ ID NO: 4000 - DNA, 561 bp, Homo sapiens
cgactgggccaggcgccggggcaggaagggaggcggccgccgtgccattcttaaaggcgcccgagtgtaggcgacaggccgctgacggccggaaggaaaatgagtgagtctttggttgtttgtgatgttgccgaagatttagtggaaaagctgagaaagtttcgttttcgcaaagaaacgaacaacgctgctattataatgaagattgacaaggataaacgcctggtggtactggatgaggagcttgagggcatttcaccagatgaacttaaagatgaactacctgaacgacaacctcgattcattgtgtatagttataaatatcaacatgatgatggaagagtttcatatcctctgtgctttattttctccagtcctgttggatgtaagcctgaacaacagatgatgtatgctggaagtaagaataagctagtccagacagctgaactaaccaaggtatttgaaataagaaataccgaagacctaactgaagaatggttacgtgagaaactttttttcactaatgtgaacttctgtgtttctaaagtatttatgtattaa

SEQ ID NO: 4001 - DNA, 4301 bp, Homo sapiens
acttgcagccaggcagagcgtcctcctctagagggagcagggaaaagaaaaaaaaaaaaaaaaaaaaaaaaaaaaaaatcaggcgatcgcattctgtctaattttgagccgcgccttttgccgtccgccatcacgtgccggcccgctgaggccgcgttgataggtgggggcgactgggccaggcgccggggcaggaagggaggcggccgccgtgccattcttaaaggcgcccgagtgtaggcgacaggccgctgacggccggaaggaaaatgagtgagtctttggttgtttgtgatgttgccgaagatttagtggaaaagctgagaaagtttcgttttcgcaaagaaacgaacaacgctgctattataatgaagattgacaaggataaacgcctggtggtactggatgaggagcttgagggcatttcaccagatgaacttaaagatgaactacctgaacgacaacctcgcttcattgtgtatagttataaatatcaacatgatgatggaagagtttcatatcctctgtgctttattttctccagtcctgttggatgtaagcctgaacaacagatgatgtatgctggaagtaagaataagctagtccagacagctgaactaaccaaggtatttgaaataagaaataccgaagacctaactgaagaatggttacgtgagaaacttggattttttcactaatgtgaacttctgtgtttctaaagtatttatgtattaacctgaccatactggaatcagacataaatacttatttatgcctaaaaatgcactgttacttacagtttgtttcctgcagtaaagaaaaattcttcatttgtgcaaaatttgaacaaagaggaaatcatcttcatagtaatgaaactttgtaaagtgtttccttatattggtaattgttaggtggactacttttctccagggactttttgcactcttgtgactaatttctataacttatggttcggaatttgttactatttacagacaccattggaaagtggatatattagattgtgagagacaacagttgcctccttttgacaaatactggatattagcagtttatttatgaaaatagcgtattatcacttgtcaaatcattgaaattcatttggggtcaaagacttgagtgacccagtattgagccatgaataatttagtgtaacctgtattacaagtacattgatgaattctgtatcttctttggtttcctgtatctttttaatcaagtctagaaactatgttcatcagtcactcatttttaaggtcgggagttagattttatgatagaattatgactgttagcttttctccttatagcatcttagtcttagaaattggtgggttgtaataatcaagggcttcattccttttatgtcatttctagacagttttgaatctaggttaataacactttatttataaagcacctcaatgtcctgtgaacactaattattttaaatgtgttaatactgtgcctttgatttgttagctttaaagttagtttaagacttttacactgccagtattccacatttggtgaaattaatacttttttaaagggtccaaataaaataattttctaatgtgtatatctgaaatttgtaataaaatcaacttcatattttaaaaattccaactatctgcttgcattggtgaatatatggcagtcgagagttataattttgggtatacttgtggttagttttgtgccataggaaaaaattatcttaaaactttggccatagttaataacattaacacttcaatagcaatcacatcttatatcctaaatgtcagaagatattctgaactggatgcctgaatagttaactaaaccagtcttgttagatgatggtactcttggcataaagcgaggattctgatatttggcatacttgtaaaaacaaatacataagtaaccattgaacattaatttgataataggtctagagactctaaaaactaaccaaacttggtgagtgtattcttatattaagaatatcttagtcatctcaaaactagcaaaatttaaattttggcatgttttccattcatatgttctttgcattttatttttgaggtttctgtgagaagtaaagatagttggaatttttgcgatattgaatagaacatcttctgttcccaacactgtttggcttcactaatttagaagtcaggaagcaatagaaagttggagatgaggaagtgctagagtaggtgtttgttttggttcttggagggaaaagattctttattccaatttccagagagaagagaaaactcacccaggaagtttaaaaattctttaaacaggtattttgatattggagaataacatgcatataattctgtaggaatgcacatgtaatccaagtgagtggagagtgtttttaatgtttttgaatgaaggaaatgaggttttgtttcacctgttttgcagcagtaagagaaactagtgctgcaagaatgtattttttaatgaagttccttattttgtcttgcatgttttagttttgcttatttttaaatttggaggtcctccataatgtcagataatattgacctgccatacgttagcactcttagttccgctactgtctttaacaggagcaaagagctgtgataaaccatgcttttttgagcttgtctgactcctaattaataacatgtttttggcaagacaacagattgaggttagaggatcagtaggacatttttattccatctgtcctatggggaaatttacaaatcccgtgctctaaaatgttctcaaacatttatatagatttccctttcatcttactaaattttgcattgttcttttcaagtatgtttcgtatttactgtctttttttctgccatttcccaaataataactccagatttcataattccagtttttacattccgttatctttctggtacaaccattcccattcagccttaaatctgagtcctttttagcagcaacttttttcctgggatcctccttcgtggtcttctaagtcagtgttagttttgaaatttttggccctgcataagttctgcatagcatctaatgtcaaaatagaaccaactggtaatcacagtattatttagtgtggtttccatgacaacaaaaatacatacgaagaaaacttctcaggttactatgctgaaattccaaaatgtctgagttttgaatagtgatcactttgttctggtattgacgcaattatattaggaaaaaagttggttgactgtttttgtttaattgacttctaaaatgttcaaattgtctagttctaaaagtttactaaatgcctagtgcagttaaacatactcttgtttaagtgtgtgttgctaaattttttactgtcattactaaataatctgtgtggcaaaatgtgtgtcagcacttttccctccttttttatctcctattttcaggagtcaaatgtagccataaactgtatccttgtctgacactttagctaaaaatttccagttaggggagtttattgccaaattaaatttggctgttccccccaacccatatagatattaaggaaggtgtacttaaaaaatgtttggactgcttttaaaacctgagcaatgtcattaatccatatgtggactagtgatgaatagatattttcataagagtttaaatgctgatatttggtggaagtagagagtaactcatattctatcaattcaagtattcttactatggttgctttccctatttgttcaatagactgataatactggaatttatagagtttgagccattacaacttttgtgaggatgtgtttcaaacatttctggacaaatcttattttgtatttctggaagaatgtagtaatcttctagaccgcttaaaaccaatgctcccaagctgaatattcttgagaaatttgtttttattatgccatttgacatttcaaatcagtgctcatatacagtaaacttgtgatagaaattgtattttattgctttttggattataattcatataaatataattacttgaatattgtttgagatcattaacatgccagggcagttcccactgatttagatggtccaagataatctcattcaggaggcttgaaacattaatggtttagtcttgtgaattttaacagttctctgtcatcgtttaacaaaaccaacaactgacacaactccttaagctgtggtttcagtctctgctagttcatattgcatgtttattttggacagtcttttgttaagcatggtgcttgtactggtttaaataaaatgttaacattaaaaga

SEQ ID NO: 4002 - DNA, 1995 bp, Homo sapiens
ctaagacgccggaggaggtggcggcggctgggagaggcgagggttctggccgattttagcatcgaaactaggagaaataagaatggctgtagaggaacttcagtctataataaagagatgtcaaatcctagaagagcaagactttaaagaagaggattttggcctatttcagttagctgggcaaagatgcatagaagaagggcacacagaccagctattagaaattattcaaaatgaaaagaataaggtcatcatcaagaatatgggctggaatctcgttggtcctgttgttcgatgccttttgtgtaaagataaagaggatagtaaaagaaaagtttattttttgatctttgatttattggtaaagttatgcaatccaaaggaattattgttgggtttgcttgaactgattgaagagccctctggaaaacagatatcccaaagtattcttcttttgcttcagccattacaaacagtgattcagaaacttcataacaaggcatattcaattggattagcattgtctaccctttggaatcagctatctcttcttcctgttccatactcaaaagaacaaatacaaatggatgactatggcctttgtcagtgttgcaaggccttaatagagttcactaagccttttgtggaagaagtcattgataacaaagaaaactcactggaaaatgaaaagttaaaggatgaattactgaaattttgtttcaaaagcttgaaatgccctttgctgacagcacaattctttgaacagtctgaagaaggtggaaatgatcctttcaggtattttgcatcagaaataataggttttttatcagcaattggacaccctttccccaaaatgatttttaatcatggaaggaaaaagagaacttggaattaccttgaatttgaagaagaagaaaataaacagttagcagactcaatggcttctctggcatatctagtatttgtacagggcatccatattgatcagcttccaatggtcttaagcccattgtaccttttgcagtttaatatggggcacattgaagtctttttgcaaagaacagaagagtctgttatctccaaaggattggagctgctggagaatagtttattgagaatagaagacaatagtctactttaccagtacttagaaatcaagagttttcttactgtacctcagggcttagtgaaagtaatgacactttgccccattgagacactgaggaaaaagagtttagctatgcttcagctgtatattaacaagttggattcacaaggcaaatatacattatttaggtgcttattgaatacaagtaatcactcaggtgtggaggcttttattattcaaaatatcaaaaatcaaattgacatgtcattaaagagaacacgtaacaacaaatggtttacaggaccacagttgatttcccttcttgatttggtactttttctcccagagggtgcagaaacagatttactgcaaaactcagataggattatggcttcattaaatttattgaggtatttggttatcaaagataatgaaaatgacaatcaaactggattatggacagaacttggaaatattgagaataatttcttaaagccacttcatataggacttaatatgtcaaaagcacattatgaagcagaaattaaaaatagccaagaggcccagaaatctaaagatctttgttctataactgtaagtggagaagagatccctaatatgcctcctgaaatgcagcttaaggtcctgcattcagctcttttcacatttgatttgattgaaagtgttctagctcgagtggaagaactcattgaaataaaaacaaagtctacctctgaagaaaatattgggataaagtgaaagttccatttcctaaataaaaactaataaaatatagtactttccattatgattcatttaatacctttataaaaaatttttctgtaaaaatttactgcttgaaaaataaatgtagcttttctcattta

SEQ ID NO: 4003 - DNA, 1963 bp, Homo sapiens
agaagagcgggctaagacgccggaggaggtggcggcggctgggagaggcgagggttctggccgattttagcatcgaaactaggagaaataagaatggctgtagaggaacttcagtctataataaagagatgtcaaatcctagaagagcaagactttaaagaagaggattttggcctatttcagttagctgggcaaagatgcatagaagaagggcacacagaccagctattagaaattattcaaaatgaaaagaataaggtcatcatcaagaatatgggctggaatctcgttggtcctgttgttcgatgccttttgtgtaaagataaagaggatagtaaaagaaaagtttattttttgatctttgatttattggtaaagttatgcaatccaaaggaattattgttgggtttgcttgaactgattgaagagccctctggaaaacagatatcccaaagtattcttcttttgcttcagccattacaaacagtgattcagaaacttcataacaaggcatattcaattggattagcattgtctaccctttggaatcagctatctcttcttcctgttccatactcaaaagaacaaatacaaatggatgactatggcctttgtcagtgttgcaaggccttaatagagttcactaagccttttgtggaagaagtcattgataacaaagaaaactcactggaaaatgaaaagttaaaggatgaattactgaaattttgtttcaaaagcttgaaatgccctttgctgacagcacaattctttgaacagtctgaagaaggtggaaatgatcctttcaggtattttgcatcagaaataataggttttttatcagcaattggacaccctttccccaaaatgatttttaatcatggaaggaaaaagagaacttggaattaccttgaatttgaagaagaagaaaataaacagttagcagactcaatggcttctctggcatatctagtatttgtacagggcatccatattgatcagcttccaatggtcttaagcccattgtaccttttgcagtttaatatggggcacattgaagtctttttgcaaagaacagaagagtctgttatctccaaaggattggagctgctggagaatagtttattgagaatagaagacaatagtctactttaccagtacttagaaatcaagagttttcttactgtacctcagaggaaaaagagtttagctatgcttcagctgtatattaacaagttggattcacaaggcaaatatacattatttaggtgcttattgaatacaagtaatcactcaggtgtggaggcttttattattcaaaatatcaaaaatcaaattgacatgtcattaaagagaacacgtaacaacaaatggtttacaggaccacagttgatttcccttcttgatttggtactttttctcccagagggtgcagaaacagatttactgcaaaactcagataggattatggcttcattaaatttattgaggtatttggttatcaaagataatgaaaatgacaatcaaactggattatggacagaacttggaaatattgagaataatttcttaaagccacttcatataggacttaatatgtcaaaagcacattatgaagcagaaattaaaaatagccaagaggcccagaaatctaaagatctttgttctataactgtaagtggagaagagatccctaatatgcctcctgaaatgcagcttaaggtcctgcattcagctcttttcacatttgatttgattgaaagtgttctagctcgagtggaagaactcattgaaataaaaacaaagtctacctctgaagaaaatattgggataaagtgaaagttccatttcctaaataaaaactaataaaatatagtactttccattatgattcatttaatacctttataaaaaatttttctgtaaaaatttactgcttgaaaaataaatgtagcttttctcattt

SEQ ID NO: 4004 - DNA, 765 bp, Homo sapiens
aatgggaagacggtgcaagtattgccaagcgctttatccacaatgtttggaatagattcttgcccttactatgtgctagagaaccactatatcacaactcctttgtccacagaagaagctgcattccctttggcatatgtaatgaccatcagtcaagatttcgatacgtttgaatggcttttctgggctatttacatgcctcaaaatgtctactgtattcacgttgataaggcggccacgattgactttaaaattgctgtgagtgaattattggagtgcttctcaaatgcatttatatcctcacagtctgagtatattatttatggtggaaaatccaggctccaggcggacctggcctgcatgagagatcttatagcatcaactgttcagtggagatatgtcactaacactggtgatcacgatttccccctaaaaaccaacagggagatagttcagtatttgaaaacaatgaattggacaaacattacacctaatttagtgtctgttctgaaatctactgaaaggatcaaatatacccatagagagtacagaaccagagcacacgcttttgtcctaaagaagcataaaaagaagagcccacctccacgtcaactcaaaatccactttggctcaagttacgttgcccttacaagggaatttgtccattttgctctttataataaaatagccattgagttactccagcggtctcaagatacctacagtccagataaacatttctggattacactcaacaatattcca

SEQ ID NO: 4005 - DNA, 1176 bp, Homo sapiens
atgaaggtttggagctgttatctttgtatcattactcttcaaattataatcatagtcacagtattatacaatgtgcatgtaagtcaaccagacagtggtcaaatagatgacgtaggtggtgaatatcaagccctttcccgactgcacatctgtgacgcagccctaaatgggaagacggtgcaagtattgccaagcgctttatccacaatgtttggaatagattcttgcccttactatgtgctagagaaccactatatcacaactcctttgtccacagaagaagctgcattccctttggcatatgtaatgaccatcagtcaagatttcgatacgtttgaatggcttttctgggctatttacatgcctcaaaatgtctactgtattcacgttgataaggcggccacgattgactttaaaattgctgtgagtgaattattggagtgcttctcaaatgcatttatatcctcacagtctgagtatattatttatggtggaaaatccaggctccaggcggacctggcctgcatgagagatcttatagcatcaactgttcagtggagatatgtcactaacactggtgatcacgatttccccctaaaaaccaacagggagatagttcagtatttgaaaacaatgaattggacaaacattacacctaatttagtgtctgttctgaaatctactgaaaggatcaaatatacccatagagagtacagaaccagagcacacgcttttgtcctaaagaagcataaaaagaagagcccacctccacgtcaactcaaaatccactttggctcaagttacgttgcccttacaagggaatttgtccattttgctctttataataaaatagccattgagttactccagcggtctcaagatacctacagtccagataaacatttctggattacactcaacaatattccagttgagtgtactgggccttggatattggcagtgaactctggctcctgccagaatagacacatctgtccacgtggccttgagtttcagcaacaatatccagttaacagctttggtggcaacaactgtagcatcgcagctggcactgcagcaccaagggaggccctggggcctttccacctgaaggcagcttgttctgctcatcagaacaagtggggattctggaactgctatttgcacctcaaatag

SEQ ID NO: 4006 - DNA, 1633 bp, Homo sapiens
ccttttgccttcggttggggctgctgtttctcttcgccgacggttcgtctcaaactcctgggctcaaaagatcctcatcttctcaagtggttgaatatacacgctccagcgaccatgcctggctgaatgaagagctttgagattttgaagaaacaggaaccatgaaatttgctttgcaactgtttgcaacctttaaggaagactgaaaaggcattcctgaagcatgtgccttcagccgctacaagagcagaagcagtgggcattggatggagctgagtacaggaccatacaggctaattgcaccggcacaggaatcggatataacatcatctgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccactcggctcaagaccaagggagcggggaatgggaaggggccactcaagggacagcccagagacatctaccaccagacctgggccagatacattgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctacccttgccaacggtactcaccacaatgtccgcctactcatgctggatgaccaacgcttgctgctgccccactgggcaaaggtggtactgacagacccagaagcagctaagtatgttcatggtattgctgtacattggtacctggactttctggctccagccaaagccaccctaagggagacacaccacctgttccccaacaccatgctctttgcctcagaggcctgtgtgggttccaagttctgggagcagagtgtgcggctaggctcctgggatcgagggatgcagtacagccacagcatcatcacaaacctcctgtaccatgtggtcggctggaccgactggaacccatcattgtagacatcaccaagcacacgttttacaaacagcccatgttctaccaccttggccacttcagcaagttcattcctgagggctcccagagagtggggctggttgccagtcagaagaacgacccggacgcagtggcactgatgcatcccgatggctctcctgttgtggtcgtcctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacaacagggccagcgtgagcttacagcgacgtaagcccaggggcaatggtttgggtgactcactttcccctctaggtggtgccaggggctggaggcccctagaaaaagatcagtaagccccagtgtcccccc

SEQ ID NO: 4007 - DNA, 1873 bp, Homo sapiens
cttttgccttcggttggggctgctgtttctcttcgccgacggtgacagggctttccctatgttgcccaggttcgtctcaaactcctgggctcaaaagatcctcatcttctcaagtggttgaatatacacgctccagcgaccatgcctggctgaatgaagagctttgagattttgaagaaacaggaaccatgaaatttgctttgcaactgtttgcaacctttaaggaagactgaaaaggcattcctgaagcatgtgccttcagccgctacaagagcagaagcagtgggcattggatggagctgagtacaggaccatacaggctaattgcaccggcacaggaatcggatataacatcatctgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccactcggctcaagaccaagggagcggggaatgggaaggggccactcaagggacagcccagagacatctaccaccagacctgggccagatacattgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctacccttgccaacggtactcaccacaatgtccgcctactcatgctggatgaccaacgcttgctgctgccccactgggcaaaggtggtactgacagacccagaagcagctaaaggcctgtgtgggttccaagttctgggagcagagtgtgcggctaggctcctgggatcgagggatgcagtacagccacagcatcatcacaaacctcctgtaccatgtggtcggctggaccgactggaacccatcattgtagacatcaccaagcacacgttttacaaacagcccatgttctaccaccttggccacttcagcaagttcattcctgagggctcccagagagtggggctggttgccagtcagaagaacgacccggacgcagtggcactgatgcatcccgatggctctcctgttgtggtcgtcctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacaacagggccagcgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagccca

SEQ ID NO: 4008 - DNA, 3759 bp, Homo sapiens
gcgcgtcctcgtccctccgtttgcactggtgttctctccgcggctgcctggtgcacctgcgggtcccccggggggcgctgcctcggcaaccaccgtcgccgcccagactgcgggagccgcgcccggggcagcctggagtgggggagcggagatgagcagcgactcggaccgccagtgtcctgtggacggagatattgatcaacaagagatgattccaagtaagaagaatgctgttcttgtggatggggttgtgctgaatggtcctacaacagatgcaaaagctggagaaaaatttgttgaagaggcctgtaggctaataatggaagaggtggttttgaaagctacagatgtcaatgagaaggtgtgtgaatggaggcctcctgaacaactgaaacagcttcttgatttggagatgagagactcaggcgagccaccccataaactattggaactctgtcgggatgtcatacactacagtgtcaaaactaaccacccaagatttttcaaccaattgtatgctggacttgattattactccttggtggcccgatttatgaccgaagcattgaatccaagtgtttatacgtatgaggtgtccccagtgtttctgttagtggaagaagcggttctgaagaaaatgattgaatttattggctggaaagaaggggatggaatatttaacccaggtggctcagtgtccaatatgtatgcaatgaatttagctagatacaaatattgtcctgatattaaggaaaaggggctgtctggttcgccaagattaatccttttcacatctgcagagtgtcattactctatgaagaaggcagcctcttttcttgggattggcactgagaatgtttgctttgtggaaacagatggaagaggtaaaatgatacctgaggaactggagaagcaagtctggcaagccagaaaagagggggcagcaccgtttcttgtctgtgccacttctggtacaactgtgttgggagcttttgaccctctggatgaaatagcagacatctgcgagaggcacagcctctggcttcatgtagatgcttcttggggtggctcagctttgatgtcgaggaagcaccgcaagcttctgcatggcatccacagggctgactctgtggcctggaacccacacaagatgctgatggctgggatccagtgctgtgctctccttgtgaaagacaaatctgatcttcttaaaaaatgctactctgccaaggcatcttacctcttccagcaggataaattctatgatgtgagctatgacacaggagacaagtctatccagtgtagcagaagaccagatgcattcaagttctggatgacctggaaggccctgggtacattaggccttgaagaaagagttaatcgtgctcttgctttatctaggtacctagtagatgaaatcaagaaaagagaaggattcaagttactgatggaacctgaatatgccaatatttgcttttggtacattccaccgagcctcagagagatggaagaaggacccgagttctgggcaaaacttaatttggtggccccagccattaaggagaggatgatgaagaagggaagcttgatgctgggctaccagccgcaccggggaaaggtcaacttcttccgccaggtggtgatcagccctcaagtgagccgggaggacatggacttcctcctggatgagatagacttactgggtaaagacatgtagctgtggctttggtcccccagaggcatagatcctatcctgggagagtttagatccagaacatcttggagatacacagtagattgcagcccttctgatgagaaatagggaatactcccagtccaggcccagcaaaaccaaaatgctaagcaatgaatattaaggactctctagctgcctgggcattactgttgctaaaagaagaaagtttaaaaaaaaaaatgattttctcaaggaatgcccctggaacacagctctgaagagagtttagtaagtaccatgtaggttctggattctaagcttacattgctctttaaagaacttataaactaacggtttaaagcagtggttctcaaagtgtggtccctggactatcagcatcaaagcatcacctgggaacttgctaaaaatgcagattctcaggctttctctagaccaactggatcagaagctctgggggtgaggcccagtattctgtgttttaacaagcccgtcagggaattctgatgcacagtaaaatccgagaaacactggtttaagaaaaaccttgtaatgatcgaatacccactctgatgttttgccagcaaagggatatctaatatttcagaagcctctgagccagtctttgaaaaaatacaactatggcatctgcagcacaaatatttaaggacatcagaagcatgtcaaagctatttttaaagagagaaactgtataagatgtttacttcatagagatttatgttttatgcaggctgaatgtttatctcaaaagttaaaattatccattctcaaaagttaaaattatatatatatatatatatacacacacacacatatatatatatatataattcaaagcacaataattgaaagcacaataattgacagaaaaatacaggttctattaataaattaataaactgttggtcttcaaaatagaaatgcatgtaatatccatattagttttttcttggtagacaactggaaggttttcttttttttcgtctatgactaattttctttattcaagatacctgaactggggtgctttttaagaaaaatttgggaaatatatatgtttctgtgatatacatatatacatatatatgtatatatatacacacacatacatatgtgtgtgtatagtatatatatatatacacacatatatgtttctgtgttcctcttttagcttgaggggcttgtttattatcttgctctgtgcctcatagggaataaacacaatgaagtccagggttgtacaacattccctttcctaagctttgaaatgtcagtatagattattaagtggtttatattacagaatctgggattcagcagactttcagtgtaaatgcttcctccatttctcctgagagtgggtgattttaattctatctctgaccctggtcctaggtttctaggagagttttgtttaactaagaaattgacagaattcataggtgtgggtgtagagttcaccaagataagattatgaatataattaaaggtctgcattaaaaggtgaatgattgaagagtgttaaagcattagacttagcacattcaataaccttttcgtactccattgttaaccaatgtcatttaaattttgagtactatttgcttttattgcttattttcattttagtgtgcacagtttctcggtatctctattggtcaaagaatattaaatctgtctctgaattacttcaaattctcaggtgaaacctattggtgtgtgtgtgtgtgtgtgtgtgtttattttgcatttcttgttgcctttttgttttaatgtctacataaaatatttctaaaattgatgtttgtaacaatttgggtttcatgaaacaaaaaggaacattactatacttagtgttgttgacttttcttttcctgtcatctcctctttactggattgtaccaatacattttagaagtgaactggacttggttggcattttagtttaatgactgaaaaagtaggttgaaagctctctgtattttagttaacaccttgaataaaatggaaaaagcagttatagc

SEQ ID NO: 4009 - DNA, 1814 bp, Homo sapiens
tgagcggccgccgagcgggtgcgggtgcgggcgcatcggccatcaccgcgcggccgcgcagcggacaccgtgcgtaccggcctgcggcgcccggccaccggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctactggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcaccaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgc

SEQ ID NO: 4010 - DNA, 1813 bp, Homo sapiens
aggagggcggaacccggaaggcacggcgctcagctcaggaccgcgcgccgtggtctgaggtccgcggcagggtcccgcatggcggcgcacaggaagcacgtgtttgtggagaaggtgctgcagagactttttcctcctgttccaagtggccaaggaaagagggaaccccagacgctggccgtccaaaatccaccaaagaaagtgacctctgagaaagtgagccagaaacatgctgagcctttgacagacactggctctgagaccccgactgcccgacggctctacactgccagcgggcctcctgagggctacgtcccctgttggccggagcccagcagctgtgggagccccgagaacgcctccagcggggatgacacagaagatcaggatcctcatgaccagccaaagagaagaagaattaggaagcataaatcaaagaaaaaatttaaaaatcccaataatgttcttatagaacaagcagaattagagaaacagcagagtctgttacaggagaaatctcagcgacagcacacagatggcaccacaataagcaaaaataaaaaaaggaaactgaaaaagaaacagcaaattaaaaggaagaaagcagccggcttggcagcaaaggctgctggtgtcagtttcatgtaccagcccgaggacagcagcaatgaaggggaaggcgtgggagaggcttgtgaggaggatggtgtggacaccagcgaggaagacccgacactggccggggaggaagacgttaaagataccagggaggaagatggtgcggacgctagcgaggaagacctgacacgggccaggcaggaagagggtgcggacgccagtgaggaagatccgacaccggccggggaggaagacgttaaagacgccagggaggaggacggtgtggacaccattgaggaagacctgacacgggccggggaggaagacggtaaagacaccagggaggaggacggtgcggacgccagcgaggaagacccgacatgggctggggaggaagagggtgcagactccggggaggaggacggtgcagacgccagcgaggaagatgatacaattaccaatgaaaaggcacacagtattctaaattttttgaagtcaacacaggaaatgtatttttatgacggtgtctccagagatgcagcttcagctgccctcgcagatgccgctgaggagctgctggaccgccttgcgtcacacagcatgctgccctcagacgtgtccatcctgtaccacatgaaaacgctgctgctcctgcaagatactgagagattgaagcatgctctggaaatgttcccagaacattgcacgatgcctcctgaccatgccagagtaatctcagctttctttagttactggatcacacatatccttcctgagaagagcagtgactaaaatggaatatctctttaagaacagctcctctttaacaaaaaaacttaaaagacaaatgtgagatgggcttagagttagttctctgggaacttgaaagacatttatgccatattatttattcacgtgtttgttcctggtgggcaagatgccatctgaggcttcagatgagaaattggggtaaaatggaaatttttcacttatttgcaattatatatatcttgaattactacataaaacttgattctgtttctctacttattgtaaaaattgaaaatggacattctgttaagttaaatgtatagtttgaagctcatatatttttatgaagttttgaatcaccttgtatctgaaagtctctgctttaagaatgctttctgggtattaaaatgttctagtttaagta

SEQ ID NO: 4011 - DNA, 2443 bp, Homo sapiens
cagctcaggaccgcgcgccgtggtctgaggtccgcggcagggtcccgcatggcggcgcacaggaagcacgtgtttgtggagaaggtgctgcagagactttttcctcctgttccaagtggccaaggaaagagggaaccccagacgctggccgtccaaaatccaccaaagaaagtgacctctgagaaagtgagccagaaacatgctgagcctttgacagacactggctctgagaccccgactgcccgacggctctacactgccagcgggcctcctgagggctacgtcccctgttggccggagcccagcagctgtgggagccccgagaacgcctccagcggggatgacacagaagatcaggatcctcatgaccagccaaagagaagaagaattaggaagcataaatcaaagaaaaaatttaaaaatcccaataatgttcttatagaacaagcagaattagagaaacagcagagtctgttacaggagaaatctcagcgacagcacacagatggcaccacaataagcaaaaataaaaaaaggaaactgaaaaagaaacagcaaattaaaaggaagaaagcagccggcttggcagcaaaggctgctggtgtcagtttcatgtaccagcccgaggacagcagcaatgaaggggaaggcgtgggagaggcttgtgaggaggatggtgtggacaccagcgaggaagacccgacactggccggggaggaagacgttaaagataccagggaggaagatggtgcggacgctagcgaggaagacctgacacgggccaggcaggaagagggtgcggacgccagtgaggaagatccgacaccggccggggaggaagacgttaaagacgccagggaggaggacggtgtggacaccattgaggaagacctgacacgggccggggaggaagacggtaaagacaccagggaggaggacggtgcggacgccagcgaggaagacccgacatgggctggggaggaagagggtgcagactccggggaggaggacggtgcagacgccagcgaggaagatgatacaattaccaatgaaaaggcacacagtattctaaattttttgaagtcaacacaggaaatgtatttttatgacggtgtctccagagatgcagcttcagctgccctcgcagatgccgctgaggagctgctggaccgccttgcgtcacacagcatgctgccctcagacgtgtccatcctgtaccacatgaaaacgctgctgctcctgcaagatactgagagattgaagcatgctctggaaatgttcccagaacattgcacgatgcctcctgccctgacttgatctgtttttcagctccagttcccagatgtgcgtgttgtggtccccaggtatcaactccaaattcctgggagcagtgctctggccgtacctgtctgggtttgttggccagcgctgaatccgcttagccaggagagcatggggtgtgcggggttcggtcagcctcacacacgtggcaggagtttctctctggacggcggccgcccacacctggccgacaggagcctgtcttcagcaactttcagttaacgcgtccctcttgccccatgcttgtcctgccacacaaatgtgaaaatgcaacgttacaaagatctgtgcctcagacaccatttgaacacagagaaactcgtgggcttatgtgactacacttttcaggttacggaatttctttaaggtgtacccttgagtttaatatacttattaataacttatcattacagagaaaaaattaccagaagtacagggtgtttttaacggactttcttctcttgcacattgctgggcatggcgtgtactgtgacagggcggagtgatgggctgagaatgtgtgtgtgtctccaacagttcccaaacgtctacattttcaagaaaaaggcaatctacatcatctggaaaattgtaacttagtaattaattaggataatttccctaggttctctgtgctgacttggacaattccaggtcaagaggaactgtctactttcgactttgtgtgatagtaactttttaagcagtggaccgggagcccaagactcagatgcagcaagctttgcaaggctgacgagagctgagatcttcagtggccgatgggtacagggctgctgggagcgtagccacgtctgctccaaggtggcttgaatgaggcagtgcccaagtccttttgactggctgaggtgagcctgtggctcagtcacagtttgtccctctcctaataagtgcatttcccagacagcagctccttggtgtcatgcaactgaggaacctaattggctgggtgggttgttcccatccaacttccacctgtcacgaaggatgctttttcagatcagtctccacagctaccatcttgtcgggcacagagccgggcatcaacaagtgtatgttgaataaagaatgaattgatgaaatg

SEQ ID NO: 4012 - DNA, 8554 bp, Homo sapiens
tacgaaccccgagccgccgccgccgccgccagcagcagctgcagcagtggcagctgcagtagcggcagcagccccagcctcaaggccagtttaagctatgaagaaggacatccctcacactctgaaacagatctccttcagagacagagttttgcagcctctcatcagcttcctggatatgctcccacacctcagcctactggtctttctggaatatttgatactagtgtgaacagtgccagcagtaacactaaagagtcttcagtgatgaattttctgtctactgctgaatcccgaactgctcaggctgctgcttcaggaactactctcttaccacaattcagggctccatcctggcagacaggcatgcattcctcagcagcaactgagctgtttgctactggacctttgccaagcactggaacacttccaccatctctctctgcttatcagcatcccaccaccttcagcaatagaaactttgctaccacttcacctttggtgcttcaggattcaacttttaacactacatcaaatggaattttaagtcatcatgaccctttgctacaaatcaagacttcccagggaactgttccaactgctttggcatttgagcgcctgggcagttctgtattaagtaacagcataccacctcagtcttcaacataccgctcagctcaagagtctgcaccccatcttttacaacctcaatttagtttgttgccttcagcacttgggggatcccagcagactcctcaagcctacagttcaactctctttactagttctactgcttccattgaaagagctcttcttcgagaatgtagtgttattaaacaccatcagcggccttcaggtacccagtcaattcaggcacaactgactggttcacagcactccttacatagttatctatcaaattcaagtgtagttaattttcaggaaacaaccaggcagtcatctttatcctgtagcccaattggagattccactcagaatttgccagactctagcccgacccagaattatatttctatgcattcttcccaaaatgttcagactcaagagtcatcatctccccagtcccagaagtttttgcctgctgtccagtcatcatcttttgcatcctctactcattgtcagacattacaaaataacataacttcccctgacccaaagtcttatgctgaaagaaagcttgactcagatgtgtatccatcttcaaagcaagaagatggttttccaatgcaagagttacaggtgttgcagccacaagcatctcttgagtcatcaacccaaaggctatctgatggagaaattaatgctcaagaatcaacttataaggtgtcaaaggcagatgacagatattctcagagtgtaatcagaagtaattcccgtcttgaagatcaagttattggggttgctctgcaagcatcaaaaaaagaagaaagtgttgttggttcagtgacacaacttaaccaacaaattggccaagtcaataatgcagctacccttgatcttaagaactcaactaatttaatacagactccacaaataaggttgaatactaaagacttaaagcagcaacatcctctcatacttaaggtgcatgagtccaaggtccaggaacagcacgatcaaataattaatgcttcatctcagattcaaattccaaatcatgctttagggcatggccatcaggcatctcttcctaatacacaggtccttttagattctgcctgtgatttacaaattcttcagcagtcaatactgcaggcaggtttaggtcaagtaaaggcatctttacaagcacagcgtgttcaaagccctcaacaaatagtacatcccttccttcagatggaaggtcatgttattcaaagcaatggtgatcattctcagcagcaactccatcctcaaaattctgaagttatgaaaatggacctctctgagtcttcaaaaccattacaacaacatctaacaacaaagggccattttagtgaaacaaatcaacatgattcaaagaatcagtttgtttctcttggatcgatgtgtttcccagaggcagtgcttcttagtgatgaaagaaatattttatcaaatgtagatgatatcttagcagctacagcagcagcttgtggagttacacctactgatttttccaagtcaacttcaaatgaaaccatgcaggctgttgaagatggtgattctaaatctcattttcagcagtcattagatgtcaggcatgtgacttcagattttaactctatgacagctacagtaggaaagccacagaatataaatgatacttccttaaatggaaatcaggttactgtgaacctttcaccagtacctgcccttcagtcaaaaatgactcttgatcaacagcacattgaaacacctggtcaaaatataccaactaaagtaacttcagcagtggttggaccaagtcatgaagtccaggagcaaagttctggcccattcaagaaacagtctgctaccaatcttgaatctgaagaagacagtgaagctcctgttgatagtacattaaataataacagaaaccaagagtttgtttctagtagtagaagtataagtggagagaatgctacatcagagagtgaatttaccttagggggtgacgacagtggtgtgtcaatgaacccagctaggagtgcacttgcactgttggccatggcccaatctggggatgcagtcagtgtcaagattgaagaagaaaaccaagatttaatgcattttaaccttcaaaagaaaagagctaaaggaaaagggcaagttaaagaggaagacaacagtaatcagaaacagctgaaaagacctgcccaaggcaaacgccagaatccaaggggaacagatatttacttaccgtatactcctccttcctcagaaagctgccatgatggttatcagcatcaagaaaaaatgagacagaagatcaaagaggtggaggaaaaacaaccagaagtcaaaacaggatttattgcttctttcttagattttctgaaatccgggcccaagcagcagttttccactcttgctgtacgaatgcctaacaggactagacggccagggacccagatggttcgtacattttgtcccccaccacttcccaagccttcatctacaacacccacacctttagtgtctgaaactggcggtaacagtccatcagataaagttgataatgaacttaaaaacttggaacatttatcttcattttcttctgatgaagatgatcctggatatagtcaagatgcttataaaagcgtctctactcccttaactactttggatgctacttctgataaaaagaagaaaacagaagccctacaggtggcaactactagcccaactgccaatactactggtactgctactacttcctcaaccactgtgggtgcagttaagcaagaacctctccactctacttcatatgcagtaaatattctggaaaatataagctcttcagaatcctcaaagcccattgaacttgatggtcttccttcagaccagtttgcaaaaggacaggacactgttgccatagaaggttttacagatgaggaggacacagaaagcggaggagaaggccaatacagagagcgtgatgaatttgtggtaaagatagaagacatagagacttttaaggaggctttaaaaacaggaaaagaacctccagctatttggaaagtacaaaaagctttattacagaaatttgttcctgaaattcgagatggtcaaagagaatttgctgctacaaatagttatcttggatattttggagatgcaaagagtaaatacaaaagaatatatgtgaagttcattgaaaatgcaaacaagaaggaatatgtcagagtgtgttctaaaaagccaagaaataaaccttcacaaactatcagaactgttcaagctaagccaagtagtagcagtaaaacttctgatcctctagcatcaaaaactacaactacaaaagccccttccgtgaaacccaaagttaaacagccaaaagtaaaggctgagccaccaccaaagaaacggaaaaaatggaaagaagaattttcatcatcccaatctgactcatctcctgagatccatactagtagtagtgacgatgaggaatttgaacctcccgctccctttgtcactcgctttttgaacacaagagcaatgaaggaaacctttaagagctacatggaattgcttgttagcattgccttggaccctgacacaatgcaagccttagagaagagcaatgatgagctacttttacctcatatgaaaaaaatagatggcatgctaaatgataaccgaaagagacttcttttgaatcttcatttggatcaatcattcaagaatgctttggaaagttttcctgaactaacaataattactcgagattctaaagcaaagagtggaggaactgctatttctaaaatcaaaatgaatggcaaagcctataataagaaaactctaaggacttctaaaacaaccaccaaatctgcacaagagtttgctgtcgatccagagaaaatacagttgtattctttgtatcattcactccatcattataagtaccatgtttatctgatatgtaaggatgagatttcttcggtgcagaaaaaaaatgaagatttaggacaggaggaaattgttcaactttgtatgaaaaatgtaaaatgggtggaggacctctttgaaaaatttggagaacttctaaatcatgtacagcagaaatgttcctgacttttccacaaaaatcccatctttttatagcactaatgaaatggcagatatggggtggtcaaagataatcagatgtcaagtagtggccttctgcaggccggccgcttccatcatggaactgtcattaccacctctgctgaaggacagtggtgcggcctttaggaacgaagttagtcctctggaaatggacctaaatcccaccacatttttaccctaatgaatgatttttctattttgtaaaccattgggtaacttgagtcatattttcagaaacattttttgacaaatgatgaagcatgcactaagtataatttttttttattgctagagaagtaacacttaaagtaacgattttttttttctgactccggctaaacaccagaatgacagagaagtggcagaaaccatatgtttgtactcacatctggccacaaaaccagaaatactgtacattatgtaaagaggtctggtgtggtgtgacatcctgtataagaatatcatcaatttaaaatataaaatttggaaactattctgctttacagactccttttactcttaacatgttcaggaaactggatgtggaattggtgcaattctctgactgctttttgtgtcaaattatattgtgataaaaaaacaatgacatactattttccctatcgcaaagaaaagtattttcgtttatactgttttttcctttggaaaattttcaattgtacattttatttcactgatagttgtatttttcacaaggaaaatgttgtggttataattacgtttgatatatctctacaacaccttttgttattttcagtaaatcttagttatatgttgaatttctaatgtgaattctatcttgaggtaaccatttttttcatacagatttgcttcagtgttatccagaatatgcattcagtactagaattagtttagctttataaatagggctgtgttagacactgcagtaattttctaattcataaaataaacttcttactaaactagcacttgattaacttgttgaggtaaaaatctaactacatttacattttgaagaataaaactgataattagactatttgcagtgttaaacacagcttccttaactcttagaactggaagttgtagagctctccttttggtgcctttccagcctttatacacactattgtagctttcttaggtttgataggtagcgtttcaagtagtttagctgagacagtgaatgtattaggttcaacatgaccttgtgttttatttgtgtttgccaacaggatgccttatttgtttgagaaaaagatgtactagtgtcattctaaactatctccttttttaggattctaaagaagttaatcatcatccttttgtttattttaccaccatttagtgccttaaatcctatcaagaaagcagtgttactgctcaatgcccaaataagacacgcggatattgctattgtcttgcttttgagttaacaggccaactttttatacttaaaacctcagtaaactggcaaagaattgaaggtaatgtgatttgatttgagaataaaacattgtagcattgggtgaaaaatgagtatttgagttaagcttacatatttatttctgatggttatcttattaaaagcaataatccttaatactgtacttgccattagactaggtactcagtaatggaagtttctctcaagggttaaatgttccatttttgaaagttttaaaaaacctgtttgggtggtttattttgaaaacaaaagtaacctattagattcattttgcctaactcatatgagagatgcagagtatcaacagtgggagcatcataaaatgaattttccaagtggagaggagtaggaagcagccatatgatagtattgactctggacagaattgatgtctttcgtttccaaagtgcagagtagggaactacatttcctaatgtggcattgtaaatatacatctttatattactcttccagcctacgttcctaaatcattgataatttaaatattttttaaagccaccttaatttaggtagctcttggaatcgatgtttgaattcactagccacattttcttcatgatatgcctcgtggcaaacaaagatgtttccttaagatgaatcttacatttcccatagaaaataacccatttcctttggcactgcagttgccctcaaactgcttgcagttgtattcattttagtacaacaaaggttttcataatatgggaggccaagtctatgatactgcctcaaagagaccctattgtgtagatgcatcatcttctctcatttgatccatagagcataggcaaagatgtcaacctcaggccttagagaaaagtggaaatgttattatgacagccgtccatgagttatcgctttgtatgaagttaaatacagtcatgcgttgcttaacagcagggatacattctgagaaatgcattgttaggcaattccgttgtgcgaacatcctagtgtacttacacaaacctaggtggcatagcccacaacgtacccaggctatatggtaaacctgtacagcatgttactgtactgaatactgtaggcagttgtaacacaatggtatttgtgtatctagacatagaaaacatacagtaagaatatggtattataatcttacgggaccactgtcaaatacgcggtctgtctttgaaaagttgtaatgcggcgcatgactataaatacctagctggttagcatttacattccttgccagggagtttgaaatttatactatagaaataactttaggttttaggtagagttaaagaggtaaagcacatgttgccacaacccaggaaagtatttttaagaaagattggattttcctacctttagagatctaaaaaaaatttaatataaaaaatcattttgtgttggtgtttattactagttcagatgagtggctgctgaaggggcccccttgtcattttcattataacccaatttccacttatttgaactcttaagtcataaatgtataatgacttatgaattagcacagttaagttgacactagaaactgcccatttctgtattacactatcaaataggaaacattggaaagatggggaaaaaaatcttattttaaaatggcttagaaagttttcagattactttgaaaattctaaacttctttctgtttccaaaacttgaaaatatgtagatggactcatgcattaagactgttttcaaagctttcctcacatttttaaagtgtgattttccttttaatatacatatttattttctttaaagcagctatatcccaacccatgactttggagatatacctataaaaccaatataacagcagggttattgaagcagctttctcaaatgttgcttcagatgtgcaagttgcaaattttattgtatttgtagaatacaatttttgttttaaactgtatttcaatctatttctccaagatgcttttcatatagagtgaaatatcccaggataactgcttctgtgtcagtcgcatttgacgcataactgcacaaatgaacagtgtatactcttggttgtgcattaacttacatgtataatttttggcatctgtgttcacaaatgcatgtgttagcaaatcacctttatttataagtgacaataattgaagttaaggatataaagaaacctgcatttgtagtccagcgttttcatttggtccataacacaatgtatggaaatgtgaaagacaattttgtacatttgtttgttactaactcagatcattaaaatgaaaacaatttttttaaacaagaaaa

SEQ ID NO: 4013 - DNA, 9335 bp, Homo sapiens
cgcccgcgccccccgccgcccccgtccccgccagcgccgctgcgcagccccccgccccagcctgggcgtacgaaccccgagccgccgccgccgccgccagcagcagctgcagcagtggcagctgcagtagcggcagcagccccagcctcaaggccagtttaagctatgaagaaggacatccctcacactctgaaacagatctccttcagagacagagttttgcagcctctcatcagcttcctggatatgctcccacacctcagcctactggtctttctggaatatttgatactagtgtgaacagtgccagcagtaacactaaagagtcttcagtgatgaattttctgtctactgctgaatcccgaactgctcaggctgctgcttcaggaactactctcttaccacaattcagggctccatcctggcagacaggcatgcattcctcagcagcaactgagctgtttgctactggacctttgccaagcactggaacacttccaccatctctctctgcttatcagcatcccaccaccttcagcaatagaaactttgctaccacttcacctttggtgcttcaggattcaacttttaacactacatcaaatggaattttaagtcatcatgaccctttgctacaaatcaagacttcccagggaactgttccaactgctttggcatttgagcgcctgggcagttctgtattaagtaacagcataccacctcagtcttcaacataccgctcagctcaagagtctgcaccccatcttttacaacctcaatttagtttgttgccttcagcacttgggggatcccagcagactcctcaagcctacagttcaactctctttactagttctactgcttccattgaaagagctcttcttcgagaatgtagtgttattaaacaccatcagcggccttcaggtacccagtcaattcaggcacaactgactggttcacagcactccttacatagttatctatcaaattcaagtgtagttaattttcaggaaacaaccaggcagtcatctttatcctgtagcccaattggagattccactcaggtgagcaacggaggattacaacagaagacctcccaggtctcagtggaacttgctcagtcttactcatctgcgattccatcatcagggtatcctccttctactacaaaaataaaaagctgttctacagaacaaccactgacatcaaccaagacccctaaacctcaaagtataattcctcctgtgcaaacactaagctattccaaacctttacataatcagagttctgtaatatcgggccaagcacaaatttattctacagcgcagctaccaagccttttatcagttagtcagtcccaaaattacggtttagtacagccacataatgtgccatctattgttcattcacaggtttataggtccagcaaggttgagaaattgccacccttgtataaaacattgactttttctgggtcatctcagactgtaactcctgaaaatcagacgcttaattattcatctaatcagcaagaggtattgtcttcagttacaaatgagaattaccctgctcaaacaagagatctgtcttcagtaagtcagtctcaaagttactcatctggtcactctcagggtttatcaccagttagccagacacaggttagctattcatctcaatcacaagttttgtcagttgttagtctttcagaaagctatgcttcaggggagtccctaacattaacagccccttctctttcttattcttctgcctctcgggctcagaatttgccagactctagcccgacccagaattatatttctatgcattcttcccaaaatgttcagactcaagagtcatcatctccccagtcccagaagtttttgcctgctgtccagtcatcatcttttgcatcctctactcattgtcagacattacaaaataacataacttcccctgacccaaagtcttatgctgaaagaaagcttgactcagatgtgtatccatcttcaaagcaagaagatggttttccaatgcaagagttacaggtgttgcagccacaagcatctcttgagtcatcaacccaaaggctatctgatggagaaattaatgctcaagaatcaacttataaggtgtcaaaggcagatgacagatattctcagagtgtaatcagaagtaattcccgtcttgaagatcaagttattggggttgctctgcaagcatcaaaaaaagaagaaagtgttgttggttcagtgacacaacttaaccaacaaattggccaagtcaataatgcagctacccttgatcttaagaactcaactaatttaatacagactccacaaataaggttgaatactaaagacttaaagcagcaacatcctctcatacttaaggtgcatgagtccaaggtccaggaacagcacgatcaaataattaatgcttcatctcagattcaaattccaaatcatgctttagggcatggccatcaggcatctcttcctaatacacaggtccttttagattctgcctgtgatttacaaattcttcagcagtcaatactgcaggcaggtttaggtcaagtaaaggcatctttacaagcacagcgtgttcaaagccctcaacaaatagtacatcccttccttcagatggaaggtcatgttattcaaagcaatggtgatcattctcagcagcaactccatcctcaaaattctgaagttatgaaaatggacctctctgagtcttcaaaaccattacaacaacatctaacaacaaagggccattttagtgaaacaaatcaacatgattcaaagaatcagtttgtttctcttggatcgatgtgtttcccagaggcagtgcttcttagtgatgaaagaaatattttatcaaatgtagatgatatcttagcagctacagcagcagcttgtggagttacacctactgatttttccaagtcaacttcaaatgaaaccatgcaggctgttgaagatggtgattctaaatctcattttcagcagtcattagatgtcaggcatgtgacttcagattttaactctatgacagctacagtaggaaagccacagaatataaatgatacttccttaaatggaaatcaggttactgtgaacctttcaccagtacctgcccttcagtcaaaaatgactcttgatcaacagcacattgaaacacctggtcaaaatataccaactaaagtaacttcagcagtggttggaccaagtcatgaagtccaggagcaaagttctggcccattcaagaaacagtctgctaccaatcttgaatctgaagaagacagtgaagctcctgttgatagtacattaaataataacagaaaccaagagtttgtttctagtagtagaagtataagtggagagaatgctacatcagagagtgaatttaccttagggggtgacgacagtggtgtgtcaatgaacccagctaggagtgcacttgcactgttggccatggcccaatctggggatgcagtcagtgtcaagattgaagaagaaaaccaagatttaatgcattttaaccttcaaaagaaaagagctaaaggaaaagggcaagttaaagaggaagacaacagtaatcagaaacagctgaaaagacctgcccaaggcaaacgccagaatccaaggggaacagatatttacttaccgtatactcctccttcctcagaaagctgccatgatggttatcagcatcaagaaaaaatgagacagaagatcaaagaggtggaggaaaaacaaccagaagtcaaaacaggatttattgcttctttcttagattttctgaaatccgggcccaagcagcagttttccactcttgctgtacgaatgcctaacaggactagacggccagggacccagatggttcgtacattttgtcccccaccacttcccaagccttcatctacaacacccacacctttagtgtctgaaactggcggtaacagtccatcagataaagttgataatgaacttaaaaacttggaacatttatcttcattttcttctgatgaagatgatcctggatatagtcaagatgcttataaaagcgtctctactcccttaactactttggatgctacttctgataaaaagaagaaaacagaagccctacaggtggcaactactagcccaactgccaatactactggtactgctactacttcctcaaccactgtgggtgcagttaagcaagaacctctccactctacttcatatgcagtaaatattctggaaaatataagctcttcagaatcctcaaagcccattgaacttgatggtcttccttcagaccagtttgcaaaaggacaggacactgttgccatagaaggttttacagatgaggaggacacagaaagcggaggagaaggccaatacagagagcgtgatgaatttgtggtaaagatagaagacatagagacttttaaggaggctttaaaaacaggaaaagaacctccagctatttggaaagtacaaaaagctttattacagaaatttgttcctgaaattcgagatggtcaaagagaatttgctgctacaaatagttatcttggatattttggagatgcaaagagtaaatacaaaagaatatatgtgaagttcattgaaaatgcaaacaagaaggaatatgtcagagtgtgttctaaaaagccaagaaataaaccttcacaaactatcagaactgttcaagctaagccaagtagtagcagtaaaacttctgatcctctagcatcaaaaactacaactacaaaagccccttccgtgaaacccaaagttaaacagccaaaagtaaaggctgagccaccaccaaagaaacggaaaaaatggaaagaagaattttcatcatcccaatctgactcatctcctgagatccatactagtagtagtgacgatgaggaatttgaacctcccgctccctttgtcactcgctttttgaacacaagagcaatgaaggaaacctttaagagctacatggaattgcttgttagcattgccttggaccctgacacaatgcaagccttagagaagagcaatgatgagctacttttacctcatatgaaaaaaatagatggcatgctaaatgataaccgaaagagacttcttttgaatcttcatttggatcaatcattcaagaatgctttggaaagttttcctgaactaacaataattactcgagattctaaagcaaagagtggaggaactgctatttctaaaatcaaaatgaatggcaaagcctataataagaaaactctaaggacttctaaaacaaccaccaaatctgcacaagagtttgctgtcgatccagagaaaatacagttgtattctttgtatcattcactccatcattataagtaccatgtttatctgatatgtaaggatgagatttcttcggtgcagaaaaaaaatgaagatttaggacaggaggaaattgttcaactttgtatgaaaaatgtaaaatgggtggaggacctctttgaaaaatttggagaacttctaaatcatgtacagcagaaatgttcctgacttttccacaaaaatcccatctttttatagcactaatgaaatggcagatatggggtggtcaaagataatcagatgtcaagtagtggccttctgcaggccggccgcttccatcatggaactgtcattaccacctctgctgaaggacagtggtgcggcctttaggaacgaagttagtcctctggaaatggacctaaatcccaccacatttttaccctaatgaatgatttttctattttgtaaaccattgggtaacttgagtcatattttcagaaacattttttgacaaatgatgaagcatgcactaagtataatttttttttattgctagagaagtaacacttaaagtaacgattttttttttctgactccggctaaacaccagaatgacagagaagtggcagaaaccatatgtttgtactcacatctggccacaaaaccagaaatactgtacattatgtaaagaggtctggtgtggtgtgacatcctgtataagaatatcatcaatttaaaatataaaatttggaaactattctgctttacagactccttttactcttaacatgttcaggaaactggatgtggaattggtgcaattctctgactgctttttgtgtcaaattatattgtgataaaaaaacaatgacatactattttccctatcgcaaagaaaagtattttcgtttatactgttttttcctttggaaaattttcaattgtacattttatttcactgatagttgtatttttcacaaggaaaatgttgtggttataattacgtttgatatatctctacaacaccttttgttattttcagtaaatcttagttatatgttgaatttctaatgtgaattctatcttgaggtaaccatttttttcatacagatttgcttcagtgttatccagaatatgcattcagtactagaattagtttagctttataaatagggctgtgttagacactgcagtaattttctaattcataaaataaacttcttactaaactagcacttgattaacttgttgaggtaaaaatctaactacatttacattttgaagaataaaactgataattagactatttgcagtgttaaacacagcttccttaactcttagaactggaagttgtagagctctccttttggtgcctttccagcctttatacacactattgtagctttcttaggtttgataggtagcgtttcaagtagtttagctgagacagtgaatgtattaggttcaacatgaccttgtgttttatttgtgtttgccaacaggatgccttatttgtttgagaaaaagatgtactagtgtcattctaaactatctccttttttaggattctaaagaagttaatcatcatccttttgtttattttaccaccatttagtgccttaaatcctatcaagaaagcagtgttactgctcaatgcccaaataagacacgcggatattgctattgtcttgcttttgagttaacaggccaactttttatacttaaaacctcagtaaactggcaaagaattgaaggtaatgtgatttgatttgagaataaaacattgtagcattgggtgaaaaatgagtatttgagttaagcttacatatttatttctgatggttatcttattaaaagcaataatccttaatactgtacttgccattagactaggtactcagtaatggaagtttctctcaagggttaaatgttccatttttgaaagttttaaaaaacctgtttgggtggtttattttgaaaacaaaagtaacctattagattcattttgcctaactcatatgagagatgcagagtatcaacagtgggagcatcataaaatgaattttccaagtggagaggagtaggaagcagccatatgatagtattgactctggacagaattgatgtctttcgtttccaaagtgcagagtagggaactacatttcctaatgtggcattgtaaatatacatctttatattactcttccagcctacgttcctaaatcattgataatttaaatattttttaaagccaccttaatttaggtagctcttggaatcgatgtttgaattcactagccacattttcttcatgatatgcctcgtggcaaacaaagatgtttccttaagatgaatcttacatttcccatagaaaataacccatttcctttggcactgcagttgccctcaaactgcttgcagttgtattcattttagtacaacaaaggttttcataatatgggaggccaagtctatgatactgcctcaaagagaccctattgtgtagatgcatcatcttctctcatttgatccatagagcataggcaaagatgtcaacctcaggccttagagaaaagtggaaatgttattatgacagccgtccatgagttatcgctttgtatgaagttaaatacagtcatgcgttgcttaacagcagggatacattctgagaaatgcattgttaggcaattccgttgtgcgaacatcctagtgtacttacacaaacctaggtggcatagcccacaacgtacccaggctatatggtaaacctgtacagcatgttactgtactgaatactgtaggcagttgtaacacaatggtatttgtgtatctagacatagaaaacatacagtaagaatatggtattataatcttacgggaccactgtcaaatacgcggtctgtctttgaaaagttgtaatgcggcgcatgactataaatacctagctggttagcatttacattccttgccagggagtttgaaatttatactatagaaataactttaggttttaggtagagttaaagaggtaaagcacatgttgccacaacccaggaaagtatttttaagaaagattggattttcctacctttagagatctaaaaaaaatttaatataaaaaatcattttgtgttggtgtttattactagttcagatgagtggctgctgaaggggcccccttgtcattttcattataacccaatttccacttatttgaactcttaagtcataaatgtataatgacttatgaattagcacagttaagttgacactagaaactgcccatttctgtattacactatcaaataggaaacattggaaagatggggaaaaaaatcttattttaaaatggcttagaaagttttcagattactttgaaaattctaaacttctttctgtttccaaaacttgaaaatatgtagatggactcatgcattaagactgttttcaaagctttcctcacatttttaaagtgtgattttccttttaatatacatatttattttctttaaagcagctatatcccaacccatgactttggagatatacctataaaaccaatataacagcagggttattgaagcagctttctcaaatgttgcttcagatgtgcaagttgcaaattttattgtatttgtagaatacaatttttgttttaaactgtatttcaatctatttctccaagatgcttttcatatagagtgaaatatcccaggataactgcttctgtgtcagtcgcatttgacgcataactgcacaaatgaacagtgtatactcttggttgtgcattaacttacatgtataatttttggcatctgtgttcacaaatgcatgtgttagcaaatcacctttatttataagtgacaataattgaagttaaggatataaagaaacctgcatttgtagtccagcgttttcatttggtccataacacaatgtatggaaatgtgaaagacaattttgtacatttgtttgttactaactcagatcattaaaatgaaaacaatttttttaaacaag

SEQ ID NO: 4014 - DNA, 818 bp, Homo sapiens
attccatagaatactataattagagaggttatggaggttatttcatctggtcctttttttatacagatgaaattagtccaacaataattgagtcccttatttaaattacactgtaagccagaagtagagcctgtacaatgaattcacctctctgttgtccaggatattactttttcttctgtaccacattacctctcccagtaaaaagactcttgtttgaggtagaattgaattaaagaaaatactgtgtattatttttcttactaatgcatcttaaatatatttcctccattgtgatagtattgtcagactgtgtttgatccacgaatctataggtcaggaaattggtcaaaggtttctactacttttatagttgttcttctagaagttttttttatcagatggtttggactgtgtattttggtcactgatttttaatgtcctctagtttaagctatgaagaaggacatccctcacactctgaaacagatctccttcagagacagagttttgcagcctctcatcagcttcctggatatgctcccacacctcagcctactggtctttctggaatatttgatactagtgtgaacagtgccagcagtaacactaaagagtcttcagtgatgaattttctgtctactgctgaatcccgaactgctcaggctgctgcttcaggaactactctcttaccacaattcagggctccatcctggcagacaggcatgcattcctcagcagcaactgagctgtttgctactggacctttgccaagcactggaacacttccaccatctctctctgcttatcagcatccc

SEQ ID NO: 4015 - DNA, 5359 bp, Homo sapiens
ggcggccaggtggaggacctgagcaagcagctcaagcgtgtggacggccaggtgcagggcatcgccacgcacgtgcagcacttctcccaggccagcgggcttgacctggccgcgctagagtggccggaggagcaggaggtgggcgtgcgggcgttcgatagggtgcggactgggagtatcatgaaggacgccgccgaggagctcagctttgccagggtacttttacagcgggttgatgaactagagaagctattcaaagatcgggagcaattcctggaactagtcagccggaagctgagtttggttcctggtgcagaagaagtcaccatggtcacctgggaagagctggagcaggcgattacggacggctggagagcctcacaagcgggctcagaaacacttatgggattttctaagcacggagggttcacttccttaacatcacctgaagggactctaagcggagactctaccaagcaaccaagtattgagcaggctctggattctgccagtggtcttggcccggatcggactgcatcaggatctggtggcacagcacacccctctgatggggtttccagtagggaacaaagcaaggtcccctctggtactgggagacagcagcagccgagggcccgtgatgaagctggcgtgccacgactccatcagtcttctacattccaattcaaatcagactcagatcgtcacaggagtagagagaagcttacctcgacacaaccaagaagaaatgcacgtcctggtccagttcaacaggacttacccttggccagagaccagcccagtagtgtgcccgctagccagagtcaggtccatctaaggccagatcgtcgtgggttagaaccaactggcatgaatcagcctggattagtgcctgctagcacttacccacatggtgtggtacccctcagcatgggtcagcttggtgtgccaccacctgaaatggatgatcgggaattgataccatttgtcgtggatgagcaacgtatgttgccaccatcagtacctggcagagaccagcaaggattggaactacctagcacagaccaacatggtctggtttcagtcagtgcatatcagcatggtatgacatttcctggcacagaccaacgcagtatggaaccacttggcatggatcagcgtggatgtgtaatatcaggcatgggtcagcaaggactagtaccccctggtatagaccagcaaggattgacattgcctgtcgtcgatcaacatggcctggttctaccttttacagaccagcatggtttggtatcacctggtttgatgccaattagtgcagatcagcaaggttttgtgcagcccagtttggaagcaactggcttcatacaacctggcacagagcagcatgatttgatccagtctggcagatttcagcgtgctttggtgcagcgtggtgcatatcagcctggcttggtccaacctggtgcagatcagcgtggtttggtccggcctggaatggatcagtctggtttggcccaacctggtgcagatcagcgtggtttggtctggcctggaatggatcagtctggtttggcccaacctggtagagatcagcatggtttgatccagcctggcacaggtcagcatgatttggtccaatctggcacaggtcagggtgtcttggtacagcctggtgtagatcagcctggcatggtccaacctggcagatttcagcgtgctttggtgcagcctggtgcatatcagcctggcttggtccaacctggtgcagatcagattgatgtggtgcaacctggtgcagatcagcatggtttggtacaatctggtgcagatcagagtgatttggctcaacctggtgcagttcagcatggtttggtccaacctggagtagatcagcgtggtttggcacaacctcgtgcagatcatcagcgtggtttggtcccacctggtgcagatcagcgtggtttggtccaacctggtgcagatcagcatggtttggtccaacctggagtggatcagcatggtttggcacaacctggtgaagttcagcgtagtttggtgcaacctggtatagttcagcgtggtttggtgcaacctggtgcagttcagcgtggtttggtgcaacctggtgcagttcagcgtggtttggtccaacctggagtggatcagcgtggtttggttcaacctggtgcagttcagcgtggtttggtccaacctggtgcagttcagcatggtttggtccaacctggtgcagatcagcgtggtttggtccaacctggagtggatcagcgtggtttggtgcaacctggagtggatcagcgtggtttggtccaacctggaatggaccagcgtggtttgatccaacctggtgcagatcagcctggtttggtccagcctggtgcaggtcagctgggtatggtgcagcctggaataggtcagcaaggtatggtgcaacctcaggcagatccacatggcctggtacaacctggtgcctatcctcttggtttggtacaacctggtgcatatttgcatgatttatctcaatctgggacatatccacgtggtctggtgcagccaggaatggatcagtatggtttgagacaacctggtgcatatcagccaggcttgatagcaccaggcacaaagcttcgtggctcttcaacattccaggcagattctacaggttttatatcagtacgtccatatcaacatggtatggtacctcctggcagagaacaatacggccaggtgtcaccactcctagccagtcaaggtttggcatcacctggtatagatcgaaggagtttggtaccaccagaaacttatcagcaaggtttgatgcatcctggcacagaccagcacagcccaataccactgagtacaggtttgggatctacacacccagatcaacagcatgtggcatcacctggcccaggtgagcatgaccaggtatacccagatgcagctcagcatggccatgctttctctctctttgacagtcatgattcaatgtatcctggttatcgtggcccagggtatctaagtgctgatcagcatggccaggaaggtttggatccaaatagaacacgagcctcggaccgacatggaattcctgcccagaaggccccaggccaagatgtcactcttttcaggagtccagactccgtcgaccgagtcttatcagaagggagcgaagtctcgagtgaagtcctgagtgagcgacgcaattcactgcgtagaatgagttctagtttccccacggcagtggagacatttcatctgatgggagagctcagtagcctctatgtggggctaaaggagagtatgaaggatctggatgaggagcaggccggccaaaccgacttggagaagatccagttcctgctggcacagatggtcaaaaggaccatacctcctgaactgcaggagcagctgaagaccgtaaagacgctagccaaagaagtttggcaggagaaagcaaaagtggaaaggctgcagaggatcctggaaggggaagggaatcaagaagcagggaaggaactgaaagctggagagctgagattgcagctgggtgtcctcagagtcaccgtggctgacatagaaaaggagctggccgagttgagggagagccaagacaggggcaaggctgccatggaaaattctgtctctgaagcctccctttacctgcaggaccagttggacaagctcaggatgatcattgagagcatgctgacctcctcctccacgctcctgtccatgagcatggccccgcacaaggcccacaccttggctcctggccagatcgaccctgaggccacctgtccagcctgcagcctggatgtgagccatcaggtcagcacgctggtgcggcgctatgagcaactccaagacatggtcaacagcctggccgtctcccgaccctccaagaaggccaagctccagagacaggacgaggagctgctgggccgtgtgcagagtgccatcctgcaggtgcagggtgactgcgagaagctcaacatcaccaccagcaacctcatcgaggaccatcggcagaaacagaaggacattgctatgctgtaccagggtctggagaagctcgaaaaggaaaaggccaacagggagcacctggagatggagatcgatgtgaaagccgacaagagtgctctggccaccaaagtgagccgtgtccagtttgatgccaccacggagcagctgaaccacatgatgcaggagctggtggccaagatgagcgggcaggagcaggactggcagaagatgctggacaggctgctcacagagatggacaacaagctggaccgcctggagctggacccagtgaagcagttgctggaggatcggtggaaatcgctgcgacagcagctcagggagcgccccccactctaccaggcagacgaggcggctgccatgcggaggcagctcctggcacatttccactgcctctcatgtgaccggcccttggagacacctgtgactggacatgccatccccgtgacccccgcgggtccaggcctacctgggcaccattccatccgcccctacacggtgtttgaactggagcaggtccggcagcatagccgcaacctcaagctgggcagcgccttccctcggggtgacctggcgcagatggagcagagcgtggggcgcctgcgctccatgcactccaagatgctgatgaacattgagaaggtgcagatccacttcgggggctccaccaaggccagcagccagataatccgcgagctgctgcacgcccagtgcctgggctccccctgctacaaacgggtgacagatatggctgattacacctactcaactgtgccccggcgctgcgggggcagccacaccctcacctacccctaccaccgcagccgcccgcagcaccttccccggggcctgtatcctactgaagagatccagattgccatgaagcatgatgaggtggacatcttgggcctggatggccacatttacaagggacggatggacacaaggctgccaggcatcctccgaaaagacagctcagggacctcaaagcgcaagtcccagcagcccaggccccacgtgcacaggccgccatccctcagcagcaatggccagctgccctctcggccacagagcgcccagatttcggctggcaacacctcagaaagatagaccttcctccgagggccgtctctcccagccgaacacagcccacccgcccagctccgccgcggtggcaaacagggggctggagaggcacgtggacatgcctcctggggaggggctcgaggagcccacgcgggggccgcggtccagcaccgctcagtgagcggaggtgtaaataaacattcaggaggaa

SEQ ID NO: 4016 - DNA, 4655 bp, Homo sapiens
ggcggccaggtggaggacctgagcaagcagctcaagcgtgtggacggccaggtgcagggcatcgccacgcacgtgcagcacttctcccaggccagcgggcttgacctggccgcgctagagtggccggaggagcaggaggtgggcgtgcgggcgttcgatagggtgcggactgggagtatcatgaaggacgccgccgaggagctcagctttgccagggtacttttacagcgggttgatgaactagagaagctattcaaagatcgggagcaattcctggaactagtcagccggaagctgagtttggttcctggtgcagaagaagtcaccatggtcacctgggaagagctggagcaggcgattacggacggctggagagcctcacaagcgggctcagaaacacttatgggattttctaagcacggagggttcacttccttaacatcacctgaagggactctaagcggagactctaccaagcaaccaagtattgagcaggctctggattctgccagtggtcttggcccggatcggactgcatcaggatctggtggcacagcacacccctctgatggggtttccagtagggaacaaagcaaggtcccctctggtactgggagacagcagcagccgagggcccgtgatgaagctggcgtgccacgactccatcagtcttctacattccaattcaaatcagactcagatcgtcacaggagtagagagaagcttacctcgacacaaccaagaagaaatgcacgtcctggtccagttcaacaggacttacccttggccagagaccagcccagtagtgtgcccgctagccagagtcaggtccatctaaggccagatcgtcgtgggttagaaccaactggcatgaatcagcctggattagtgcctgctagcacttacccacatggtgtggtacccctcagcatgggtcagcttggtgtgccaccacctgaaatggatgatcgggaattgataccatttgtcgtggatgagcaacgtatgttgccaccatcagtacctggcagagaccagcaaggattggaactacctagcacagaccaacatggtctggtttcagtcagtgcatatcagcatggtatgacatttcctggcacagaccaacgcagtatggaaccacttggcatggatcagcgtggatgtgtaatatcaggcatgggtcagcaaggactagtaccccctggtatagaccagcaaggattgacattgcctgtcgtcgatcaacatggcctggttctaccttttacagaccagcatggtttggtatcacctggtttgatgccaattagtgcagatcagcaaggttttgtgcagcccagtttggaagcaactggcttcatacaacctggcacagagcagcatgatttgatccagtctggcagatttcagcgtgctttggtgcagcgtggtgcatatcagcctggcttggtccaacctggtgcagatcagcgtggtttggtccggcctggaatggatcagtctggtttggcccaacctggtgcagatcagcgtggtttggtctggcctggaatggatcagtctggtttggcccaacctggtagagatcagcatggtttgatccagcctggcacaggtcagcatgatttggtccaatctggcacaggtcagggtgtcttggtacagcctggtgtagatcagcctggcatggtccaacctggcagatttcagcgtgctttggtgcagcctggtgcatatcagcctggcttggtccaacctggtgcagatcagattgatgtggtgcaacctggtgcagatcagcatggtttggtacaatctggtgcagatcagagtgatttggctcaacctggtgcagttcagcatggtttggtccaacctggagtagatcagcgtggtttggcacaacctcgtgcagatcatcagcgtggtttggtcccacctggtgcagatcagcgtggtttggtccaacctggtgcagatcagcatggtttggtccaacctggagtggatcagcatggtttggcacaacctggtgaagttcagcgtagtttggtgcaacctggtatagttcagcgtggtttggtgcaacctggtgcagttcagcgtggtttggtgcaacctggtgcagttcagcgtggtttggtccaacctggagtggatcagcgtggtttggttcaacctggtgcagttcagcgtggtttggtccaacctggtgcagttcagcatggtttggtccaacctggtgcagatcagcgtggtttggtccaacctggagtggatcagcgtggtttggtgcaacctggagtggatcagcgtggtttggtccaacctggaatggaccagcgtggtttgatccaacctggtgcagatcagcctggtttggtccagcctggtgcaggtcagctgggtatggtgcagcctggaataggtcagcaaggtatggtgcaacctcaggcagatccacatggcctggtacaacctggtgcctatcctcttggtttggtacaacctggtgcatatttgcatgatttatctcaatctgggacatatccacgtggtctggtgcagccaggaatggatcagtatggtttgagacaacctggtgcatatcagccaggcttgatagcaccaggcacaaagcttcgtggctcttcaacattccaggcagattctacaggttttatatcagtacgtccatatcaacatggtatggtacctcctggcagagaacaatacggccaggtgtcaccactcctagccagtcaaggtttggcatcacctggtatagatcgaaggagtttggtaccaccagaaacttatcagcaaggtttgatgcatcctggcacagaccagcacagcccaataccactgagtacaggtttgggatctacacacccagatcaacagcatgtggcatcacctggcccaggtgagcatgaccaggtatacccagatgcagctcagcatggccatgctttctctctctttgacagtcatgattcaatgtatcctggttatcgtggcccagggtatctaagtgctgatcagcatggccaggaaggtttggatccaaatagaacacgagcctcggaccgacatggaattcctgcccagaaggccccaggccaagatgtcactcttttcaggagtccagactccgtcgaccgagtcttatcagaagggagcgaagtctcgagtgaagtcctgagtgagcgacgcaattcactgcgtagaatgagttctagtttccccacggcagtggagacatttcatctgatgggagagctcagtagcctctatgtggggctaaaggagagtatgaaggatctggatgaggagcaggccggccaaaccgacttggagaagatccagttcctgctggcacagatggtcaaaaggaccatacctcctgaactgcaggagcagctgaagaccgtaaagacgctagccaaagaagtttggcaggagaaagcaaaagtggaaaggctgcagaggatcctggaaggggaagggaatcaagaagcagggaaggaactgaaagctggagagctgagattgcagctgggtgtcctcagagtcaccgtggctgacatagaaaaggagctggccgagttgagggagagccaagacaggggcaaggctgccatggaaaattctgtctctgaagcctccctttacctgcaggaccagttggacaagctcaggatgatcattgagagcatgctgacctcctcctccacgctcctgtccatgagcatggccccgcacaaggcccacaccttggctcctggccagatcgaccctgaggccacctgtccagcctgcagcctggatgtgagccatcaggtcagcacgctggtgcggcgctatgagcaactccaagacatggtcaacagcctggccgtctcccgaccctccaagaaggccaagctccagagacaggacgaggagctgctgggccgtgtgcagagtgccatcctgcaggtgcagggtgactgcgagaagctcaacatcaccaccagcaacctcatcgaggaccatcggcagaaacagaaggacattgctatgctgtaccagggtctggagaagctcgaaaaggaaaaggccaacagggagcacctggagatggagatcgatgtgaaagccgacaagagtgctctggccaccaaagtgagccgtgtccagtttgatgccaccacggagcagctgaaccacatgatgcaggagctggtggccaagatgagcgggcaggagcaggactggcagaagatgctggacaggctgctcacagagatggacaacaagctgccaggcatcctccgaaaagacagctcagggacctcaaagcgcaagtcccagcagcccaggccccacgtgcacaggccgccatccctcagcagcaatggccagctgccctctcggccacagagcgcccagatttcggctggcaacacctcagaaagatagaccttcctccgagggccgtctctcccagccgaacacagcccacccgcccagctccgccgcggtggcaaacagggggctggagaggcacgtggacatgcctcctggggaggggctcgaggagcccacgcgggggccgcggtccagcaccgctcagtgagcggaggtgtaaataaacattcaggagg

SEQ ID NO: 4017 - DNA, 3083 bp, Homo sapiens
gagggttgaatgtaagatggcgcccagggagctgtgaggagaaaaccctgtcggtcttggagcgacgacggcagaaccagggtccctggcggtgcggcggggccggcgggtgcagcggaggcggcggcggcggcggcagtgacgtcgccggaatattagaagtcttaagaactcaggacaagcagcagaaatacatgcaacatggtgactggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctatta

SEQ ID NO: 4018 - DNA, 3549 bp, Homo sapiens
aaaggaggctctggcgggcgacggaaggtgggtccaaagagctagcttggagccctagccttccgagactccactactaggccaagccacggccctagctccgccccacatggagaggcgtccatgggcggagcgagccgctccataccctaggatccactatccgctctagcggccagaagcgcggccaccttcccctgctgaagcgttcactttaattttggccggtaggcagtcccagatctcgcgggatccgacgccccgattatcgcgagaggagcaatcggctcctattggctgtgagggttgaatgtaagatggcgcccagggagctgtgaggagaaaaccctgtcggtcttggagcgacgacggcagaaccagggtccctggcggtgcggcggggccggcgggtgcagcggaggcggcggcggcggcggcagtgacgtcgccgggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctcttatgtattcttactctagttgtttattaagaatgacaagcacgtcttttcaaca

SEQ ID NO: 4019 - DNA, 3009 bp, Homo sapiens
cgcgttcccggcccggatatctctgctctaggagctgtggcccgtgggcaaccgcggctttctggagcgcgcgcccgtgacgacccccagttttggggcgcgcgctctgatatcgggtggcggtgctgcctcgagagcgcgcaggaggcttctgctgagcagagggccggccgcggctcgttgcgctgggaaggttgaggattgggtcctttctggtctggtgacgttcccgggcatccgtggcctcggcctggagagaaaccaaccagctttgctgtctggcttgcggttccgctcctctgtgaggggggcgagattgcccgttctcctcgaagaatgccgttacttgaggcccaaaatattagaagtcttaagaactcaggacaagcagcagaaatacatgcaacatggtgactggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtccta

SEQ ID NO: 4020 - DNA, 747 bp, Homo sapiens
atggaggaccctgagaaaaagctgaatcagaagagtgatggcaaaccccggaaagtacgatttaaaatctcctcctcctacagcggtcgagtattgaagcaggtctttgaggatgggcaggaattagagtcaccaaaggaggaataccctcacagttttctgcaagagtctcttgaaacaatggatggtgtttatgggtctggggaagtccccaggccccagatgtgctcccctaagctgactgctcagaggatcagtgtgtttagagagggtaatgcctacaccttggcaggcggccagcctcggttcaacgattacaaggcgaatgaccataagcccctacctattatagattttggaaagataatcatctacactaataacctgaaaatcattcgaaccccaatggacaagagagattttgtgaggaaaattctccagaaggaagaggaggctgaggaagagtctctgatgaacaaagaagaaagctatggaggcagggaccagcacgatagacctttggtggaggcagaaagcacattaccccaaaaccggtatacacaggaaggggatattcccgaggacagctgttttcactgccgagggtcgggcagtgccacctgctctctgtgccacggcagcaagttctcgatgctggccaacagatttaaggagtcctatcgggccctgaggtgccctgcctgcaatgagaatggcctacagccttgccagatttgcaatcaatag

SEQ ID NO: 4021 - DNA, 1712 bp, Homo sapiens
aaaaggggctgaaatcctggggacctcagagtcgtctaaaactcctagccatgttccagcagttccaggcctcctgtcttgtcctgtttttcctggttggctttgctcagcagaccctaaagcctcaaaataggaaggtggattgcaacaaaggggtaacaggcaccatctatgagtatggagccctcaccctcaacggcgaggagtacatccaattcaagcagtttgcaggcaagcacgtcctgtttgtcaatgtggccgcctattgaggcttggcagctcagtatcctgaactgaatgcactacaggaggagctgaagaattttggtgtcattgtgttggcctttccctgcaaccagtttggaaaacaagaaccaggaacaaactcagaaatacttcttggtctcaagtatgtgtgtccaggtagtggctttgtccccagtttccagctctttgagaaaggggatgtgaatggagaaaaagaacagaaggtctttactttcctgaagaactcctgccctccgacctctgatcttttgggctcatcaagccaactcttctgggagcccatgaaggtccatgatatccgctggaactttgagaaatttctggtggggcccgatggagtccctgtcatgcattggttccaccaggctccagtcagcacagtcaagtcagacatcctggagtacctaaagcagttcaatacccactaggaagggctagcgactgacagaaataactaccctgtctcccacctgcaggaatgtctaacaaagcatccatcttcctccttctttgctccacactcgtgcctacccagcctcctgatgaccaaaccatcctgtactacccaagcacctgcttagcatgtgtgtgtagctgtgtgtgtgtgtgtgtgtgtgtgtatggatatgtagaattgtatttgttggtatatgcataggtgtatgtatggtgtgtgtgtgtgtgtgtgtgtgtgtgtttgaagattaaggaaaagaacacctatctctccaactctctgatcctgaaatatctattccaaaggaaaatcatattttagggtagatgaatcagactatcctgtgtccctaaaaaagcaatcccgagaagttgtgacatctatcccttccccttcctgaaagttttaaagaaagcaggagctggccgcaagactctaggcctccttcatagcctctctcctctaagataggcatgcattgttaaactcttttctccttaattctcctttattcccctgccacccagtagttctcatgtaggacctctgaaggcagagtgagagcagaaaccccacctcacatgaagggaagggcatctccatgatggtggatcccaaaacccctctgggtcgcaccctgccagagccttccttggtgcctgtcccttagtgcattcaggtcatggcacctgggcaggggtgtccctgtattctgaatgatgggctttctcctcaccctgagcctcctcaactttaagcttattttgatcactgtctcaaatttaaaaattctgcagcaacctggctctgtgtggtgttttcccagtcccatattatgtccagtcatacttcttctttctctgtcactttgtccctgctttcttgattcccttgtcttgttcttcagtattttgtttttctcaaaaatgctctagaactttccttggcacatataaaagcacggctg

SEQ ID NO: 4022 - DNA, 216 bp, Homo sapiens
ctaacttcttttagagttgtacatactattcctatgattaagtctttctttaattatctctctccaaaacatctaaaattccaggtggattgcaacaaaggggtaacaggcaccatctatgagtatggagccctcaccctcaacggcgaggagtacatccaattcaagcagtttgcaggcaagcacgtcctgtttgtcaatgtggccgcctattga

SEQ ID NO: 4023 - DNA, 3422 bp, Homo sapiens
ggtggagccggcggcaggggccaggcctctctaggctctccggctgagccgggttggggcccgggttgggccgcccggggactctggagcattgggatttgtagcgcgccctctgggtaggcggctgtagcggagaggcgtgcgggatcgggatgtcggggctgctcacggacccggagcagagagcgcaggagccgcggtaccccggcttcgtgctggggctggatgtgggcagttctgtgatccgctgccacgtctatgaccgggcggcgcgggtctgcggctccagcgtgcagaaggtagaaaatctttatcctcaaattggctgggtagaaattgatcctgatgttctttggattcaatttgttgccgtaataaaagaagcagtcaaagctgcaggaatacagatgaatcaaattgttggtcttggcatttcaacacagagagcaacttttattacgtggaacaagaaaacaggaaatcattttcacaactttataagttggcaagacttaagagctgttgaacttgtaaaatcttggaataattctcttcttatgaagatatttcacagttcttgccgagtgcttcactttttcactagaagtaaacgactttttacagccagtttgttcactttcacaacccagcagacttctttgagattggtctggattttacagaacttgactgaggtgcaaaaggcagttgaagaagaaaattgctgctttgggactattgatacctggttgttatataagctcacaaaaggttctgtatatgccacagatttttcaaatgctagtacaactggactttttgacccatataagatgtgttggagtgggatgattacctctctaatttcgataccactttctctcctacctcctgtgagggacacaagccacaattttggatcagtggatgaagagatatttggtgtgcctataccaatagttgccttggttgctgaccagcaatcagccatgtttggagagtgctgcttccagacaggtgatgtgaaattaaccatgggaactgggacatttttggatattaacactggaaatagccttcaacagactactggaggcttttatccattaattgggtggaagattgggcaagaagtcgtatgcttagctgaaagcaatgcaggagacactggtactgccataaaatgggctcagcagttagaccttttcacagatgctgctgagactgaaaaaatggccaaaagtttggaggattctgaaggagtttgttttgttccatcttttagtggattacaggctccattaaatgacccctgggcatgtgcctcttttatgggtttgaagccttctaccagtaaataccatcttgtacgagcaatattggagtcaatagctttcagaaacaaacagttatatgagatgatgaagaaagagattcatattcctgtaagaaaaatccgggcagatggaggagtttgtaagaatggttttgtcatgcagatgacttcagacctgattaatgagaatatagacagacctgccgacattgacatgtcatgcctgggtgcagcttctctagctggccttgctgttgggttttggactgacaaggaggaactaaagaaactgagacaaagtgaagtggttttcaagccacagaagaaatgtcaagaatatgaaatgagtctggaaaactgggccaaagcagtgaaacgctccatgaattggtataacaagacataacactaaatgaaatgatcaaaaccataggtagctggtttatgtgacgtgcagatgagatgaagctcagggataacccatatgacaatgactaagaggagaaaattttaaataagcttcataacttaagaagcattgcttttaaaaaaacaaaacggaacaaaaaactcttatttttttcccctaaaccatggtaaggcagcaatacctcaaaactttatatcttctattttgtagcaaattccaaaggacattagtcatttccaaccacattttgacagttatgggtcctcttcctttttatactgggtcagtggtacataggaacataatgatttaccatccaagctaatagttctgggtcaagtaccatgcacatattgttccaaaattatgtgaaacgtatttctttaattctttaagtgggctatttgaagtacatatagctaaaaagaaagaataactgagaaaatgtggaattttgaaacattaatattttatgtttaaagccataatttcctaatattatatccaaatatgagcttaatatgtccctctcagataagcttatgagatagttaatgctttcctttactggtcttaaagacactgccttaatttttccttgttcaaccaaaatctgagcattctttctatgttgaaaacactgaaaaactaattttagttaatgaactagaaagaatattgatttttaagaaacagaaaaatactacttattttccttctcaaataacgtttctttcaaaaacttctggctgaagtataacatgctggtagttaacataaatcttgtctttctcttgttctttatctttctttgttatttagatgcttgtataaatgtcttttgtttttattaagtgcctaattgacagagcttaatttgaagaagtgccctaatttattgaccacttaagaattgcctttattggggtattttatttgttcctgcgtctttttgatgtttgttcagtctactcatccctgtgagtatgtgtgggggacagctgatagaagggaggagagtgtgtctatgctcaggattgccctttagccactcagccagagatccacagggagcaacaaggacagtttcacatgcttagactttcttggaagaaacagtgaggaggagtaagtcgtgagtagtgtcaagctggatgtagaattgtcctaaggcagttgaccccaccttccaacatgttttcactttatttgcccctccctacatttgggttaggttccatttggatttgcagcaataatgactttatttctctcttggtcaggatttggcacataaaatccttttattatagaactagctattttagttacatagtaatgtaactaatggagagatttatagagaattttgtttttgctgtcatatatgtccattttggagacagatatgatagaactagaaattaagttgcatttctgcaagtgccatttgaatgaacttcaagtatcttcttaattattaaattttctgatgaaggcattgtaacaaatatatagtattattaaatctaattaatatttggaaatattaataaataggtattttatttactgtaaaaagtcaaacttcattatgtagataaatcttattcttttcattctttcccctgtttacatcctttttacaaagcttag

SEQ ID NO: 4024 - DNA, 1037 bp, Homo sapiens
caggcctctctaggctctccggctgagccgggttggggcccgggttgggccgcccggggactctggagcattgggatttgtagcgcgccctctgggtaggcggctgtagcggagaggcgtgcgggatcgggatgtcggggctgctcacggacccggagcagagagcgcaggagccgcggtaccccggcttcgtgctggggctggatgtgggcagttctgtgatccgctgccacgtctatgaccgggcggcgcgggtctgcggctccagcgtgcagaaggtagaaaatctttatcctcaaattggctgggtagaaattgatcctgatgttctttggattcaatttgttgccgtaataaaagaagcagtcaaagctgcaggaatacagatgaatcaaattgttggtcttggcatttcaacacagagagcaacttttattacgtggaacaagaaaacaggaaatcattttcacaactttataagttggcaagacttaagagctgttgaacttgtaaaatcttggaataattctcttcttatgaagatatttcacagttcttgccgagtgcttcactttttcactagaagtaaacgactttttacagccagtttgttcactttcacaacccagcagacttctttgagattggtctggattttacagaacttgactgaggtgcaaaaggcagttgaagaagaaaattgctgctttgggactattgatacctggttgttatataagctcacaaaaggttctgtatatgccacagatttttcaaatgctagtacaactggactttttgacccatataagatgtgttggagtgggatgattacctctctaatttcgataccactttctctcctacctcctgtgagggacacaagccacaattttggatcagtggatgaagagatatttggtgtgcctataccaatagttgccttgttaaaggtccctggatatgaccagaatatctgctatatttttgggaaggggaccattgagccagtattctatcatggaagtactttataa

SEQ ID NO: 4025 - DNA, 623 bp, Homo sapiens
aggcctggaaatccacgcggcttcccaaagacggcgcctctgttctgcgggttcgtgacgaggatttatttccacccactgcgcctgggcgcaggtctgcgggtccgcgcccactgcgtgcggcgccacggaccatgtcggtgactgatcaggcttttgtcacactggccacagatgacatctactgccagggcgccctggtcctggggcagtcactgaggagacacaggctgacgaggaagctggtggtgttgatcactcctcaggtgtccagcctgctcagggacatggatgaagctggaaaccatgactctgagcaaactattgcagggatagaaaaccaaacactgcatgttctcactcataggtgggaattgaacaatgagaacacttggacacagggtggagaacatcacacactggagccagtcgtggggcggggagaggggggagggatagctttaggagatatacctaatgtaaatgatgagtaaacgggtgcagcacaccaacatggtacatgtatatatatgtatcaaacctgcacattgtgcacatgtaccctagaacttaaagtataataaaaaaaatttataaataaaaatgtttaggcaattaaaaaa

SEQ ID NO: 4026 - DNA, 694 bp, Homo sapiens
ctgggcgcaggtctgcgggtccgcgcccactgcgtgcggcgccacggaccatgtcggggtctcactctgtcacccaggctggagtagagtggtacaatcacagctcactgcagcctcaaactcccaggctcaagtatcctcctacctcagcctcccaagtagctgtaactacagtgactgatcaggcttttgtcacactggccacagatgacatctactgccagggcgccctggtcctggggcagtcactgaggagacacaggctgacgaggaagctggtggtgttgatcactcctcaggtgtccagcctgctcagggtctcactcgtcgcccaggcttgagtgcagtgataccatctcggctcactgcaacctctccctcactggcccaagtgatcttccctcctcagccttctaagcagctgggaccacaagtatgtgcccgcatgcttggctatttttatttttattttttgtatttttggtagagacagggtttcgtcacattgcctaggctgatcttgaactcctggactcactcagtccacccaggttggcctcccaaagtgctgggattacaggcatgagccacggcgccctgccaaggagtctttttaaaaataatttccttttacaattccctttgtctttaattctcaaataaagcaaatacataaataaatgcatctaatgaa

SEQ ID NO: 4027 - DNA, 300 bp, Homo sapiens
tttatttccacccactgcgcctgggcgcaggtctgcgggtccgcgcccactgcgtgcggcgccacggaccatgtcggtgactgatcaggcttttgtcacactggccacagatgacatctactgccagggcgccctggtcctggggcagtcactgaggagacacaggctgacgaggaagctggtggtgttgatcactcctcaggtgtccagcctgctcagacctgcagcctcgttggtcctctccagggtttcttcaaggccatagacggaaggtgacatctctgcattgtcctgaacttt

SEQ ID NO: 4028 - DNA, 639 bp, Homo sapiens
aggcctggaaatccacgcggcttcccaaagacggcgcctctgttctgcgggttcgtgacgaggatttatttccacccactgcgcctgggcgcaggtctgcgggtccgcgcccactgcgtgcggcgccacggaccatgtcggtgactgatcaggcttttgtcacactggccacagatgacatctactgccagggcgccctggtcctggggcagtcactgaggagacacaggctgacgaggaagctggtggtgttgatcactcctcaggtgtccagcctgctcagtctctccaaaaggtgcaagatatcatccagccacttggactgagagctcatcccaatccagttcctgatcagatggggccctgccactcgttccagccaggtgacctggtgttcgttaaaaagttccagaaagaaggactcctgcttagaaaagacctcatactgtcatccttaccaccccaatggctctaaaagtagaaaggaatgcttacattcatgacaccccctagtacaaagcatgtttaactgtaatctatgactaactaccctaattactggattggcagaaccctttttctccttctcttgtttagtcttccaaccattatatattaaaattagtttcttaaatttgt

SEQ ID NO: 4029 - DNA, 2210 bp, Homo sapiens
acagagctcaggacagggctgaggaaccatgtctccatccccgaccgccctcttctgtcttgggctgtgtctggggcgtgtgccagcgcagagtggaccgctccccaagccctccctccaggctctgcccagctccctggtgcccctggagaagccagtgaccctccggtgccagggacctccgggcgtggacctgtaccgcctggagaagctgagttccagcaggtaccaggatcaggcagtcctcttcatcccggccatgaagagaagtctggctggacgctaccgctgctcctaccagaacggaagcctctggtccctgcccagcgaccagctggagctcgttgccacgggagtttttgccaaaccctcgctctcagcccagcccggcccggcggtgtcgtcaggaggggacgtaaccctacagtgtcagactcggtatggctttgaccaatttgctctgtacaaggaaggggaccctgcgccctacaagaatcccgagagatggtacagggctagttttcccatcatcacggtgaccgccgcccacagcggaacctaccgatgctacagcttctccagcagggacccatacctgtggtcagcccccagcgaccccctggagcttgtggtcacagaattctcagaagccaccgctgaactgaccgtctcattcacaaacgaagtcttcacaactgagacttctaggagtatcaccgccagtccaaaggagtcagactctccagctggtcctgcccgccagtactacaccaagggcaacctggtccggatatgcctcggggctgtgatcctaataatcctggcggggtttctggcagaggactggcacagccggaggaagcgcctgcggcacaggggcagggctgtgcagaggccgcttccgcccctcccgcccctcccgctgacccggaaatcaaacgggggtcaggatggaggccgacaggatgttcacagccgcgggttatgttcatgaccgctgaaccccaggcacggtcgtatccaagggagggatcatggcatgggaggcgactcaaagactggcgtgtgtggagcgtggaagcaggagggcagaggctacagctgtggaaacgaggccatgctgcctcctcctggtgttccatcagggagccgttcggccagtgtctgtctgtctgtctgcctctctgtctgagggcaccctccatttgggatggaaggaatctgtggagaccccatcctcctccctgcacactgtggatgacatggtaccctggctggaccacatactggcctctttcttcaacctctctaatatgggctccagacggatctctaaggttcccagctctcagggttgactctgttccatcctctgtgcaaaatcctcccgtgcttccctttggccctctgtgctcttgtctggttttccccagaaactctcaccctcactccatctcccactgcggtctaacaaatctcctttcgtctctcagaacgggtcttgcaggcagtttgggtatgtcattcattttccttagtgtaaaactagcacgttgcccgcttcccttcacattagaaaacaagatcagcctgtgcaacatggtgaaacctcatctctaccaacaaaacaaaaaaacacaaaaattagccaggtgtggtggtgcatccctatactcccagcaactcagggggctgaggtgggagaatggcttgagcctgggaggcagaggttgcagtgagctgagatcacaccactgcactctagctcgggtgacgaagcctgactttgtctcaaaaaatacagggatgaatatgtcaattaccctgatttgatcatagcacgttgtatacatgtactgcaatattgctgtccaccccataaatatgtacaattctgtatacatttttaaaatcataaaaataagataatgcaccgtctccacccctctcatatttactttctgaaggaaatgttaggtcttctcaaggtaaagttctatatttattatagcgtttaggcatttcttgaccatctaatgagtgtaaaactgtaccactgggccaagtgcagtggatcatgtctgtaatcctagcactgtgggaggccaaggcaggaggatcgcttgagcccaggagttcaagaccagcctgggcaacatagtgagaccccatctctacttaaaataaagaagataaaaattgttttaaaa

SEQ ID NO: 4030 - DNA, 2210 bp, Homo sapiens; identical to SEQ ID NO: 4029

SEQ ID NO: 4031 - DNA, 2210 bp, Homo sapiens; identical to SEQ ID NO: 4029

SEQ ID NO: 4032 - DNA, 2210 bp, Homo sapiens; identical to SEQ ID NO: 4029

SEQ ID NO: 4033 - DNA, 2210 bp, Homo sapiens; identical to SEQ ID NO: 4029

SEQ ID NO: 4034 - DNA, 2210 bp, Homo sapiens; identical to SEQ ID NO: 4029

SEQ ID NO: 4035 - DNA, 2210 bp, Homo sapiens; identical to SEQ ID NO: 4029

SEQ ID NO: 4036 - DNA, 2210 bp, Homo sapiens; identical to SEQ ID NO: 4029

SEQ ID NO: 4037 - DNA, 2091 bp, Homo sapiens
gcgcttttgccgcgccgtgctgcccgcgagggcagctgaggtggtggtggcggccgccttgtcgaggcatcgcgcgcccgtgaagtgttcgccgtcagtgctgttgggtgcctggagccgcgtcccccgtcccgaaaactgtccttgacagtacttgcgcggcccaacggccgccggcgcccccgcgtctccatggcgacggcctttttccctgcgaggaccccggcggcagggctgccccgcggcgcctgcttggcgcgacgctctagcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttc

SEQ ID NO: 4038 - DNA, 1621 bp, Homo sapiens
gtgggatttatttgagtgcaagatcgttttctcagtggtggtggaagttgcctcatcgcaggcagatgttggggctttgtccgaacagctcccctctgccagcttctgtagataagggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttc

SEQ ID NO: 4039 - DNA, 1340 bp, Homo sapiens
gtgggatttatttgagtgcaagatcgttttctcagtggtggtggaagttgcctcatcgcaggcagatgttggggctttgtccgaacagctcccctctgccagcttctgtagataagggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatccgccaccttggttccagtgctggaaaacgatattcacctcagtttgtaaaggctgccaagttactcattggaatggacatttgaagccatggggaaggactgcttcatatacttgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctag

SEQ ID NO: 4040 - DNA, 2320 bp, Homo sapiens
gcgcttttgccgcgccgtgctgcccgcgagggcagctgaggtggtggtggcggccgccttgtcgaggcatcgcgcgcccgtgaagtgttcgccgtcagtgctgttgggtgcctggagccgcgtcccccgtcccgaaaactgtccttgacagtacttgcgcggcccaacggccgccggcgcccccgcgtctccatggcgacggcctttttccctgcgaggaccccggcggcagggctgccccgcggcgcctgcttggcgcgacgctctagcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtacagcagaccgaggacacggttgttaccaagaccaggctgttgccttggaagagcccagagcgtgtcaagggagacagccacatcacgccagaaatacatgacagctggattagccctgggagagggaggcccagatgtgggagctcaggggaggtgcagctcaacgtggagtttggaggaggctaccttgacctttgaatgccaagtgggagccagccagatgaaaggggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttc

SEQ ID NO: 4041 - DNA, 622 bp, Homo sapiens
cgctctagcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtagatggggtttcaccatcttggacaggctggtctcgaactcctgacctcttgatccacctgccttggcctcccaaagtgctgggattacagacgtgagccacggcgccctgatgtatatgagaagaagttcactgacacgttgtacttcatatatactgctttggaaagggttaaaaactaatatttatatgacagaagaaaaagatgtcattccgtaaagtaaacatcatcatcttggtcctggctgttgctctcttcttactggttttgcaccataacttcctcagcttgagcag

SEQ ID NO: 4042 - DNA, 1826 bp, Homo sapiens
gcggcgcctgcttggcgcgacgctctagcggttaccgctgcgggctggctgggcgtagtggggctgcgcggctgccacggagctagaggacagcagaccgaggacacggttgttaccaagaccaggctgttgccttggaagagcccagagcgtgtcaagggagacagccacatcacgccagaaatacatgacagctggattagccctgggagagggaggcccagatgtgggagctcaggggaggtgcagctcaacgtggagtttggaggaggctaccttgacctttgaatgccaagtgggagccagccagatgaaaggggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttcaat

SEQ ID NO: 4043 - DNA, 720 bp, Homo sapiens
attgggttcttgggaactgtgaattcaaaatgagtttctggcggaatactgtatatgcctcttgtttcttcctgaattaaaaaaaaaaaaaaagtgttagggcattttgatgtcccttctcatgtgcttactgactttgggggcttgtttttgttttgtagggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaa

SEQ ID NO: 4044 - DNA, 770 bp, Homo sapiens
gcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtacagcagaccgaggacacggttgttaccaagaccaggctgttgccttggaagagcccagagcgtgtcaagggagacagccacatcacgccagaaatacatgacagctggattagccctgggagagggaggcccagatgtgggagctcaggggaggtgcagctcaacgtggagtttggaggaggctaccttgacctttgaatgccaagtgggagccagccagatgaaaggggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagac

SEQ ID NO: 4045 - DNA, 706 bp, Homo sapiens
gcctgcttggcgcgacgctctagcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccgg

SEQ ID NO: 4046 - DNA, 1577 bp, Homo sapiens
cttggcgcgacgctctagcggttaccgctgcgggctggctgggcgtagtggggctgcgcggctgccacggagctagagggcaaggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaac

SEQ ID NO: 4047 - DNA, 577 bp, Homo sapiens
atggcgacggcctttttccctgcgaggaccccggcggcagggctgccccgcggcgcctgcttggcgcgacgctctagcggttaccgctgcgggctggctgggcgtagtggggctgcgcggctgccacggagctagaggttacaatggctagaaatgtactccacacttttgatatcgattggattttgtgaatttttgtagctttttctgtgctgtgggtttgtcaagtgaatttggataatattcttttctctgaggacactcatgttaaagggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcaca

SEQ ID NO: 4048 - DNA, 789 bp, Homo sapiens
gggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtcagaccgaggacacggttgttaccaagaccaggctgttgccttggaagagcccagagcgtgtcaagggagacagccacatcacgccagaaatacatgacagctggattagccctgggagagggaggcccagatgtgggagctcaggggaggtgcagctcaacgtggagtttggaggaggctaccttgacctttgaatgccaagtgggagccagccagatgaaaggatccagcgtctgtgtgcaatttcgttttgagaattccttctaaccagatcaggaaagctctcttaccaggaatagccccaggaaagacaatatggattagacgtactccatgataactggcgttttgcatggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaag

SEQ ID NO: 4049 - DNA, 735 bp, Homo sapiens
ggattgtcgggaggaccctgggcaaagacgcctaccctgccatgctgcgccatctgccctccaggctgccagtcaagatgtggggcaggactttggagaaacagtcatggagggacagcagtcagacccctcccccatgtcttatccgtagacttgaccacatcgtgatgacggtgaagagcatcaaagacaccaccatgttttattccaagatcctgggcatggaggtcatgacttttaaggaagaccggaaagcactgtgttttggagaccagaaatttaacctccacgaggtgggaaaggaatttgaacccaaagccgctcacccagttcctggctccctggacatatgtctgatcacagaggtgcctttggaggaaatgatccagcacctcaaggcttgtgatgtccctattgaggaggggccagtccccagaacaggggcaaaagggcctatcatgtccatctacttccgagaccccgacagaaatctgattgaggtgtccaactacatctcctcgtgatggaggctggacctcctccattctgtcccccttgatgtcgccctctcctttccttcctgcaaacccccacccaggcccagagatctccaaagactgaggacttaggcacttcacacatcctgctgaggggggacccaagacaggtttgggaccaaacctacatgtctgtatgtcatcaaagttggcctaataaatgcataacctctcaatg

SEQ ID NO: 4050 - DNA, 594 bp, Homo sapiens
ttatccgtagacttgaccacatcgtgatgacggtgaagagcatcaaagacaccaccatgttttattccaagatcctgggcatggaggtcatgacttttaaggaagaccggaaagcactgtgttttggagaccagaaatttaacctccacgaggtgggaaaggaatttgaacccaaagccgctcacccagttcctggctccctggacatatgtctgatcacagaggtgcctttggaggaaatgatccagcacctcaaggcttgtgatgtccctattgaggaggggccagtccccagaacaggggcaaaagggcctatcatgtccatctacttccgagaccccgacagaaatctgattgaggtgtccaactacatctcctcgtgatggaggctggacctcctccattctgtcccccttgatgtcgccctctcctttccttcctgcaaacccccacccaggcccagagatctccaaagactgaggacttaggcacttcacacatcctgctgaggggggacccaagacaggtttgggaccaaacctacatgtctgtatgtcatcaaagttggcctaataaatgcataacctctcaatg

SEQ ID NO: 4051 - DNA, 3176 bp, Homo sapiens
agtcacacagcagccttgtaggtgactggaggtgttcgctgatgtggccccaaccctacctccctccccaccccatgatgttagaagaatctcgacagaataaattggcagcagccaagaaaaagctaaaagaatatcagcaaaggaagagccctggtattccagcaggagcaaagacaaaaaagaaaaaaactgacagtagccctgagacaaccacttccggtggttgccactcacctggggatagccagtaccaagaactagcagtagccctggagtcaagctcagtgacaatcagtcaactcaatgaaaacatagaatcattgaaacagcagaagaaacaagtggaacatcagctggaagaagcaaagaaaacaaacaatgaaatacacaaagcacaaatggagcggttagagacaatcaacatcctcacattggaaaaggcagacttgaagaccaccctttaccatactaaacgtgctgcccgacacttcgaagaagagtccaaggatctggctggccgcctgcaatactccttacagcgtattcaagaattggagcgggctctctgtgctgtgtctacacagcagcaggaagaggacaggtcctcgagctgcagagaagcggtcctccagcggtggttacagcagaccataaaggagcgggcgctgctgaacgcacacgtgacacaggtgacagagtcactaaaacaagtccagctagagcgagacgaatatgctaaacacataaaaggagagagggcccggtggcaggagaggatgtggaaaatgtcggtggaggctcgaacattgaaggaagagaagaagcgtgacatacatcggatacaggagctggagaggagcttgtccgaactcaaaaaccagatggctgagcccccatccctggcgcccccagcagtgacctctgtggtggaacagctacaagatgaggccaaacacctgaggcaggaggtggaaggtctggagggaaagctccagtcccaggtggaaaacaatcaggccttgagtctccttagcaaggaacaaaagcagagactccaggagcaggaggagatgctccgagagcaggaggcgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctgaacaacgagaaaaagagcgcactgcagttggagcagcaagtaaaggagctgcaggagaagctagacgaggagcacctagaagctgccagccaccagaaccaacagctagagacccagctaagcctcgtggctctccctggagaaggagatggaggacaacatctggacagtgaggaggaggaggcgcctcggcccacgccaaacatcccagaggacctggagagccgggaggccacgagcagctttatggacctcccgaaggagaaggcggacgggacggagcaggtggagagacgagagcttggattcgtccagccttctggagtgacagacggcatgagagagtccttcaccgtatatgaaagccagggggcagtgccaaacacgcggcaccaggagatggaggatgtcatcaggctggcccagaaggaggaggagatgaaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatgttttttatgaagtgagcctggacaacaacgtggagcctgcaccaggagcggccagggagggttctccccatgacaaccccactgtacagcagatcgtgcagctgtctcctgtcatgcaggacacctaggagcacccaggcttgcccagcaaaccctgcgtgccattcttctaccaggcagccgagaacagggagataaacatcatcatcttctaagagctggtcaagaaatttaaaacaacaacaacaacaaaaagttacggggttcatctcctacacaattcatttactccatttgaatgctagagccactcacatttatttgtgtttctaatttaccgtttaaatttatttgtaaaaagttaagggagagttggtctttccctgatgttctttctggcatcctttagcatttttatttttaatttgataattgtaggtcattagtatgcatatcgagtttgcccttaggtggtgggaattcaaacacacaaagacccactaatttgcacaaaactattctggctggtttggaacaggctgccatgcttttttaatgttattgcagcatgtatattcattccagaattcagataaaatgtgcttatgttctgctattacgtttgatcgaatcctaaccacagtgagctcttcattagctcaatatgtggtttgccctcaattgagcactgtttattactttgtaatatgccactgtgagtactgacatttagagttgtttaaaggccaagaactggaaacagccttttccctattttctgtgtattggggatgggagtaataacattttggggagctttttaaatctcacagaagaggaaagtggcctgctctggcaggtgtgtgcaggatagagtgtgtttcatttgttctggtgccaagaatgagcgctgtactatggtagttcccttaggatttgtatgtgctctgggctcatgaagatattgcatcatgagctgcagcagttgtaccctttcttgatgacctaaaaagggattatttctgaggaatgaaaggctcccatcattgactgtggatgtggaaaaccttttctagcttagagcatttatatctacaatacattttaaagtcagagttcatgttacctgttttaatcacgagtatatgtcccagtacacaaaagggcactggttggcattc

SEQ ID NO: 4052 - DNA, 3178 bp, Homo sapiens
agtcacacagcagccttgtaggtgactggaggtgttcgctgatgtggccccaaccctacctccctccccaccccatgatgttagaagaatctcgacagaataaattggcagcagccaagaaaaagctaaaagaatatcagcaaaggaagagccctggtattccagcaggagcaaagacaaaaaagaaaaaaactgacagtagccctgagacaaccacttccggtggtggccactcacctggggatagccagtaccaagaactagcagtagccctggagtcaagctcagtgacaatcagtcaactcaatgaaaacatagaatcattgaaacagcagaagaaacaagtggaacatcagctggaagaagcaaagaaaacaaacaatgaaatacacaaagcacaaatggagcggttagagacaatcaacatcctcacattggaaaaggcagacttgaagaccaccctttaccatactaaacgtgctgcccgacacttcgaagaagagtccaaggatctggctggccgcctgcaatactccttacagcgtattcaagaattggagcgggctctctgtgctgtgtctacacagcagcaggaagaggacaggtcctcgagctgcagagaagcggtcctccaccggcggttacagcagaccataaaggagcgggcgctgctgaacgcacacgtgacacaggtgacagagtcactaaaacaagtccagctagagcgagacgaatatgctaaacacataaaaggagagagggcccggtggcaggagaggatgtggaaaatgtcggtggaggctcgaacattgaaggaagagaagaagcgtgacatacatcggatacaggagctggagaggagcttgtccgaactcaaaaaccagatggctaagcccccatccctggcgcccccagcagtgacctctgtggtggaacagctacaagatgaggccaaacacctgaggcaggaggtggaaggtctggagggaaagctccaatcccaggtggaaaacaatcaggccttgagtctccttagcaaggaacaaaagcagagactccaggagcaggaggagatgctccgagagcaggaggtgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctgaacaacgagaaaaagagcgcactgcagttggagcagcaagtaaaggagctgcaggagaagctagacgaggagcacctagaagctgccagccagcagaaccaacagctagagacccagctaagcctcgtggctctcccgggagaaggagatggaggacaacatctggacagtgaggaggaggaggcgcctcggcccacgccaaacatcccagaggacctggagagccgggaggccacgagcagctttatggacctcccgaaggagaaggcggacgggacggagcaggtggagagacgagagcttggattcgtccagccttctggagtgacagacggcatgagagagtccttcaccgtatatgaaagccagggggcagtgccaaacacgcggcaccaggagatggaggatgtcatcaggctggcccagaaggaggaggagatgaaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatgatttttatgaagtgagcctggacaacaacgtggagcctgcaccaggagcggccagggagggttctccccatgacaaccccactgtacagcagatcgtgcagctgtctcctgtcatgcaggacacctaggagcacccaggcttgcccagcaaaccctgcgtgccattcttctaccaggcagccgagaacagggagataaacatcatcatcttctaagagctgatcaagaaatttaaaacaacaacaacaacaaaaagttacggggttcatctcctacacaattcatttactccatttgaatgctagagccactcacatttatttgtgtttctaatttaccgtttaaatttatttgtaaaaagttaagggagagttggtctttccctgatgttctttctggcatcctttagcatttttatttttaatttgataattgtaggtcattagtatgcatatcgagtttgcccttaggtggtgggaattcaaacacacaaagacccactaatttgcacaaaactattctggctggtttggaacaggctgccatgcttttttaatgttattgcagcatgtatattcattccagaattcagataaaatgtgcttatgttctgctatgacgtttgatcgaatcctaaccacagtgagctcttcattagctcaatatgtggtttgccctcaattgagcactgtttattactttgtaatatgccactgtgagtactgacatttagagttgtttaaaggccaagaactggaaacagccttttccctattttctgtgtattggggatgggagtaataacattttggggagctttttaaatctcacagaagaggaaagtggcctgctctggcaggtgtgtgcaggatagagtgtgtttcatttgttctggtgccaagaatgagcgctgtactatggtagttcccttaggatttgtatgtgctctgggctcatgaagatattgcatcatgagctgcagcagttgtaccctttcttgatgacctaaaaagggattatttctgaggaatgaaaggctcccatcattgactgtggatgtggaaaaccttttctagcttagagcatttatatctacaatacattttaaagtcagagttcatgttacctgttttaatcacatgagtatatgtcccagtacacaaaagggcactggttggcattc

SEQ ID NO: 4053 - DNA, 5379 bp, Homo sapiens
agtcacacagcagccttgtaggtgactggaggtgttcgctgatgtggccccaaccctacctccctccccaccccatgatgttagaagaatctcgacagaataaattggcagcagccaagaaaaagctaaaagaatatcagcaaaggaagagccctggtattccagcaggagcaaagacaaaaaagaaaaaaactgacagtagccctgagacaaccacttccggtggtggccactcacctggggatagccagtaccaagaactagcagtagccctggagtcaagctcagtgacaatcaatcagctcaatgaaaacatagaatcattgaaacagcagaagaaacaagtggaacatcagctggaagaagcaaagaaaacaaacaatgaaatacacaaagcacaaatggagcagttagagacaatcaacatcctcacattggaaaaggcagacttgaagaccaccctttaccatactaaacgtgctgcccgacacttcgaagaagagtccaaggatctggctggccgcctgcaatactccttacagcgtattcaagaattggagcgggctctctctgctgtgtctacacagcagcaggaagaggacaggtcctcgagctgcagagaagcggtcctccagcggcggttacagcagaccataaaggagcgggcgctgctgaacgcacacgtgacacaggtgacagagtcactaaaacaagtccagctagagcgggacgaatatgctaaacacataaaaggagagagggcccggtggcaggagaggatgtggaaaatgtcggtggaggctcgaacattgaaggaagagaagaagcgtgacatacatcggatacaggagctggagaggagcttgtccgaactcaaaaaccagatggctgagcccccatccctggcacccccagcagtgacctctgtggtggaacagctacaagatgaggccaaacacctgaggcaggaggtggaaggtctggagggaaagctccagtcccaggtggaaaacaatcaggccttgagtctccttagcaaggaacaaaagcagagactccaggagcaggaggagatgctccgagagcaggaggcgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctgaacaacgagaaaaagagcgcactgcagttggagcagcaagtaaaggagctgcaggagaagctagacgaggagcacctagaagctgccagccagcggaaccaacagctagagacccagctaagcctcgtggctctccctggagaaggagatggaggacaacatctggacagtgaggaggaggaggcgcctcggcccacgccaaacatcccagaggacctggagagccgggaggccacgagcagctttatggacctcccgaaggagaaggcggacgggacggagcaggtggagagacgagagcttggattcgtccagccttctggagtgacagacggcatgagagagtccttcaccgtatatgaaagccagggggcagtgccaaacacgcggcaccaggagatggaggatgtcatcaggctggcccagaaggaggaggagatgaaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatgatttttatgaagtgagcctggacaacaacgtggagcctgcaccaggagcggccagggagggttctccccatgacaaccccccggtacagcagatcgtgcagctgtctcctgtcatgcaggacacctaggagcacccaggcttgcccagcaaaccctgcgtgccattcttctaccaggcagccgagaacagggagataaacatcatcatcttctaagagctggtcaagaaatttaaaacaacaacaacaaaaagttacggggttcatctcctacacaattcatttactccatttgaatgctagagccactcacatttatttgtgtttctaatttaccgtttaaatttatttgtaaaaagttaagggagagttggtctttccctgatgttctttctggcatcctttagcatttttatttttaatttgataattgtaggtcattagtatgcatatcgagtttgcccttaggtggtgggaattcaaacacacaaagacccactaatttgcacaaaactattctggctggtttggaacaggctgccatgcttttttaatgttattgcagcatgtatattcattccagaattcagataaaatgtgcttatgttctgctattacgtttgatcgaatcctaaccacagtgagctcttcattagctcaatatgtggtttgccctcaattgagcactgtttattactttgtaatatgccactgtgagtactgacatttagagttgtttaaaggccaagaactggaaacagccttttccctattttctgtgtattggggatgggagtaataacattttggggagctttttaaatctcacagaagaggaaagtggcctgctctggcaggtgtgtgcaggatagagtgtgtttcatttgttctggtgccaagaatgagcgctgtactatggtagttcccttaggatttgtatgtgctctgggctcatgaagatattgcatcatgagctgcagcagttgtaccctttcttgatgacctaaaaagggattatttctgaggaatgaaaggctcccatcattgactgtggatgtggaaaaccttttctagcttagagcatttatatctacaatacattttaaagtcagagttcatgttacctgttttaatcacgagtatatgtcccagtacacaaaagggcactggttggcattcttcttaaggtatttagtgaagatcataagaaatcctttaagagtttaaatgtccctggaagaggcatacaggctctagtcaagaatgaatttgagtgaaggaaagctgtgtgacacctggccttcctctatgttcatggagcttctttgaggctagaagattgattttatcatctagacctctctggctaatacctattcttcagccacattagttactctgacataggaatttacttcttttctttgaatggaaaacactttaaaaataataacaaccattattataaaccaatatatgtgagagtacttagttgaaacaaaaaggagttttagtagacagtattatactacacatgaaaatcaaggcgaagtttatgcaacttaaaatgtttacaagctgcagtgcaatctaatgtttgtgaatgtccaagtattatgagaaaaagtgtctatacaatgacagacttatgtttcctcacaaagttcttcacaaagagtgaaatatgtttttatacctctcagtttcagttagaggcatattttgtgccatatttatgttaatgtgcctatacgtgatgagtgaattatttcagtcatacattgcctaaatcataactttaagatgcttgggaaagaatcaacagctaaaagttcatgaagttctaatgtctgtgttccaaaatacgtcacagtattaggatgcagggagagatgtgtgtgcgctccctggggtgggcatttctagttactagaccatctccatttttagcatttggcatcctcatgatacttttatacatatgacattaataggagagcaataatacgattttacagatggaataacagatgtgcctgcattcagtgaaagagtgcaaatattaagtccttgtgacttcaactgactcttccaaattgtatgaatttatcaatgtattagataaactcagttccagaattataaagaaaaactgttagaccaacgaatgtggctaattaacagtaggacgatttctagcccgagggtttaaaatggacttcaagtcctgttcttgccttttattttctgaacttgccacttttgcattctttgagttcagtttaaagacagtttgagtccaatttagaccctcgggctagaaatcataccactgttaattagccaccttatttggtctaacagtttttctttataattctgaaactgggtttacctaatacattgataaattatttcaaaggtatttttatagttcaaatcacttcacttttaccctgataaatataaatgactaggaatgatcttcagctagcctttagcacctgcaaccaatctgacaataatgtgttcatcaggtacctgtggattaaatcacacaccggcatatttaagctgaatgtcagtctggaaaatgaatgtactatattaactgaaataccactctttgtgtaggtattctgtcatatatttaagaaaaattaaatagcatgtaaatcatataacaataacttaagtctttcttcaaagtgcatgtggtcctttgcaatacctcattcagccaagtatttgttctcttcctcattcagtttaaggcagctttcaatttgcttagaaggcaacattagaagggtagagtttaatcagaaacatagaattttaaagtgtgggttcaactgaataaatttgaatttctgtaggaagtaaagaattaaaaatctatttaaagattgcaatatataatcatttttaaagtatttgtttaacctgatgggttttccagaaatgaaaacaagtcagttctaaaaccaaagctgatatttagaaaatgtgaaaatataaatcagccctatgcataatatagtttctctaaaactttatcttaaagagtcattttaaaagaatataactattcaaaaatgtaactgctatcttaatgttttgaaataagttaaaacactttaaaatatgaatactgtagtttgaaagaaagaaactgggggaaggaaaagtagagaaagaaatgccaattccaatgcaaggctttatttgccaagttttcttagaatgacttttaccagtttatgaattcttgtaaacagaatgtataatagaaatactgaaacactgttgcctaaagtggcattgttgactgctactgtgatgctactgtaatgtaataaattattaaattgttgcaaagtgc

SEQ ID NO: 4054 - DNA, 3414 bp, Homo sapiens
atgtggccccaaccctacctccctccccaccccatgatgttagaagaatctcgacagaataaattggcagcagccaagaaaaagctaaaagaatatcagcaaaggaagagccctggtattccagcaggagcaaagacaaaaaagaaaaaaactgacagtagccctgagacaaccacttccggtggtggccactcacctggggatagccagtaccaagaactagcagtagccctggagtcaagctcagtgacaatcaatcagctcaatgaaaacatagaatcattgaaacagcagaagaaacaagtggaacatcagctggaagaagcaaagaaaacaaacaatgaaatacacaaagcacaaatggagcagttagagacaatcaacatcctcacattggaaaaggcagacttgaagaccaccctttaccatactaaacgtgctgcccgacacttcgaagaagagtccaaggatctggctggccgcctgcaatactccttacagcatattcaagaattggagcgggctctctgtgctgtgtctacacagcagcaggaagaggacaggtcctcgagctgcagagaagcggtcctccagcggcggttacagcagaccataaaggagcgggcgctgctgaacgcacacgtgacacaggtgacagagtcactaaaacaagtccagctagagcgagacgaatatgctaaacacataaaaggagagagggcccggtggcaggagaggatgtggaaaatgtcggtggaggctcgaacattgaaggaagagaagaagcgtgacatacatcggatacaggagctggagaggagcttgtccgaactcaaaaaccagatggctgagcccccatccctggcacccccagcagtgacctctgtggtggaacagctacaagatgaggccaaacacctgaggcaggaggtggaaggtctggagggaaagctccagtcccaggtggaaaacaatcaggccttgagtctccttagcaaggaacaaaagcagagactccaggagcaggaggagatgctccgagagcaggaggcgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctgaacaacgagaaaaagagcgcactgcagttggagcagcaagtaaaggagctgcaggagaagctagacgaggagcacctagaagctgccagccagcggaaccaacagctagagacccagctaagcctcgtggctctccctggagaaggagatggaggacaacatctggacagtgaggaggaggaggcgcctcggcccacgccaaacatcccagaggacctggagagccgggaggccacgagcagctttatggacctcccgaaggagaaggcggacgggacggagcaggtggagagacgagagcttggattcgtccagccttctggagtgacagacggcatgagagagtccttcaccgtatatgaaagccagggggcagtgccaaacacgcggcaccaggagatggaggatgtcatcaggctggcccagaaggaggaggagatgaaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatgttttttatgaagtgagcctggacaacaacgtggagcctgcaccaggagtggccagggagggttctccccataacaaccccactgtacagcagatcgtgcagctgtctcctgtcatgcaggacacctaggagcacccaggcttgcccagcaaaccctgcgtgccattcttctaccaggcagccgagaacagggagataaacatcatcatcttctaagagctggtcaagaaatttaaaacaacaacaacaacaaaaagttacggggttcatctcctacacaattcatttactccatttgaatgctagagccactcacttttatttgtgtttctaatttaccgtttaaatttatttgtaaaaagttaagggagagttggtctttccctgatgttctttctggcatcctttagcatttttatttttaatttgataattgtaggtcattagtatgcatatcgagtttgcccttaggtggtgggaattcaaacacacaaagacccactaatttgcacaaaactattctggctggtttggaacaggctgccatgcttttttaatgttattgcagcatgtatattcattccagaattcagataaaatgtgcttatgttctgctattacgtttgatcgaatcctaaccacagtgagctcttcattagctcaatatgtggtttgccctcaattgagcactgtttattactttgtaatatgccactgtgagtactgacatttagagttgtttaaaggccaagaactggaaacagccttttccctattttctgtgtattggggatgggagtaataacattttggggagctttttaaatctcacagaagaggaaagtggcctgctctggcaggtgtgtgcaggatagagtgtgtttcatttgttctggtgccaagaatgagcgctgcactatggtagttcccttaggatttgtatgtgctctgggctcatgaagatattgcatcatgagctgcagcagttgtaccctttcttgatgacctaaaaagggattatttctgaggaatgaaaggctcccatcattgactgtggatgtggaaaaccttttctagcttagagcatttatatctacaatacattttaaagtcagagttcatgttacctgttttaatcacatgagtatatgtcccagtacacaaaagggcactggttggcattcttcttaaggtatttagtgaagatcataagaaatcctttaagagtttaaatgtccctggaagaggcatacaggctctagtcaagaatgaattcgagtgaaggaaagctgtgtgacacctggccttcctctatgttcatggagcttctttgaggctagaagattgattttatcatctagacctctctggctaatacctattcttcaaccacactagttactctgacataggaatttacttcttttctttgaatggaaaacactttaaaaataataacaa

SEQ ID NO: 4055 - DNA, 3822 bp, Homo sapiens
attctagtgcagccctggttacgcctcctctggctcagtcacacagcgacgtagaggtgactggaggtatatacttgtcctcacctggatcatgctgatgtggccccaaccccacctccctacccatccccacctccctacccatccccacctccctacccatccccacctccctacccatccccacctccctacccatccccacctccctacccatccccacctccctacccatcctatgatgtccaaagaaaccagacagagcaaattggccgaggccaaggaacagttgacagaccatcatccccagaccaaccctagtgttggtacagcagcaagcgacaccaaaaagaagaaaataaataatggcactaaccctgagacaaccacttctggtggttgccactcgcctgaggatgaacagaaggcaagccaccaacatcaggaagccctaaggagggagctagaggcccaggttcataccatacgaatccttacatgtcagaaaactgagcttcagatggcactctactacagccagcatgctgtcaagcagttggaaggagaggccagggatctgatcagccgcctgcatgattcatggaagtttgcaggagagttagagcaggctctctctgctgtcgctacacagaagaagaaggcggataggtacattgaggagttaacaaaggagagggacgccctgagtctggaactgtacaggaacaccataactgatgaggagctgaaggagaaaaatgccaaactacaagaaaaacttcaacttgtagaatctgaaaagtctgagatccagctcaacgtaaaggagctaaaaaggaaactggagagggccaagctcctgctgccacagcagcagctgcaggcggaggctgaccacctgggtaaggagctgcagagtgtgtcagcaaagctccaagcccaggtggaagagaacgagttgtggaaccgcctgaaccagcaacaggaggagaagatgtggaggcaggaggagaagatacaggagtgggaggagaagatacaggagcaggaggagaagatacgggagcaggaggagaagatacgggagcaggaggagaagatgcggaggcaggaggagatgatgtgggagaaggaggagaagatgcggaggcaggaggagatgatgtgggagaaggaggagaagatgcggaggctggaggagatgatgtgggagaaggaggagaagatacgggagctggaagagaagatgcacgagcaggagaagatacgggagcaggaagagaagaggcaggaggaggagaagatacgcgagcaggagaagaggcaggagcaggaggcgaagatgtggaggcaggaggagaagatacgggagcaggaagagaagatacgggagcaggagaaaaagatgtggaggcaggaggagaagattcacgagcaggagaagatacgggaggaggagaagaggcaggagcaggaggagatgtggaggcaggaggagaagataagggagcaggaggagatatggaggcaaaaggagaagatgcacgagcaggagaagatacggaagcaggaggagaaggtgtggaggcaggaggagaagatgcacgaccaggaggagaagatacgggagcaggaggagaagatgtggaggcaggaggagaagataagggagcaggaggagaagatacgggagcaggaggagaagatacgagagcaggaggagatgatgcaggaacaggaagagaagatgggggagcaggaagagaagatgcaagaacaggagaagatgcggaggcaggaggagaagataagggagcaggaggagaagatacgggagcagaaggagaagatacgagagcaggaggagaagatatgggagcaggaggagaagatacgagagcaggaggagatgatgcaggaacaggaagagaagatgtgggagcaggaggagaagatgtgtgagcaggaagagaagatgcaagaacaggaggagaagatgcggaggcaggaggagaagatgtgggagcaggaagtgaggctgcggcagcaggaggagaagatgcaggaacaccaggagcacctggaagctgccatctaatgagcacatgacaagaaggcaaagacaataaacatgtaaaagccggcagcaaggcctggagaagagtaagccgccatgtgactgtttagaatatagtctgagcacaaacctgaaaaaaaaattttatttattttaaattgtggcaaaatactggccaggcatggtagctcacgcctgtaatcctagcaatttgggaggccgaggtaaatggatgacctgaggtcaagagttcaagaccagcctggccaatacaaaaattagccgggcatggtggcgcatgcctgtaatcccagctacttgggaggctgaggcaggagaatcgcttgaacctgggaggcagaggttgcagtgagctgagatcgtgccactgcactcaagcctgggtgacagagcgaaactccgtctcaaaaaaaaaagtttcttccttacatgtatgtttctattagttttcttcttggtctttctcatttagtcttgtgttgtcttttgacattcatagtaaacttttatctgcctccagagagtattgactttgagtttatggcacacaattggagtaagggcagatcgccttcatctactttgggactaagctggttcaaagcaggttttaggttttctgatggctggtctatgttttattcatttggactcccaggggtggcccttccagggtccccaccaaggtcccatctccttcctgggacccaaattctcattaggtcatttcagccctgtgagagtgccaaacattcagctaggctctccagcctcttaactaccacttcatactcagtttcttagcctcttagccctctactgttgaccaatcaccaaatgtgggaaagcactacagactgtcaggatcacctcctaggcctggtcactcaagtcctgactgaggtctccaattaccttccaacaattgtttttgattgggggcggggcacatttttatccagtttttctaactgctcttgtggggaggcgaatctgtaacaagctcctctgcctttactgaaagttgaaaaccttcatctgtcctttttttgttgttgttgagatggagtcttgcgctgttgcccaggctctagtgcaatggcacgatctctgctcactgtaacctctgcctcctgggttcaagcaattctcctgcctcagcttcccgcgtagcgtgtgccaccatgcctggctaatttttttttatacctttaatagaggcaggatgtcaccatgttttccaggctggtctcgagctcctgactcaggtgatctacctgcctcagcctcccaaagtgctgggattacaagtatgagccactgcatccggcccatctgtcttttaaaacatgtttttaattggaggtataatttctattagtgaaatgcacaggtctggtttacattttgatgagttttaactcatttaacattactatggaacccacctcctttgaagatacagagtatttctatcatccagaaagttctcctgtgctttcatgctgtcccgcactcccccagcagctgatgaacatgctgaggacattggtactggattctggccgccccaaaagagccgctttgaccaggcttacccagcactaaatccctgcctgctctctcaaaatttccatctttaaactggttgtacctataaccctccctcatcaagtcaatagataaacaaaccctgaaaaataaacaactcttcctggcccagc

SEQ ID NO: 4056 - DNA, 1857 bp, Homo sapiens
atgatgtccaaagaaaccagacagagcaaattggccgaggccaaggaacagttgacagaccatcatccccagaccaaccctagtgttggtacagcagcaagcgacaccaaaaagaagaaaataaataatggcactaaccctgagacaaccacttctggtggttgccactcgcctgaggatgaacagaaggcaagccaccaacatcaggaagccctaaggagggagctagaggcccaggttcataccatacgaatccttacatgtcagaaaactgagcttcagatggcactctactacagccagcatgctgtcaagcagttggaaggagaggccagggatctgatcagccgcctgcatgattcatggaagtttgcaggagagttagagcaggctctctctgctgtcgctacacagaagaagaaggcggataggtacattgaggagttaacaaaggagagggacgccctgagtctggaactgtacaggaacaccataactgatgaggagctgaaggagaaaaatgccaaactacaagaaaaacttcaacttgtagaatctgaaaagtctgagatccagctcaacgtaaaggagctaaaaaggaaactggagagggccaagctcctgctgccacagcagctgcaggcggaggctgaccacctgggtaaggagctgcagagtgtgtcagcaaagctccaagcccaggtggaagagaacgagttgtggaaccgcctgaaccagcaacaggaggagaagatgtggaggcaggaggagaagatacaggagtgggaggagaagatacaggagcaggaggagaagatacgggagcaggaggagaagatacgggagcaggaggagaagatgcggaggcaggaggagatgatgtgggagaaggaggagaagatgcggaggcaggaggagatgatgtgggagaaggaggagaagatgcggaggctggaggagatgatgtgggagaaggaggagaagatacgggagctggaagagaagatgcacgagcaggagaagatacgggagcaggaagagaagaggcaggaggaggagaagatacgcgagcaggagaagaggcaggagcaggaggcgaagatgtggaggcaggaggagaagatacgggagcaggaagagaagatacgggagcaggagaaaaagatgtggaggcaggaggagaagattcacgagcaggagaagatacgggaggaggagaagaggcaggagcaggaggagatgtggaggcaggaggagaagataagggagcaggaggagatatggaggcaaaaggagaagatgcacgagcaggagaagatacggaagcaggaggagaaggtgtggaggcaggaggagaagatgcacgaccaggaggagaagatacgggagcaggaggagaagatgtggaggcaggaggagaagataagggagcaggaggagaagatacgggagcaggaggagaagatacgagagcaggaggagatgatgcaggaacaggaagagaagatgggggagcaggaagagaagatgcaagaacaggagaagatgcggaggcaggaggagaagataagggagcaggaggagaagatacgggagcagaaggagaagatacgagagcaggaggagaagatatgggagcaggaggagaagatacgagagcaggaggagatgatgcaggaacaggaagagaagatgtgggagcaggaggagaagatgtgtgagcaggaagagaagatgcaagaacaggaggagaagatgcggaggcaggaggagaagatgtgggagcaggaagtgaggctgcggcagcaggaggagaagatgcaggaacaccaggagcacctggaagctgccatctaa

SEQ ID NO: 4057 - DNA, 1240 bp, Homo sapiens
gcgttccattggtgccctggttacgccacctgtggctcagttgcacagctgcctggtaggtgactggaggcattgagcagtgctcactggtatttcgctgatgtggccccaaccccgcctccctccccaccccgcgatgtcagaaaaaacacaacaggggaaattggccgcagccaagaaaaagttaaaagcatattggcagaggaagagccctggcattccagcaggagctaacaggaaaaagaaagtcaatggcagtagccctgacacagccacttctggtggttaccactcacctggggattcagcaacaggtatctacggggagggccgtgcatcctctactaccctgcaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacatgaacaggaggagaggctacatgagcaggaggagaggctgtgtgaacaggaggagaggctgtgtgaacaggaggagaggctacgtgaacaggaggagaggctacgtgaacaggaggagaggctacatgaacaggaggagaggctgtgtgaacaggaggagaggctatgtgaacaggaggagaggctgtgtgaacaggagaagctgccagggcaggagaggctgctggaagaggtggagaagctgttagaacaggagaggcggcaggaggagcaggagaggctgctggagagggagaggctgtggacgaggtggaggagctcctggagcaggagaggcttcggcaacaggatgagaggctgtggcagcaggagactctgcgggagctggagaggctgcgggagctggagaggctgcgggagctggagaggctgcgggagctggagaggatgctggagctggggtgggaagccctgtacgagcagcgggccgagccacgcagcggcttcgaggagc

SEQ ID NO: 4058 - DNA, 1440 bp, Homo sapiens
atgtggccccaaccccgcctccctccccaccccgcgatgtcagaaaaaacacaacaggggaaattggccgcagccaagaaaaagttaaaagcatattggcagaggaagagccctggcattccagcaggagctaacaggaaaaagaaagtcaatggcagtagccctgacacagccacttctggtggttaccactcacctggggattcagcaacaggtatctacggggagggccgtgcatcctctactaccctgcaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacatgaacaggaggagaggctacatgagcaggaggagaggctgtgtgaacaggaggagaggctgtgtgaacaggaggagaggctacgtgaacaggaggagaggctacgtgaacaggaggagaggctacatgaacaggaggagaggctgtgtgaacaggaggagaggctatgtgaacaggaggagaggctgtgtgaacaggagaagctgccagggcaggagaggctgctggaagaggtggagaagctgttagaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggctgcgggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcagaagaggctgcatgccattcttttcgggctgcggagaacagggagctaaacatcaccatcatctaa

SEQ ID NO: 4059 - DNA, 2006 bp, Homo sapiens
gctgcgtggtacgtgactggaggtgtatccttgtcctcgtctgaatcacgctgatgtggccccaaccccacctccctccccaccccatgatgtcagaaaaaaccagacagaacaaattggctgaggccaagaaaaagtttacagactatcgtcagtggaacattgctggtgttggtaccagagcaactgacaccaaaaagaagaaaataaataatggcactaaccctgagacaaccacttcggagggttgccattcacctgaggatacacaacagaaccgagcgcagctgaaagaagaaaagaaggcaagccaccaacatcaggaagccctaaggcgggagatagaggcccaggatcatacaatacgaattctcacgtgtcagaaaactgaactggagacagcgctctattacagccaggatgctgccaggaaatttgaagatgggaacctgggcaccccatcatccttcaacctggcactttcacaggcctttagggggagtcctttgggctgtgtctcaacctctctcattccaggagagtccaaggatctcgccggccgcttgcatcattcctggcactttgcaggagagttacagcgggctctctctgctgtgtccacatggcacaagaaggcagacaggtacatcgaggagttaacaaaggagagggacgccctgagtctggaactgtacaggaacaccataaccaatgaggagctgaagaagaaaaatgccgaactacaagaaaaacttcgacttgcagaatctgaaaagtctgagatccagctcaacgtgaaggagctaaaaaggaaactggagagggccaagttcctgctgccacaggttcaaaccaacactttgcaggaggagatgtggaggcaggaggaggagctacgggagcaggaaaagaagatacggaagcaggaggagaagatgtggagacaggaggagagactgcgggagcaggaggggaagatgcgggagcaggaggagaagatgcggagacaggagaagaggctgcgagagcaggagaaggagctgcgggagcaggagaaggagctgcgggagcagaagaagctgcgggagcaggaggagcagatgcaggagcaggaggagaagatgtgggagcaggaggagaagatgcgggagcaggaagagaagatgtggagacaggaggagaggctgtgggagcaggagaagcagatgcgggagcaggagcagaagatgcgggaccaagaggagaggatgtgggagcaggacgagaggctacgggagaaggaggagaggatgcgggagcaggagaagatgtgggagcaggtggagaagatgcgggaggagaagaagatgcaggagcaggagaagaagacgcgggaccaggaggagaagatgcaagaggaggagaggatacgggagcgggagaagaagatgcgggaagaggaggagacgatgcgggagcaggaggagaagatgcagaagcaggaggagaatatgtgggagcaggaagagaaggagtggcagcagcagaggctgccggaacagaaggagaagctgtgggaacaggagaagatgcaggagcaggaggagaagatatgggagcaggaggagaagatacgggaccaggaggagatgtgggggcaggagaagaagatgtggcggcaggagaagatgcgggagcaggaagatgagatgcgagagaaggaggagaggatacgagatcagaaagagaagatgcaggagaggctgccagagcacgaggagcggtgctcagagccctgcctccctccctccaaagttctttgtaatatgagccacactggcagtgtggagcctgcaggaggagaggctggggagggttctccgcaggacaaccccactgcacaggagatcatgcagctgttttgtgggatgaagaacgcccagcagtgcccaggattaggcagtacctcctgcatcccattcttctaccgaggagacaagagaaagatgaagatcatcaatatctaa

SEQ ID NO: 4060 - DNA, 1972 bp, Homo sapiens
gctgcgtggtacgtgactggaggtgtatccttgtcctcgtctgaatcacgctgatgtggccccaaccccacctccctccccaccccatgatgtcagaaaaaaccagacagaacaaattggctgaggccaagaaaaagtttacagactatcgtcagtggaacattgctggtgttggtaccagagcaactgacaccaaaaagaagaaaataaataatggcactaaccctgagacaaccacttcggagggttgccattcacctgaggatgaaaagaaggcaagccaccaacatcaggaagccctaaggcgggagatagaggcccaggatcatacaatacgaattctcacgtgtcagaaaactgaactggagacagcgctctattacagccaggatgctgccaggaaatttgaagatgggaacctgggcaccccatcatccttcaacctggcactttcacaggcctttagggggagtcctttgggctgtgtctcaacctctctcattccaggagagtccaaggatctcgccggccgcttgcatcattcctggcactttgcaggagagttacagcgggctctctctgctgtgtccacatggcacaagaaggcagacaggtacatcgaggagttaacaaaggagagggacgccctgagtctggaactgtacaggaacacaatctgaaaagtctgagatccagctcaacgtgaaggagctaaaaaggaaactggagagggccaagttcctgctgccacaggttcaaaccaacactttgcaggaggagatgtggaggcaggaggaggagctacgggagcaggaaaagaagatacggaagcaggaggagaagatgtggagacaggaggagagactgcgggagcaggaggggaagatgcgggagcaggaggagaagatgcggagacaggagaagaggctgcgagagcaggagaaggagctgcgggagcaggagaaggagctgcgggagcagaagaagctgcgggagcaggaggagcagatgcaggagcaggaggagaagatgtgggagcaggaggagaagatgcgggagcaggaagagaagatgtggagacaggaggagaggctgtgggagcaggagaagcagatgcgggagcaggagcagaagatgcgggaccaagaggagaggatgtgggagcaggacgagaggctacgggagaaggaggagaggatgcgggagcaggagaagatgtgggagcaggtggagaagatgcgggaggagaagaagatgcaggagcaggagaagaagacgcgggaccaggaggagaagatgcaagaggaggagaggatacgggagcgggagaagaagatgcgggaagaggaggagacgatgcgggagcaggaggagaagatgcagaagcaggaggagaatatgtgggagcaggaagagaaggagtggcagcagcagaggctgccggaacagaaggagaagctgtgggaacaggagaagatgcaggagcaggaggagaagatatgggagcaggaggagaagatacgggaccaggaggagatgtgggggcaggagaagaagatgtggcggcaggagaagatgcgggagcaggaagatgtgggggcaggaggagatgcgagagaaggaggagaggatacgagatcagaaagagaagatgcaggagaggctgccagagcacgaggagcggtgctcagagccctgcctccctccctccaaagttctttgtaatatgagccacactggcagtgtggagcctgcaggaggagaggctggggagggttctccgcaggacaaccccactgcacaggagatcatgcagctgttttgtgggatgaagaacgcccagcagtgcccaggattaggcagtacctcctgcatcccattcttctaccgaggagacaagagaaagatgaagatcatcaatatctaaaagttggcactgtcaacaaggcctacagaagcataagccgccatg

SEQ ID NO: 4061 - DNA, 762 bp, Homo sapiens
atgttgagtctcctgaacaggagacaggaggagaggctacgtgaacaggaggagaggctacgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggaagaggtggagaagctgttagaacaggagaggcttcggcaacaggatgagaggctgtggcagcaggagactctgcaggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctgaagaagtcgggtggagctgaagagccaagaggctccgagtctgcagcagcagccagaccagtagctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgcggagaacagggagctaaacatcaccatcatctaagagcgggtc

SEQ ID NO: 4062 - DNA, 475 bp, Homo sapiens
catctaaggcttcggcaacaggatgagaggctgtggcagcaggagactctgcaggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctgaagaagtcgggtgagctgaaagagactgtaacctccgacccatccaagaagatgtgggaggcgggcaccagcctctggggaggggaggtgccaggccacaggcagctgcagcctggggacaggtgaccccagcaccctccggggcagtcctatgactgtttcttgcttcctgccctctgacttttagaggtgggtagccctggggtcctcccaggtctggacatcatcatcccagctagaggcatggagcccc

SEQ ID NO: 4063 - DNA, 4091 bp, Homo sapiens
attctagtgcagccctggttacgcctcctctggctcagtcacacagcgacgtagaggtgactggaggtatatacttgtcctcacctggatcatgctgatgtggccccaaccccacctccctacccatccccacctccctacccatccccacctccctacccatccccacctccctacccatccccacctccctacccatccccacctccctacccatccccacctccctacccatcctatgatgtccaaagaaaccagacagagcaaattggccgaggccaaggaacagttgacagaccatcatccccagaccaaccctagtgttggtacagcagcaagcgacaccaaaaagaagaaaataaataatggcactaaccctgagacaaccacttctggtggttgccactcgcctgaggatgaacagaaggcaagccatcaacatcaggaagccctaaggagggagctagaggcccaggttcataccatacgaatccttacgtgtcagaaaactgagcttcagatggcactctactacagccagcatgctgtcaagcagttggaaggagaggccagggatctgatcagccgcctgcatgattcatggaagtttgcaggagagttagagcaggctctctctgctgtcgctacacagaagaagaaggcggataggtacattgaggagttaacaaaggagagggacgccctgagtctggaactgtacaggaacaccataactgatgaggagctgaaggagaaaaatgccaaactacaagaaaaacttcaacttgtagaatctgaaaagtctgagatccagctcaacgtaaaggagctaaaaaggaaactggagagggccaagctcctgctgccacagcagcagctgcaggcggaggctgaccacctgggtaaggagctgcagagtgtgtcagcaaagctccaagcccaggtggaagagaacgagttgtggaaccgcctgaaccagcaacaggaggagaagatgtggaggcaggaggagaagatacaggagtgggaggagaagatacaggagcaggaggagaagatacgggagcaggaggagaagatacgggagcaggaggagaagatgcggaggcaggaggagatgatgtgggagaaggaggagaagatgcggaggcaggaggagatgatgtgggagaaggaggagaagatgcggaggcaggaggagatgatgtgggagaaggaggagaagatgcggaggcaggaggagatgatgtgggagaaggaggagaagatacgggagctggaagagaagatgcacgagcaggagaagatacgggagcaggaagagaagaggcaggaggaggagaagatacgcgagcaggagaagaggcaggagcaggaggcgaagatgtggaggcaggaggagaagatacgggagcaggaagagaagatacgggagcaggagaaaaagatgtggaggcaggaggagaagattcacgagcaggagaagatacgggaggaggagaagaggcaggagcaggaggagatgtggaggcaggaggagaagattcacgagcaggaggagatatggaggcaaaaggagaagatgcacgagcaggaggagaagatacggaagcaggaggagaaggtgtggaggcaggaggagaagatacgggagcaggaggagaagatacgggagcaggaggagaagatgtggaggcaggaggagaagatacgggagcaggaggagatgtggagggaggaagagaagatgcatgagcaggagaagatatgggaggaggagaagaggcaggagcaggaggataagatgtggaggcaggaggagaagatacgggagcaggaggagaaggtgtggaggcaggaggagaagatacgggagcaggaggaaaagaggcaggagcaggaggagaagatgtggaagcaggaggagaagataagggagcaggaggagaagatacaggagcaggaggagaagatacgggagcaggaggagaagatacgagagcaggaggagatgacgcaggaacaggaagagaagatgggggagcaggaggagaagatgtgtgagcaggaagagaagatgcaagaacaggaggagacgatgtggaggcaggaggagaagataagggagcaggagaagaagatacgggagcaggaggagaagatacgagagcaggaggagatgatgcaggaacaggaagagaagatgtgggagcaggaggagaagatgtgtgagcaggaagagaagatgcaagaacaggaggagaagatgcggaggcaggaggagaagatgtgggagcaggaagtgaggctgcggcagcaggaggagaagatgcaggaacactaggagcacctggaagctgccatctaatgagcacatgacaagaaggcaaagacaataaacatgtaaaagccggcagcaaggcctggagaagagtaagccgccatgtgactgtttagaatatagtctgagcacaaacctgaaaaaaaaattttatttattttaaattgtggcaaaatactggccaggcatggtagctcacgcctgtaatcctagcaatttgggaggccgaggtaaatggatgacctgaggtcaagagttcaagaccagcctggccaatacaaaaattagccgggcatggtggcgcatgcctgtaatcccagctacttgggaggctgaggcaggagaatcgcttgaacctgggaggcagaggttgcagtgagctgagatcgtgccactgcactcaagcctggtgacagagcgaaactccgtctcaaaaaaaaaagtttcttccttacatgtatgtttctattagttttcttcttggtctttctcatttagtcttgtgttgtcttttgacattcatagtaaacttttatctgcctccagagagtattgactttgagtttatggcacacaattggagtaagggcagatcgccttcatctactttgggactaagctggttcaaagcaggttttaggttttctgatggctggtctatgttttattcatttggactcccaggggtggcccttccagggtccccaccaaggtcccatctccttcctgggacccaaattctcattaggtcatttcagccctgtgagagtgccaaacattcagctaggctctccagcctcttaactaccacttcatactcagtttcttagcctcttagccctctactgttgaccaatcaccaaatgtgggaaagcactacagactgtcaggatcacctcctaggcctggtcactcaagtcctgactgaggtctccaattaccttccaacaattgtttttgattgggggcggggcacatttttatccagtttttctaactgctcttgtggggaggcgaatccgtaacaagctcctctgcctttactgaaagttgaaaaccttcatctgtcctttttttgttgtttttgagatggagtcttgcgctgttgcccaggctctagtgcaatggcacgatctctgctcactgtaacctctgcctcctgggttcaagcaattctcctgcctcagcttcccgagtagcgtgtgccaccatgcctggctaatttttttttatacctttaatagaggcaggatttcaccatgttttccaggctggtctcgagctcctgactcaggtgatctacctgcctcagcctcccaaagtgctgggattacaagtatgagccactgcatctggcccatctgtcttttaaaacatgtttttaattggaggtataatttctgttagtgaaatgcacaggtctggtttacattttgatgagttttaactcatttaacattactatggaacccacctcctttgaagatacagagtatttctatcatccagaaagttctcctgtgctttcatgctgtcccgcactcccccagcagctgatgaacatgctgaggacattggtactggattctggccgccccaaaagagccgctttgaccaggcttacccagcactaaatccctgcctgctctctcaaaatttccatctttaaactggttgtacctataaccctccctcatcaagtcaatagataaacaaaccctgaaaaataaacaactcttcctggcccagc

SEQ ID NO: 4064 - DNA, 4086 bp, Homo sapiens
ttgcacagctgcctggtaggtgactggaggcattgagcagtgctcactggtatttcgctgatgtggccccaaccccgcctccctccccaccccgcgatgtcagaaaaaacacaacaggggaaattggccgcagccaagaaaaagttaaaagcatattggcagaggaagagccctggcattccagcaggagctaacaggaaaaagaaagtcaatggcagtagccctgacacagccacttctggtggttaccactcacctggggattcagcaacaggtatctacggggagggccgtgcatcctctactaccctgcaggatctggagagccagtaccaagaactagcagtagccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagaggtggagaagctgttaaaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggttgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgccgagaacagggagctaaacatcaccatcatctaagagcgggtcaagaaattgaaaaaaaaaaacaaaacatttaaggggttaatatcctacacaattcatttacttcatttgaatgttagagccacttatgtttgtgtttctaatttatagtttaaatttatttgtgtttctaatttatagtttaaatttatttgtttctaatttatagtttaaatttatttgtgtttctaatttatagtttaaatttatttgtgtttctaatttataatttaaatttatttgtaaaaagttaaatgagagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctctggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctaggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaacgtttacaaactgcagcacaatctactgttcgtgaatgtcaaagtgtcatgaggaaagtgtctatacaatcacagagttatatttcctcacaaagttctttacaaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacagttactttaagcccattttaaaccctcaggctagaaatcgtaccactgttaattagccacattatttggtctaacagtttatcattctgaaactgagcttacctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactatgacaataactatgacaagtctttcttcaaagtgcatgcagtcttttgcagtaactcattcagccaagtatttgttctctacctcattcagtataaggcagcctttaatttgcttagaaggcaacattagaaggttagagttcagcaggaacatagaattttaaaatgtgacttcaactgaataaatttgaatttctgtagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgctgctgtgatgctactataatgtaatacattattaaattgtttcaaggtgc

SEQ ID NO: 4065 - DNA, 4257 bp, Homo sapiens
agttacgcagctgtcttccaggtgactggatgtgttgatcagcgctcgctgggatttggctgacgtggccccagccccgcctccctccccaccccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaggcttcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtggctctcactgatgttcactctggcatccttcagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttctaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccgagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcagtgacctaaaaagggcttatttccgaggaatgaaaggctgccatcattggctgtgggtgtgaaaaacctttcctagcttagagcatttgtatctacaatacattttaaagtcagagttcgtgttccctgttttaatcacatgactacctgtcccagtacacgaaagggcgctggttggcattcttcttaatgtatttagtgaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggaattttagtagacagtattatattatctttgaaaatcaaggagaagtttatgcaacttaaaatgtttacacactgtggtgcaatctactgtttgtgaatgtctgtattatcaggaaacatgtctatacgatcgcagagttgtatttcctcacaaacttctttacgaagagtgaaatacgtttttgtacctctcattttcagtcagggacatactttgtgcaatatttctgtgattgtgcctatgcatgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtaggtgtgctccctggggtggggagttttctagttactagaccatctccatttttagcacttggcagcctcatgatccttttataaatgtgagattaacaggagagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtttaaaaggaagaaatggtgggaaggaaaagtagagaaagaaatgccaattccaggccaaagcgttatttgccaagttttcttagaatgaattttaccaatgtatgagttcttgttaacagaatgtgtaacggaaatactgaaagacttttgcttaaagtggcattattgactgctgatgtgatgctactgtaatgcaataaatttttaaattgttgcaaagtgc

SEQ ID NO: 4066 - DNA, 5139 bp, Homo sapiens
cacgtaaagggacagagattgggggacagaaggaagtgcattaattccttccacgacccctgaagagcagcggtgggtctgagcatcctatctccaggaagcaggccagcaggcaagccagctgccacctcgtcctgtgcaaagcacaggcaccgtccccaaaagatttccaaagatgatgttaaacccagccacggttctgatctccaggaaagcaattgctgtggtacaaaaggacaagggttaaaagagaacagtgggagctctctttcccagctaactcacgcagtgtgacgcagaggctttcagcacagcccagggtgcccgggactgaaaactccttcaccagccccctccacaggatatagaagacttagatcactacgagatgaaagcagagcccattagtgggaaaaagttggaggatgaaggaattgaaaaagaaaatttggcaatattagagaaattaggaagactgaaagacaagagcatttaactgcaaactgttgtcgttgtcaactgggttgtcttcctgaagtatgaatccggtatgtattgtgtggaggagcattacgtattgaacttctcacaaaacagggctgaagcagtgcctactcgacagaaccggtcatcgtacaaagaaatgccacgtgactcaaaggcaaagccagagtgcagcttggagcaaagaagatgatgtctcactctgtcacccaagatggagtgcaatggcacgatctcagctcactgcaacctctgcctcccagtagagacggggtttcaccatgttgggcaggctagtcttggaactactgacctcaggtgatccgcccactttggcctcccgaaagtgctgggattacagtcatgagccaccatgcccagcctatttatttctgattctttaagggtgactggatgtgttgatcagcgctcgctgggatttggctgacgtggccccagccccgcctccctccccaccccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaggcttcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtggctctcactgatgttcactctggcatccttcagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttctaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccgagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcagtgacctaaaaagggcttatttccgaggaatgaaaggctgccatcattggctgtgggtgtgaaaaacctttcctagcttagagcatttgtatctacaatacattttaaagtcagagttcgtgttccctgttttaatcacatgactacctgtcccagtacacgaaagggcgctggttggcattcttcttaatgtatttagtgaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggaattttagtagacagtattatattatctttgaaaatcaaggagaagtttatgcaacttaaaatgtttacacactgtggtgcaatctactgtttgtgaatgtctgtattatcaggaaacatgtctatacgatcgcagagttgtatttcctcacaaacttctttacgaagagtgaaatacgtttttgtacctctcattttcagtcagggacatactttgtgcaatatttctgtgattgtgcctatgcatgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtaggtgtgctccctggggtggggagttttctagttactagaccatctccatttttagcacttggcagcctcatgatccttttataaatgtgagattaacaggagagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtttaaaaggaagaaatggtgggaaggaaaagtagagaaagaaatgccaattccaggccaaagcgttatttgccaagttttcttagaatgaattttaccaatgtatgagttcttgttaacagaatgtgtaacggaaatactgaaagacttttgcttaaagtggcattattgactgctgatgtgatgctactgtaatgcaataaatttttaaattgttgc

SEQ ID NO: 4067 - DNA, 4242 bp, Homo sapiens
atgttgccagttgatggggaagaaaggaagtcggagggctcagacactgagggggacagaacatctccatgtgcaggccctacatcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtggctctcactgatgttcactctggcatccttcagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttctaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccgagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcagtgacctaaaaagggcttatttccgaggaatgaaaggctgccatcattggctgtgggtgtgaaaaacctttcctagcttagagcatttgtatctacaatacattttaaagtcagagttcgtgttccctgttttaatcacatgactacctgtcccagtacacgaaagggcgctggttggcattcttcttaatgtatttagtgaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggaattttagtagacagtattatattatctttgaaaatcaaggagaagtttatgcaacttaaaatgtttacacactgtggtgcaatctactgtttgtgaatgtctgtattatcaggaaacatgtctatacgatcgcagagttgtatttcctcacaaacttctttacgaagagtgaaatacgtttttgtacctctcattttcagtcagggacatactttgtgcaatatttctgtgattgtgcctatgcatgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtaggtgtgctccctggggtggggagttttctagttactagaccatctccatttttagcacttggcagcctcatgatccttttataaatgtgagattaacaggagagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtttaaaaggaagaaatggtgggaaggaaaagtagagaaagaaatgccaattccaggccaaagcgttatttgccaagttttcttagaatgaattttaccaatgtatgagttcttgttaacagaatgtgtaacggaaatactgaaagacttttgcttaaagtggcattattgactgctgatgtgatgctactgtaatgcaataaatttttaaattgttgc

SEQ ID NO: 4068 - DNA, 6478 bp, Homo sapiens
agttctcatgggatctgatggttttataagtagcggtctcccccgctcttccctctcattcctgacgccatgcgaagaaggtccttgcttcccttttgccttctgccatgattctctactgagatgaagaaagaaaaagaatacctgctcagctccagagacacgtaaagggacagagattgggggacagaaggaagtgcattaattccttccacgacccctgaagagcagcggtgggtctgagcatcctatctccaggaagcaggccagcaggcaagccagctgccacctcgtcctgtgcaaagcacaggcaccgtccccaaaagatttccaaagatgatgttaaacccagccacggttctgatctccaggaaagcaattgctgtggtacaaaaggacaagggttaaaagagaacagtgggagctctctttcccaactaactcacgcagtgtgacgcagaggctttcagcacagcccagggtgcccgggactgaaaactccttcaccagccccctccacaggatatagaagacttagatcactacgagatgaaagcagagcccattagtgggaaaaagttggaggatgaaggaattgaaaaagaaaatttggcaatattagagaaattaggaagactgaaagacaagagcatttaactgcaaactgttgtcgttgtcaactgggttgtcttcctgaagtatgaatccggtatgtattgtgtggaggagcattacgtactgaacttctcacaaaacagggctgaagcagtgcctactcgacagaaccggtcatcgtacaaagaaatgccacgtgactcaaaggcaaagccagagtgcagcttggagcaaagaagatgatgtctcactctgtcacccaagatggagtgcaatggcacgatctcagctcactgcaacctctgcctcccaggttcaagcaattatcctgcctcagccacccgagtagctgagattacaggcctctgccaccatgctcagctattttttgtatttttagtagagacggggtttcaccatgttgggcaggctagtcttggaactactgacctcaggtgatccgcccactttggcctcccgaaagtgctgggattacagtcatgagccaccatgcccagcctatttatttctgattctttaagggtgactggatgtgttgatcagcgctcgctgggatttggctgacgtggccccagccccgcctccctccccaccccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaggctgtgagtcttgcctggacaggcttttggggacagggggcccaaggagcagtagagggcaatcgttaagattgtggatggactgttgggtactggtgaaggattctggatttggccgggcacagtggctcacgcctgtaatccccacacttcgggagaccgaggcaggtggatcacaaggtcaggagatcgagaccatccaggcaaacacggtgaaatactaaaaaatacaaaaaaaaaagccgggcgtggtggcgggcgcctgcagtcccagctgctccggagtctgagggaggagaatggcgtgaacctaggaggcggagcttgcagtgagccaagatcacgccactgcactccagcctggaaggcagagagagactccgtttcaaaaaagaaaagaattctgggtttgaatcctgcctctccgtctgctagggatatgatttagggcaagttgcttgagctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtctcatctcttatagtcagcaacaggtatccacggggagggccctacatcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtggctctcactgatgttcactctggcatccttcagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttctaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccgagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcagtgacctaaaaagggcttatttccgaggaatgaaaggctgccatcattggctgtgggtgtgaaaaacctttcctagcttagagcatttgtatctacaatacattttaaagtcagagttcgtgttccctgttttaatcacatgactacctgtcccagtacacgaaagggcgctggttggcattcttcttaatgtatttagtgaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggaattttagtagacagtattatattatctttgaaaatcaaggagaagtttatgcaacttaaaatgtttacacactgtggtgcaatctactgtttgtgaatgtctgtattatcaggaaacatgtctatacgatcgcagagttgtatttcctcacaaacttctttacgaagagtgaaatacgtttttgtacctctcattttcagtcagggacatactttgtgcaatatttctgtgattgtgcctatgcatgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtaggtgtgctccctggggtggggagttttctagttactagaccatctccatttttagcacttggcagcctcatgatccttttataaatgtgagattaacaggagagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtttaaaaggaagaaatggtgggaaggaaaagtagagaaagaaatgccaattccaggccaaagcgttatttgccaagttttcttagaatgaattttaccaatgtatgagttcttgttaacagaatgtgtaacggaaatactgaaagacttttgcttaaagtggcattattgactgctgatgtgatgctactgtaatgcaataaatttttaaattgttgc

SEQ ID NO: 4069 - DNA, 5264 bp, Homo sapiens
agtcacacagctgcctggaaggtgactggaggccttgatcggttctcattgcgattttgctgctgtggccccaaccctgcctccctccccaccctgcgatggcagaagaaactcaacacaacaaattggctgcagccaagaaaaagttaaaagaatattggcagaaaaacagccctagagttccagcaggagcgaacaggaacaggaaaacaaatggcagtatccctcagacagccacttctggtggttgccagccacctggggattcagcaacaggttttcacagggaaggccctacatcatctgctaccctgaaagatctggagagcccgtgccaagaacgagcagtagtcctggattcaaggtccgtagaaatcagtcaactgaagaacaccatcaaatctttgaaacaacagaagaaacaagtggaacatcagctggaagaagaaaagaaagcaaacatcaagaaacagaaagccaaaagggtgctagaggttcaaatccagacattgaacatacagaaagaggaactaaatacggacctgtaccacatgaaacgttctctcagatactttgaagaaaagtccaaggatctggctgtccgcctgcaacattcattgcagcgtaaaggagagttagagagtgttctctctgatgtcatggccacacagaagaagaaggcaaaccagttgtccagccccagtaaagcaggtacggagtggaagttagagcagtccatgcgggaggaggcactactgaaagtgcagctgacacagttgaaggagtcatttcaacaactccaattagaaagacatgaatatgctgaacatctaaaaggagagagggcccggtggcagcagaggatgagaaaaatgtcgcaggagatttgcacattaaagaaagagaagcagcaagatatgcgtcgggtagagaagctggagaggagcttgtccaaactcaaaaaccagatggctgaacccttgcccccggagcccccagcagtgccctctgaggtggagctgcagcacctgaggaaggaactagagagagtggcaggagcgctccaggcccaggtcaaaaacaatcagcgcataagtctcctgaaccggggacaagaagagaggattcgggagcaggaagagaggcttcggaagcaggaagagaggattcaggagcagcacaagagccttcagcagctggccaagccacagagcgtcttcgaggagccaaacaatgagaacaagagcgcactgcagttggagcagcaagtaaaggagctacaggagaagcttggtgaggagcacctggaagctgccagccagcagaaccagcagctaacagcccagctgagcctcatggctctccctggggaaggacacggaggagaacatctggacagtgagggggaggaggcacctcagcccatgccgagtgtcccagaggacctggagagcagggaggccatgagcagctttatggaccacctggaggagaaggcagacctgagtgagctggtgaagaaaaaagaactctgcttcatccaccactggcgagagagatgccatcagaaaacccatcaccttttatcagaaccagggggccgtgccaaagatgcagcactgggaggaggacaccatcaggctggagctcagggaggagatgaaggtgaagctgctggagctgcagcagatggtattgcggcttacagcaactacaacaatgggcacagaaaattcctggccgctgcccacaaccctgctgatgagcccggtccaggagccccagccccccaggagcttggggctgcagacaagcatggtgatctttgtgaggtgagcctcacctcctctgcccaaggagaggccagggaggatcctctccttgacaagcctactgcacagccgatcgtgcaggaccaccaggagcacccaggcttgggcagcaactgctgtgtgccattcttttgctgggcttggctgccaagaagaaggagataaacatcaccatcatcaaacagctgctcaagaaatttttaaataagaaaccaagttatggggttaatctcctacacaattcatttacttcctttgaatgttagagtcactcatgattatttgtgtttctaatttatagtttaagtttatttataaaaagttaaaagagagtgggtgtctgtggctctcactgatgttcactctggcatccttttagcatttttcttttttaatttcataattgtaggtcattagcatgcatatcgagtttgcccttacgtggtgggagttcaaacacacaaagacccactctttgcccaaaactgttctcgctggtttggaataggctgccatgcttttttaatgttattgcagcatgtatattcactacagaattcagacaaaatttgcctatgttctgctgttgtttgatctaatcttaatcacagtgagctcttcgttagctcaatatgtagtttgcccccaagtgtgcactgtttattactttgtaatatgccactatgagtactgacatttagagttgtttaaaggccaagaactggaaacagcctttcctccattttctgtgtattggtgatgggagtgataaccttttgggggagctttttaaatctcacagaagaggaaagtggcctcctctggcaggtatgtgcaggatagagtgtgtttcatctgttccggtgccaggaattagcagtgtattatgatggttcccttaggatttctatgtgctctgggctcatgaagatattgcatcatgagctgcagcagttgcactctttttggatgacctaaaaagggcttatttctgaggaatgaaaggttcccatcgttgactgtggatgtggaaaacctttcctagcttagagcatttgtatctacaatacattttaaagtcagagttcatgttacctgttttaatcacatgactacatgtcccagtacacaaaagggcactggttggcattcttcttaatgtatttagtgaagatcataacaaatcctttatgagttcaaacgtccctggaacaggcatacaggctctagtcaagaatgaattagagtgaaggaaagctgtgtgacacctggaattcctctctgttcacggatattctttgaggcttgaagattgattttaccatctagacctctttggctaatacctattcttcaaccaccttggttactctgacataggaatttacttccttttccttgaatggaaaacactttaaaaaataatagaaacattattataaactaatatatgtgagatacttagttgaaacaaaaaggagttttagtagacggtattatactatctttgaaaatcaaggagaagtttatgaaacttaaaatgtgtacaaactgcagtgcaatctactgttcgtgaatgtcaatgtattatcaggaaacgtgtctatacaatcacagagttatattttctcacagacttctttacaaagtgaaatatgtttttgtacctctgggtttctgttcgggacatattttgtgcaatatttatgtgattgtgcctatgcatgatgaatgaatgcatttcagttatatattgcctaaatcgtaacttgatgatgcttgggaaagactcaacagttaaaacttcatgaagttctaatgtctgtgttccaaaacacatcacattgttaggatgcagggagataggtgtgtgtgctccctgcggtggggatttctagttactagatcatctccatttttagcatttggcatcctcatgatacttctataaatatgacattaacaggagagcaacaatacgattttaccgatggaataacagatttgctggcattcactgaaagagtgcaaatattcggtccttgtgacttcaactgactcttccaaattttatgaatgtatcaatgtattagataaacccagtttcagaatgataaagaaaaaatgttagaccaaataatgcggctaattaacagtggtacgatttgtagcccgtgggtttaaaatgcacttaaagtcctgttctcgccttttattttctgaacttgccgcttttgcattctttgagttcagtttaaagacggttactttaagagcattttaaaccctcgggctagaaatcggaccactgttaatcagccacattatttggtctaacgttttttcttttatcattctgaaactgggtttatctaatacattgataaattatttcaaaggtacttttatcgttgaaatcacttcacttttaccctgataaatatcagtgactaggaatgaccttcggatagcgtttagcatctgtaaccaatctgacaataatgtgttcatgaggtgcctatggattaaatcacacactggcatatttaagctgaaggtcagtctggaaaataaatttactatattgactgaaataccactctttgtgtaggtatttgtcatatatttaagaaaaagctaaaaagaatggaaattgtatgacaataacttaagtctttctccaaagtgcatgcagtcttttgcgatacctcattcagccgagtatttgtgctcttcctcattcggtataaggcagctttcagtttgcttagaaggcaacattggaatgttagagttcatcagaaacacagaattttaaactgtgagttccactgaatacattttaatttctgtaggaagaatcaaaatacctatttaaagatggcaatatataataatcattttaaaagtatttgattaaacctgataattttccagaaatgaaaaaaaaaatcagctctaaaaccaaagctgattttagaaaatttgaaaatgtaaatcagccctatccataatatagtttctctaaaacttaattttaaagagtcgttttaaaataatataactattaaaatatgtaactgctatcttaatgttctgaaataatttaaaacattttaaaatatgaatactgtagtataaaagaaagaaacagtgggaacgaaaagcagagaaagaaatgccaattccagtccaaagttttatttgccaagttttcttagaatgaattttaccagtttatgaattattgtaaacagaatgtgtaatggaaatactgaaagatttttccctagagtggccttattgactgctggtgtgatgccactgtaatgtaataaattattaagttgtttgaatgtgttgtttttgccttaaaattttattttgcgtttcttgaaaactatagtattaaaggtattgatactgtgcaaa

SEQ ID NO: 4070 - DNA, 2199 bp, Homo sapiens
agtcacacagctgcctggtaggtgactggaggccttgatcggttctcattgagattttgctgctgtgaccccaaccctgcctccctccccaccctgcgatggcagaagaaactcaacacaacaaattggctgcagccaagaaaaagttaaaagaatattggcagaaaaacagccctagagttccagcaggagcgaacaggaacaggaaaacaaatggcagtatccctgagaaagccacttctggtggttgccagccacctagggattcagcaacaggtttccacagggaaggccctacatcatctgctaccctgaaagatctggagagcccgtgccaagaacgagcagtagtcctggattcaaggtccgtagaaatcagtcaactgaagaacaccatcaaatctctgaaacaacagaagaaacaagtggaacatcagctggaagaagtaacgtgatttcgtttcctcgcaacatgactgctggatgaaggctcacccttcagattccaccccatccccacagggcccctgataacctggtcccatgggtgggcctgtcctggggcattggtggcattctgggggcatgtctcttgctgtgccatctctgcctccccctggtaagagctctgtcttcctcttcctacaggaaaagaaagcaaacaacaagaaacagaaagccaaaagggtgctagaggttcaaatccagacattgaacatacagaaagaggaactaaatacggacctgtaccacatgaaacgttctctcagatactttgaagaaaagtccaaggatctggctgtccgcctgcaacattcattgcagcgtaaaggagagttagagagtgttctctctaatgtcatggccacacagaagaagaaggcaaaccagttgtccagccgcagcaaagcacgtacggagtggaagttagagcagtccatgcgggaggaggcactactgaaagtgcagctgacacagttcaaggagtcatttcaacaagtccaattagaaagagatgagtattctgaacatctaaaaggagagagggcccggtggcagcagaggatgagaaaaatgtcgcaggagatttgcacattaaagaaagagaagcagcaagatatgcgtcgggtagagaagctggagaggagcttgtccaaactcaaaaaccagatggctgaacccttgcccccggagcccccagcagtgccctctgaggtggagctgcagcacctgaggaaggaactagagagagtggcaggagagctccaggcccaggtcaaaaacaatcagcgcataagtctcctgaaccagcgacaagaagagaggattcgggagcaggaagagaggcttcggaagcaggaggagaggattcaggagcagcacaagagccttcagcagctggccaagccacagagcgtcttcaaggagccgaacaatgagaacaagaacgcactgcagttggagcagcaagtaaaggagctacaggagaagcttggcgaggagcacctggaagctgccagccagcagaaccagcagctaacggcccagctgagcctcatggctctccctggggaaggacacggaggagaacatctggacagtgagggggaggaggcacctcggcccatgccgagtgtcccagaggacccggagagcagggaggccatgagcagctttatggaccacctggaggagaaggcagacctgagtgagctggtgaagaaaaaagaactctgcttcatccaccactggcgagagagatgccatcagaaaacccatcaccttttatcagaaccagggggccgtgccaaagatgcggcactgggaggaggacaccatcaggctggagctcagggaggagatgaaggtgaagctgctggagctgcagcagatggtattgcggcttacagcaactacaacaatgggcacagaaaattcctggccgctgcccacaactctgctgatgagcccggtccaggagccccagccccccaggagcttggggctgcagacaagcatggtcatctttgtgaggtgagcctcacctcctctgcccaaggagaggccagggaggatcctctccttgacaagcctactgcacagccgatcgtgcaggaccaccaggagcacccaggcttgggcagcaactgctgtgtgccattcttgtgctgggcttggctgccaagaagaaggagataa

SEQ ID NO: 4071 - DNA, 4348 bp, Homo sapiens
gcgttccattggtgccctggttacgccacctgtggctcagttgcacagctgcctggtaggtgactggaggcattgagcagtgctcactggtatttcgctgatgtggccccaaccccgcctccctccccaccccgcgatgtcagaaaaaacacaacaggggaaattggccgcagccaagaaaaagttaaaagcatattggcagaggaagagccctggcattccagcaggagctaacaggaaaaagaaagtcaatggcagtagccctgacacagccacttctggtggttaccactcacctggggattcagcaacaggtatctacggggagggccgtgcatcctctactaccctgcaggatctggagagccagtaccaagaactagcagtagccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagaggtggagaagctgttaaaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggttgcgggagctggagaggatgctggagctggggtgggaagccctgtacgagcagcgggccgagccacgcagcggcttcgaggagctgaacaacgagaacaagagcacactgcagttggagcagcaagtaaaggagctggagaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgccgagaacagggagctaaacatcaccatcatctaagagcgggtcaagaaattgaaaaaaaaaaacaaaacatttaaggggttaatatcctacacaattcatttacttcatttgaatgttagagccacttatgtttgtgtttctaatttatagtttaaatttatttgtgtttctaatttatagtttaaatttatttgtttctaatttatagtttaaatttatttgtgtttctaatttatagtttaaatttatttgtgtttctaatttataatttaaatttatttgtaaaaagttaaatgagagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctctggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctaggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaacgtttacaaactgcagcacaatctactgttcgtgaatgtcaaagtgtcatgaggaaagtgtctatacaatcacagagttatatttcctcacaaagttctttacaaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacagttactttaagcccattttaaaccctcaggctagaaatcgtaccactgttaattagccacattatttggtctaacagtttatcattctgaaactgagcttacctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactatgacaataactatgacaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctgtagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgctgctgtgatgctactataatgtaatacattattaaattgtttcaaggtgctgttttgcctaaaaattttgtgtgtcttgaaaactatagtactgggtattgagactctgcaaattctcggcatgcttggcatgaggtaatcggtttttattcttacaaaattgtaactatgtaagtgtgtttattaaaagaacacaaactaaaaaagttaacaggaattaaagttgtgggatgaaaaagttacaggataaaaaaatactgtggaaaagtggc

SEQ ID NO: 4072 - DNA, 1994 bp, Homo sapiens
agtcacacagctgcctggtaggtgactggaggccttgatcggttcttattgggattttgctgctgtggccccaacccttcctccctccccaccctgcaatggcagaagaaactcaacacaacaaattggctgcagccaagaaaaagttaaaagaatattggcagaaaaacagacctagagttccagcaggagtgaacaggaacaggaaaacaaatggcagtatccctgagacagccacttccggtggttgccagccacctggggattcagcaacaggtttccacagggaaggccctacatcatctgctaccctgaaagatctggagagcccgtgccaagaacgagcagtagtcctggattcaacgtccgtaaaaatcagtcgactgaagaacaccatcaaatctttgaaacaacagaagaaacaagtggaacatcagctggaagaagaaaagaaagcaaacaacgagagacagaaagccgaaagggtgctagaggttcaaatccagacattgatcatacagaaagaggaactaaatacggacctgtaccacatggaacgttctctcagatactttgaagaagagtccaaggacctggctgtccgcctgcaacattcattgcagtgtaaaggagagttagagagggctctgtctgctgtcatcgccacagagaagaagaaggcaaaccagttgtccagctgcagcaaagcacatacagagtgggagttagagcagtccctacaggaccaggcactgctgaaagcgcagctgacacagttgaaggagtcatttcaacaactccaattagaaagagatgagtgtgctgaacatatagaaggagagagggcccggtggcatcagaggatgagtaaaatgtcgcaggagatttgcacattaaagaaagagaagcaggatatgcgttgggtagagcagctggagtggagcttgtccaaactcaaaaaccagacggctgaacccttgcccccggagcccccagcagtgccctctgaggtggagctgcagcacctgaggaaggaactagagagagtggcaggagagctccagtcccaggtcaaaaacaatcagcacataagtctcctgaaccggcgacaagaagagaggattcgggaacaggaagagaggcttcggaagcaggaggagaggcttcaggagcagcacgagaagcttcggcagctggccaagccacagagcgtcttcgaggagctgaacaatgagaacaagagcacactgcagttggagcagcaagtaaaggagctacaggagaagcttggcgaggagcacctggaagtggccagccagcagaaccagcagctaacggcccagctgagcctcatggctctccctggggaaggacacggaggagaacatctggacagtgagggggaggaggcacctcagcccatgccgagtgtcccagaggacccggagagcagggaggccatgagcagctttatggaccacctgaaggagaaggcagacctgagtgagctgctgaaaaaacaagaacttcgcttcattcaatactggcaagagagatgccatcagaaaatccatcaccttttatcagaaccagggggccgtgccaaagatgcagcactgggaggaggacaccatcaggctggagctcagggaggagatgaaggtgaagctgctggagctgcagcagatggtattgcggcttacagcaactacaacaatgggcacagaaaattcctggccgctgcccacaactctgctgatgagcccggtccaggagccccagccccccaggagcttggggctgcagacaagcatggtgatcttcgtgaggtgaccctcacctcctctgcccaaggagaggccagggaggatcctctccttgacaagcctactgcacagccgatcgtgcaggaccaccaggagcacccaggcttgggcagcaactgctgtgtgccattattttgttgggcttggctgccaagaagaaggagataa

SEQ ID NO: 4073 - DNA, 983 bp, Homo sapiens
agtcacacagctgcctggtaggtgactggaggccttgatcggttcttattgggattttgctgctgtggccccaacccttcctccctccccaccctgcaatggcagaagaaactcaacacaacaaattggctgcagccaagaaaaagttaaaagaatattggcagaaaaacagacctagagttccagcaggagtgaacaggaacaggaaaacaaatggcagtatccctgagacagccacttccggtggttgccagccacctggggattcagcaacaggtttccacagggaaggccctacatcatctgctaccctgaaagatctggagagcccgtgccaagaacgagcagtagtcctggattcaacgtccgtaaaaatcagtcgactgaagaacaccatcaaatctttgatttgcacattaaagaaagagaagcaggatatgcgttgggtagagcagctggagtggagcttgtccaaactcaaaaaccagacggctgaacccttgcccccggagcccccagcagtgccctctgaggtggagctgcagcacctgaggaaggaactagagagagtggcaggagagctccagtcccaggtcaaaaacaatcagcacataagtctcctgaaccggcgacaagaagagaggattcgggaacaggaagagaggcttcggaagcaggaggagaggcttcaggagcagcacgagaagcttcggcagctggccaagccacagagcgtcttcgaggagctgaacaatgagaacaagagcacactgcagttggagcagcaagtaaaggagctacaggagaagcttggcgaggtgaaggagacggaaacctccaccccatccaagaagggctgggaggcgggcagcagcctcttgggaggggaggtgccaggtcagaggcagcttccagcctgggggctggtgaccacagcaccccgcagggcagtcctgcgactgtttctcacttcctgcctctga

SEQ ID NO: 4074 - DNA, 1015 bp, Homo sapiens
atggcaggggccgctccgaccacggccttcgggcaggcggtgatcggcccgccgggctcagggaagaccacgtactgcctgggcatgagtgagttcctgcgcgcgctgggccggcgcgtggcggtggtgaacctggacccggccaacgaggggctgccgtacgacatcttctcccaaatggcgcagtgggacctcaggctgactgccgtccacctcgtggattctcactactgcacagaccctgccaagttcatttcagtactgtgtacctccctggccaccatgctgcacgtggaactgccccacatcaacctcctttccaagatggacctcattgagcattatgggaagctggccttcaacctggactactacacagaggttctggacctctcctacctgcttgaccacctggcttctgaccctttcttccgccactaccgccagctcaatgagaagctagtgcagctcatcgaagactatagccttgtctcctttatccctctcaacatccaggacaaggagagcatccagcgagtcctgcaggctgtggataaagccaatggatactgtttcagagcccaagagcagcgaagcttggaagccatgatgtctgccgcaatgggagccgacttccatttctcttccacactgggcatccaggagaagtacctggcaccctcgaaccagtcagtggagcaggaagccatgcagctgtagcaacaaggtggaccctggagagcaggatgcataatccagcactggggaaagtggaggctcctgatgcaggctgcagacccaagagcaagtcctcccagccagagctggcgggctggcaaggggatattcagctctgcaaaggacttctggccaaaaagccagacatggtgccaagcagaacaccccccatactgtcagtggtgtccgtgagctctgggccctgccaccagaaagtcgagcactggtcctagtcaggctgtgatgaaatgtgctacaatacaagagtttattttct

SEQ ID NO: 4075 - DNA, 715 bp, Homo sapiens
gagaaatggagtttcaccatgttggctggtcttgaactcctgacctcagccttcaacctggactactacacagaggttctggacctctcctacctgcttgaccacctggcttctgaccctttcttccgccactaccgccagctcaatgagaagctagtgcagctcatcgaagactatagccttgtctcctttatccctctcaacatccaggacaaggagagcatccagcgagtcctgcaggctgtggataaagccaatggatactgtttcagagcccaagagcagcgaagcttggaagccatgatgtctgccgcaatgggagccgacttccatttctcttccacactgggcatccaggagaagtacctggcaccctcgaaccagtcagtggagcaggaagccatgcagctgtagcaacaaggtggaccctggagagcaggatgcataatccagcactggggaaagtggaggctcctgatgcaggctgcagacccaagagcaagtcctcccagccagagctggcgggctggcaaggggatattcagctctgcaaaggacttctggccaaaaagccagacatggtgccaagcagaacaccccccatactgtcagtggtgtccgtgagctctgggccctgccaccagaaagtcgagcactggtcctagtcaggctgtgatgaaatgtgctacaatacaagagtttattttctactttt

SEQ ID NO: 4076 - DNA, 1529 bp, Homo sapiens
ccggaagtcgagttagtctagttagtatcggcctgttatctccttttgcgcgacacggtctcagctgttccgcctgaggcgagtgacgctggccgccaacgaggtatacgtactgggaccctcgccctcagtctcgtctccggcgcggctacctgccccgttttccctgtgagttgacctgctccgggccgcgggccgccaatggcaggggccgctccgaccacggccttcgggcaggcggtgatcggcccgccgggctcagggaagaccacgtactgcctgggcatgagtgagttcctgcgcgcgctgggccggcgcgtggcggtggtgaacctggacccggccaacgaggggctgccgtacgagtgtgccgtggacgtgggcgagctggtggggctgggcgacgtgatggacgcgctgcgcctggggcccaacggcggcctgctctactgcatggagtacctggaagccaacctggactggctgcgtgccaagctcgaccccctccgcggccactacttcctcttcgactgcccaggccaggtggagctctgcacgcatcacggcgccttgcgcagcatcttctcccaaatggcgcagtgggacctcaggctgactgccgtccacctcgtggattctcactactgcacagaccctgccaagttcatttcagtactgtgtacctccctggccaccatgctgcacgtggaactgccccacatcaacctcctttccaagatggacctcattgagcattatgggaagctggccttcaacctggactactacacagaggttctggacctctcctacctgcttgaccacctggcttctgaccctttcttccgccactaccgccagctcaatgagaagctagtgcagctcatcgaagactatagccttgtctcctttatccctctcaacatccaggacaaggagagcatccagcgagtcctgcaggctgtggataaagccaatggatactgtttcagagcccaagagcagcgaagcttggaagccatgatgtctgccgcaatgggagccgacttccatttctcttccacactgggcatccaggagaagtacctggcaccctcgaaccagtcagtggagcaggaagccatgcagctgtagcaacaaggtggaccctggagagcaggatgcataatccagcactggggaaagtggaggctcctgatgcaggctgcagacccaagagcaagtcctcccagccagagctggcgggctggcaaggggatattcagctctgcaaaggacttctggccaaaaagccagacatggtgccaagcagaacaccccccatactgtcagtggtgtccgtgagctctgggccctgccaccagaaagtcgagcactggtcctagtcaggctgtgatgaaatgtgctacaatacaagagtttattttctactttttgtgacttccaaacttttcttcagtcttccgggcccaggggtttggggaagaatgagggagtgtcacctagccttggaataatcagtatttccc

SEQ ID NO: 4077 - DNA, 680 bp, Homo sapiens
atctccttttgcgcgacacggtctcagctgttccgcctgaggcgagtgacgctggccgccaacgaggtatacgtactgggaccctcgccctcagtctcgtctccggcgcggctacctgccccgttttccctgtgagttgacctgctccgggccgcgggccgccaatggcaggggccgctccgaccacggccttcgggcaggcggtgatcggcccgccgggctcagggaagaccacgtactgcctgggcatgagtgagttcctgcgcgcgctgggccggcgcgtggcggtggtgaacctggacccggccaacgaggggctgccgtacgacatcttctcccaaatggcgcagtgggacctcaggctgactgccgtccacctcgtggattctcactactgcacagaccctgccaagttcatttcagtactgtgtacctccctggccaccatgctgcacgtggaactgccccacatcaacctcctttccaagatggacctcattgagcattatgggaagctggccttcaacctggactactacacagaggttctggacctctcctacctgcttgaccacctggcttctgaccctttcttccgccactaccgccagctcaatgagaagctagtgcagctcatcgaagactatagccttgtctcctttatccctctcaacatccag

SEQ ID NO: 4078 - DNA, 1468 bp, Homo sapiens
ccggagctcagtgggcgtcgcgcgaaggctaagggagtgtggcgggcggctccgggagccaacatgcctcggtatgcgcagctggtcatgggccccgcgggcagcgggaagagcacctactgtgccaccatggtccagcactgtgaagccctcaaccggtctgtccaagttgtaaacctggatccagcagcagaacacttcaactactccgtgatggctgacatccgggaactgatcgaggtggatgatgtaatggaggatgattctctgcgattcggtcccaacggaggattggtattttgcatggagtactttgccaataattttgactggctggagaactgtcttggccatgtagaggacgactatatcctttttgattgtccaggtcagattgagttgtacactcacctgcctgtgatgaaacagctggtccagcagctcgagcagtgggagttccgagtctgtggagtttttcttgttgattctcagttcatggtggagtcattcaagtttatttctggcatcttggcagccctgagtgccatgatctctctagaaattccgcaagtcaacatcatgacaaaaatggatctgctgagtaaaaaagcaaaaaaggaaattgagaaatttttagatccagacatgtattctttattagaagattctacaagtgacttaagaagcaaaaaattcaagaaactgactaaagctatatgtggactgattgatgactacagcatggttcgatttttaccttacgatcagtcagatgaagaaagcatgaacattgtattgcagcatattgattttgccattcaatatggagaagacctagaatttaaagaaccaaaggaacgtgaagatgagtcttcctctatgtttgacgaatattttcaagaatgccaggatgaatgaagagtttactaaaagtaaccatctaaagagcttgtggccaaaccagcagaacattcttctcttcaaaggatgcaatagtagaaagctacttattttaatgaaaaaaagtaaaacttcgttctttatcagcctcatgcctgaatcaaatttttaattattctgaaactgctgctgtttaaagtggaatcttttagtattataacagcatcactttagattttgtaagtcaaaattgaaatgaatgcacatagatttatatataaattagcacctgagctaaggttaaggctggtctaaacttattttcactttttgtattatttttgagatgcaggaattactgtaacaaaatatgtatgtccgaagggaaaaagctgcaaggatatatataagaccactgcttatctgtatcttcccattttcctatattgaaaatgtatattatttatataacttaaaaagtaaaaataactatgttttgagatatgtatgtgtatatataaaagaaacaaaggtttttaatgattcttggacctagataacaagtaca

SEQ ID NO: 4079 - DNA, 1491 bp, Homo sapiens
ggagctcagtgggcgtcgcgcgaaggctaagggagtgtggcgggcggctccgggagccaacatgcctcggtatgcgcagctggtcatgggccccgcgggcagcgggaaggtgaggatctgcggggacaaggagagaaaaagcacctactgtgccaccatggtccagcactgtgaagccctcaaccggtctgtccaagttgtaaacctggatccagcagcagaacacttcaactactccgtgatggctgacatccgggaactgatcgaggtggatgatgtaatggaggatgattctctgcgattcggtcccaacggaggattggtattttgcatggagtactttgccaataattttgactggctggagaactgtcttggccatgtagaggacgactatatcctttttgattgtccaggtcagattgagttgtacactcacctgcctgtgatgaaacagctggtccagcagctcgagcagtgggagttccgagtctgtggagtttttcttgttgattctcagttcatggtggagtcattcaagtttatttctggcatcttggcagccctgagtgccatgatctctctagaaattccgcaagtcaacatcatgacaaaaatggatctgctgagtaaaaaagcaaaaaaggaaattgagaaatttttagatccagacatgtattctttattagaagattctacaagtgacttaagaagcaaaaaattcaagaaactgactaaagctatatgtggactgattgatgactacagcatggttcgatttttaccttacgatcagtcagatgaagaaagcatgaacattgtattgcagcatattgattttgccattcaatatggagaagacctagaatttaaagaaccaaaggaacgtgaagatgagtcttcctctatgtttgacgaatattttcaagaatgccaggatgaatgaagagtttactaaaagtaaccatctaaagagcttgtggccaaaccagcagaacattcttctcttcaaaggatgcaatagtagaaagctacttattttaatgaaaaaaagtaaaacttcgttctttatcagcctcatgcctgaatcaaatttttaattattctgaaactgctgctgtttaaagtggaatcttttagtattataacagcatcactttagattttgtaagtcaaaattgaaatgaatgcacatagatttatatataaattagcacctgagctaaggttaaggctggtctaaacttattttcactttttgtattatttttgagatgcaggaattactgtaacaaaatatgtatgtccgaagggaaaaagctgcaaggatatatataagaccactgcttatctgtatcttcccattttcctatattgaaaatgtatattatttatataacttaaaaagtaaaaataactatgttttgagatatgtatgtgtatatataaaagaaacaaaggtttttaatgattcttggacctagataacaa

SEQ ID NO: 4080 - DNA, 1604 bp, Homo sapiens
ggaggggcaggagcgctgcggtcgctgagcgtttgcacgtttgcacctctctgtggaagcagtgcgtcacaggagggaaatatacatgctccccaaaacaagaggtgccttccacttcagtattccagatcctcagcacatttgcaaatcgcgagggtcaccatacaggtcaaacgtctgcacgcaaaccacggaccgaagcacgtggcgcaaggatgcggagctttatctgttgtccgttattactcagagcacctactgtgccaccatggtccagcactgtgaagccctcaaccggtctgtccaagttgtaaacctggatccagcagcagaacacttcaactactccgtgatggctgacatccgggaactgatcgaggtggatgatgtaatggaggatgattctctgcgattcggtcccaacggaggattggtattttgcatggagtactttgccaataattttgactggctggagaactgtcttggccatgtagaggacgactatatcctttttgattgtccaggtcagattgagttgtacactcacctgcctgtgatgaaacagctggtccagcagctcgagcagtgggagttccgagtctgtggagtttttcttgttgattctcagttcatggtggagtcattcaagtttatttctggcatcttggcagccctgagtgccatgatctctctagaaattccgcaagtcaacatcatgacaaaaatggatctgctgagtaaaaaagcaaaaaaggaaattgagaaatttttagatccagacatgtattctttattagaagattctacaagtgacttaagaagcaaaaaattcaagaaactgactaaagctatatgtggactgattgatgactacagcatggttcgatttttaccttacgatcagtcagatgaagaaagcatgaacattgtattgcagcatattgattttgccattcaatatggagaagacctagaatttaaagaaccaaaggaacgtgaagatgagtcttcctctatgtttgacgaatattttcaagaatgccaggatgaatgaagagtttactaaaagtaaccatctaaagagcttgtggccaaaccagcagaacattcttctcttcaaaggatgcaatagtagaaagctacttattttaatgaaaaaaagtaaaacttcgttctttatcagcctcatgcctgaatcaaatttttaattattctgaaactgctgctgtttaaagtggaatcttttagtattataacagcatcactttagattttgtaagtcaaaattgaaatgaatgcacatagatttatatataaattagcacctgagctaaggttaaggctggtctaaacttattttcactttttgtattatttttgagatgcaggaattactgtaacaaaatatgtatgtccgaagggaaaaagctgcaaggatatatataagaccactgcttatctgtatcttcccattttcctatattgaaaatgtatattatttatataacttaaaaagtaaaaataactatgttttgagatatgtatgtgtatatataaaagaaacaaaggtttttaatgattcttggacctagataacaagt

SEQ ID NO: 4081 - DNA, 6352 bp, Homo sapiens
aaagctgtcgcccctctctcggatgctcaggctgggcagcgctggacagatgggtacaccccgggcctgacggatgaacagtcgggcaagtgaactctcacctccaaactggctctgcgcccggcgggggcggcggcggcgtctgcagccccgcggtgggggcagccccctcggtctacgcccgactgctgcgcgccgcctctgctcttggcatagtaatttcagttcctgaacgcacggagctcgctccgggaccgggctgagaaggacctcagctcgcgggcccgccggagccatcggtgtggcgccgagagacggtgcttgggatatgcgacgggaagcccccgccacagcgcaggcagtggccccgccgcgccgcggagccgggcagagcaggctggttcttcagaggaatcatccctgactgtgtcatcactctgagctctgactgcgctcccctcccccaccagtgggaccagtactcaagagagctctggagtgctcctgaagagaaattccatggggactgtacctgaccctctgagatcagctaaaacttccctgattgcagcttccggaaaagaagacgatctaggagagccacaggctgcctcacctcggcatcgaccagctctcctgtgtaagaatgccaatggcttttcaggtgcccctgcagaaccagacctcagccccagggcagctgccgaagccctgatgcaggtttgtgagcatgagaccacccaaccagatatgtcttctcctggtgtgttcaatgaagtgcagaaagcacctgccacattcaactctcccggcaatccccagctgccagggagcagccagcccgcagcatcagccccgagttctgcagcaggaagggatcttatacacacaccattgacaatgcccgccaatcagcacacctgccagtccatcccaggtgatcagcccaatgccatcacctcatccatgcctgaagattccctgatgagatcacagagaacctcaaatagagagcaacctgagaaaccaagttgtcctgtgggaggcgtcctcagtagcagcaaagatcaggtgtcctgtgagtttccttctccagaaacaatccagggaacagtgcagactccagtgacagcagccagggtggtcagtcactcatcctctcctgtaggtggacctgaaggggaaaggcagggagccatctgtgactctgaaatgaggtcctgtaaacctctaactagagaatctggatgttcagagaacaagcagccctctgtcactgcctcgggcccccaaggcacaacttctgtgacacctcaaccaacccccctcactagcgaaccttcggcatgtcccccaggtccagagaaggtgccgctgccagcacagcgtcagatgtcaaggttcaaagaagccagtacgatgaccaaccaagctgaaagtgaaatcaaggaagttcccagcagggcttggcaagatgcggaggtgcaggcagtggcgagtgtcgagagcagatccgtctccaccagccccagtatcctcactgcatttctgaaggaaagccgtgctcctgagcattttgaacaagagcagctgcgtgtcatttgccacagcagtgggagccacacactggagctctctgacagcacgctagccccccaggagtccagccagtgccctggcatcatgccacaggtgcacattcaggcagctgcagctgagtctacagctttccaacgggaaaataaacttgcgagcctaccaggtggggtccttaaaacctcatcaatcaatttggtctccagtaatgcccagcatacgtgtaaagaagatgggaggttagcaggaatgactccagtgagggaagagtcaactgctaaaaagctcgcaggtactaattctagctccctgaaagctaccgccattgaccagatttctatcagtgcatgcagtcaagctgaaacaagttatggattggggaaatttgaaaccaggccatctgagtttgcagagaaaacgacaaacggccacaaaacagacccagattgcaaactatctgactcttgtggctctatcagcaaagctgatcattctgggagcttggatcccactaataaaggagatgcaagggaaaagaagcctgcatctcctcaggtagtaaaagaaaaagagtctactggcactgatacctcggatgccaaaaccctactgctcaatcctaaatcccaagaaagtggaggcacagaatcagctgctaatcctacaccctccccaattaggaagaaccaggagagcaccttagaagaaaacagacagaccaagacagccaccagcctgagcctgccatctgatcccatgggtgactccagcccaggttctggcaagaagaccccatctcgctccgtcaaagccagcccacgcaggcccagccgcgtcagcgagttcctcaaggagcaaaagttaaatgtgacagcagctgctgctcaggtaggactcactccaggagataagaaaaagcagcttggcgcagactccaagctccagctgaaacagtccaagcgtgtcagggacgtcgtgtgggatgagcagggaatgacctgggaagtgtatggtgcatccttggacgcagagtccctgggaatcgcgatccagaaccatttgcaaagacaaatcagggaacatgagaaattaatcaaaactcaaaatagccagacccggagatccatttcctcagatacttcttcaaataagaagctcagaggaaggcagcacagtgttttccagtccatgctgcagaacttccgacgccccaactgctgcgtccgtcctgccccgtcttctgtgttagattgaaagggagtatttatgggagtttgtgtataaatttacggtattcacatgcgtccctctatgtcaaagcttgcttagttttttgctgcaagactaggaagaaaaagcaagtattcactataggaaattgctattaaaaattgttagatcctttgacctggagctctataaacaaaaatgtcatttcaatttgaaagaaggaacaagaaaagagaaacaagcttcactgaaggtttgcaaccttaacaaattgaaaataatactcactgggtttttaaaaatatgatgttgttcatagaaatagcattattgtatcattatacatgtattattttgtataactgcctcaatttatcacacagtagtagttccattaaaatccctgcttcatattgaaagtagcaaaaacactattggcgaaaacattgttataatttctagtcttattgcagtaagaatgctgtaaccacacaaattataaataggtgataagaaccataatgaaaaaaatgagaacatatttgattcattcctaggccagataacattaaataaaaacagttaaatgtgtaaaatatgaaatatgaattaatgtttataaacatctgcagacaactctttttataaaccttcttattgctgttaataaatataagaaagttatattaggaacattagctaagcttttgactatgaaaactgcctacattaaacatggatttatatagacccattttcctgcactgaaggcaaggcgcatctctgtgattctgaccagacatattcatattttcttaccctagaggaagtacatgggactgaattcttgaaaagagccatcaaattagggataatactaaattgatactgtgcaggtgttctccagtgatattctactgagaatgctaaggttctggtcaggaactataaatagcagattaccaaacactgctttttctgtgatgataaaagcctcataagtaacaaaaacaatgtttaatttagactcctgtaaacaggatgcaattagtgattttttttaattgggttcagtaacttccagtaacaaatgtagtcaacaccaaattagaatgtgagcttccttacaatttttgtacatagactactatcatctaattgcttaaatatatatgctggagtaaaaaggtaacttctgcaaacttattgattttaagagaaatacccataatatccttcaaacccaatgaaagaagaggcctttacgaaaacatggcttgtgatttgggtggattatacttcctgggaccttggccctcccgtgtctccagaagagacgtgtgtcccgagacacatgagtatcctccaaggcactggcctggatgagcagcatcgccttgagaattggggtagtgtggaaaggaagaatgaacaacggccctgggaagccttcccttcctgcagatattgttgggggagtgctggtctccattttgcgtttagaaaaccagacttagatgctggaggggcaccggttgtcttctttgaactcattccccgtaatgagctagaaaagagtacctaaccataggtattctctctagagactcatgtgtcccgtgggtacagtcaattcacagtatctgttctggcttttttcactttaattctgttctgcacattctgaacatatgcaggaaaaaaaatcattcctgaacttagcacaagctacactcgacacaacctaaattagtaaaaagcctttgatttattttgaagcaatttaactgtagacaaagcttgcatatatggaacagtattctcagagcctgagagttgttacagttgttctatttggaaattagaaggaattttttaataaggcacatttttcagtttcttacccattggtgtctattaagaatactatgtaatgttgaaatttccatcaaattaccaagcaaattactattaatgattagagatttagcctaacactctctctttgggccttaaatacccatttgtagttgtgttcgtgtcacttctgtctcagatgcctctgccaggacataatctctctaactcttgctagctggcttctccctcccacatgggcatacatgctgtgtatacacagagtacagcctgtgtacacagtagcagctgtcaacagggcctactccagatgggtggccccaggtaatcctctgctgtaaagtggctagaacaggctgtccctgcattaaaataggtgagaataaggaatttcgcctctgataataatatttattttcatgactttagagtaaccacatgatttgtaaacagttaaatgaagcagaggcctgagagagttgttggcatttgtctcacattaaatacattaaaattgctagatttgctattgtggttatgtctatcaaaactttaagaaaatttgtttaatgtactgagtttaactgattttctttggtgctgggaccaaattcttcacttctacaacactcaagagattgtcacaaaatattacaaaaatattgtttgttttgtggctcattaaaccctatataactaacagcttttaaggacattaacagaaatatatcttcagatggataaataagatagggacctattcaagacagcagcatttttgtattgtgatacctcccctaagttactctcacaataaaaccttatttgagaattttccttcacttcaatctgtgacatagcattaggcatttagtataccttatttgtgaaacctaaggttcattcaacagatgaagctgcaaaacagttttcttggtagactcttggaacttgctcagttttttccttactttacctgcatgacacacattgggttgaaagttgtttggttttacccttcatttctcttagatatgatttggttctttttcatgcattatatttttgaaatatatggaggaaatattttattgaatcaagaaatagaaaatattccttaaaccagtagtaaaaaggtgagttagaactccatgtctggaagacaattcaacatttaaaatattaagatgctataccacttaacaagtgaatactaaaatttttaatttaaagattgattgttctgtttttatgaccatgagaaaaatgtgacagcttcagctgtcatatgtttatcttgaatgcttttctaattatgtatttctggattattgactttgaatgccacagaccaactactttacatagagtaaaatattgattaacctttgtgctttgggtcactggcaaaagttgaacatcctgataagtcaatgttaaccagaaacctttttgttcacgtctgaaattgaatatttataaaatgtgttagtatgtttcctgccttgataagttcacctatattgaatgtaatttgatctttgataattttttttaatcttgagaattctctgatactgttttgaataccagtgttcaccatgttataaagttaaacataaaaattgaaataaattgaactaaatat

SEQ ID NO: 4082 - DNA, 3175 bp, Homo sapiens
atctagagccggctgccctctaaaaatccccctgttacagtcgggatagaaaacaaaaagcttaatttaccaggaggctaaacagattgtgccttcttaggcaaatgttccacctgcttggccaattagcttcctctcccgaaagactcgttcaacaggtttcctttttctcttctctgcctcctgggttggggaaagaggctgtcacttcgcttcgaccctccccttccctccctctcggcttttccacagtgggtcggaccaatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtgaggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaacactgtgttttgtcagttcgtaaattcctttaaccaagacttaactatgctttttaactctttttccacctgccatctactactaccaactcacttatacttccttcctcccaagtaatcatttcaaaactaaaaaaggatttaagttcttgggttacaacggtttaaaggaaagaaaatgaactttgaagtcaaaaaaaaaagaaaaaa

SEQ ID NO: 4083 - DNA, 2977 bp, Homo sapiens
ctgttacagtcgggatagaaaacaaaaagcttaatttaccaggaggctaaacagattgtgccttcttaggcaaatgttccacctgcttggccaattagcttcctctcccgaaagactcgttcaacaggtttcctttttctcttctctgcctcctgggttggggaaagaggctgtcacttcgcttcgaccctccccttccctccctctcggcttttccacagtgggtcggaccaatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatgcccatatcttctctccaaatctatgcttcattcaggaccaagagtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtgaggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaa

SEQ ID NO: 4084 - DNA, 1402 bp, Homo sapiens
gcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatgcccatatcttctctccaaatctatgcttcattcaggaccaagatacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagtagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgagcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcg

SEQ ID NO: 4085 - DNA, 1210 bp, Homo sapiens
aataagcgcacaatggtgaagaaaaggctgccttctagtgacacggtgttccggtttgagactccgggcagcccaaggaaggccaacgtggaggcctcacgcagctccacagacagccccagctcggtgttcctcagctacctctctctgaatgtctaaagtgaagcggtttcctttcttcttcagctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattag

SEQ ID NO: 4086 - DNA, 2822 bp, Homo sapiens
ctgttacagtcgggatagaaaacaaaaagcttaatttaccaggaggctaaacagattgtgccttcttaggcaaatgttccacctgcttggccaattagcttcctctcccgaaagactcgttcaacaggtttcctttttctcttctctgcctcctgggttggggaaagaggctgtcacttcgcttcgaccctccccttccctccctctcggcttttccacagtgggtcggaccaatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatgtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtgaggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaa

SEQ ID NO: 4087 - DNA, 1577 bp, Homo sapiens
agagctgggcagcacagacctgggagccagcaagtccacacagtctggcatttacaagtgaaacagctacctctctctgaatgtctaaagtgaagcggtttcctttcttcttcagctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtgaggagggaaataattttggttcttgtgcaataaaagttgaccttgactctctgaggaagattttgctgcttttgcctgaagaaaacagaccc

SEQ ID NO: 4088 - DNA, 2196 bp, Homo sapiens
tctcacacatgtgggtttcaagtgcggctggtgccatccctctgagcagacgctgaaagagaaaacttctgagatagcacttgtgagcgaaaagcacaccaactggctcaaagagctgtggttgggcagatctggtgtaaatacaaagttccttcccgacatttcccagagtttcttgaagatcacctggcctctagaagatgacaaggagacagcaagtcctacaagcaaaaaggagcattcagcaaacattccaagcacagcttatgccctggaagagtatgttccacgggagagaagtgaagccagtgggtccggacctggaactctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtgaggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgta

SEQ ID NO: 4089 - DNA, 4718 bp, Homo sapiens
cccagctggaggaagcggcggcggcggccacgatgagtgcgggcgacgcagtgtgcaccggctggctcgttaagtcgccccccgagaggaagctacagcgctacgcctggcgcaagcgctggtttgtcctccggcgaggccgcatgagcggcaaccccgatgtcttggagtactacaggaacaagcactccagcaagcccatccgggtgatagacctcagcgagtgtgcagtgtggaagcatgtgggccccagctttgttcggaaggaatttcagaataatttcgtgttcattgtcaagactacttcccgtacattctacctggtggccaaaactgagcaagaaatgcaggtgtgggtgcacagcatcagtcaggtctgcaaccttggccacctggaggatggtgcagattccatggagagcctctcttacacgccctcctccctgcagccatcctctgccagctcccttcttaccgcccatgctgccagctcctctttgccaagagatgacccaaacactaatgccgtagccactgaggaaaccagaagtgagtcagagcttctcttccttccagattatctggttttgtccaactgcgagactggaagactgcaccataccagtctacccaccagatgtgatagctggtcaaactcagaccgttcattggaacaggcttcatttgatgatgtttttgttgactgcctgcagccgctcccctccagtcatttggtccacccctcatgccatggcagtggagctcaggaggtgccatcctcgaggcctcaggctgccctgatctggagtagagaaatcaatgggccacccagggaccacttgtcttcttcaccattgctggaaagttccttaagttccaccattcaggtagataaaaatcaaggttccttaccctgtggagcaaaagaactagacattatgtccaacactccacctccccgcccccctaagccaagccatctgtctgaacggcgccaagaggagtggagtacacacagtggtagcaagaagccagaatgcactctggttccaagaagaatctccctctctggtttagacaacatgagaacctggaaagctgatgtagaaggccaatccttaagacaccgagacaagcggcttagtttgaatttgccatgcaggttctccccgatgtaccccacagcttcagccagtatcgaagacagctatgtgcccatgagcccccaggctggtgcctctggtcttggaccccactgcagccctgatgactacattccaatgaactcaggaagcatctcaagcccgttgcctgagctgcctgcaaacctggaacctcccccagtgaatagagatctcaagcctcagaggaaatcacggccacctcctctggacctgagaaacctctcgatcatccgggaacatgcatctcttaccaggacccgcactgtgccttgcagtcgaaccagctttctctctccagaaagaaatggtattaattctgcaagattttttgctaatcctgtttccagagaagacgaagaaagctacatcgaaatggaggagcaccgaacagccagttccctgagcagtggtgcccttacgtggacaaagaaattcagcctagattatttggccctggacttcaattcagcatcaccagcccccatgcagcagaaacttctcctttcagaagaacaaagagtagactatgtccaagtggatgagcagaagacacaggctctccagagcacaaaacaggagtggacggatgaaaggcaatccaaagtatgagaggtgcgggcttgtgccatgtgtgaaacagggaagcttggggctcagtttgagttttttcttttttttttttttttgtccactaaaaacacactgatggtcaacacaggtcaaaaccaagagagaatgtgtagttttcaaggtcttggccagaacctttaggaaagaagacctgtttatacattgaaggaagaaaagaaggaagcagttgccttccggagggggctctgagagaatctagcctcccctctgtcctattggagcaaagattggagtgagtgttgccaccaacaggattttatcgtttgactccaatacctgaaattctgacttctctcctgtgcttcaatgagaatgataaattatcctagcaaaggggcctctggagaccatcttgttccagcctctgaagacagttgaggagatcaagcccagcaatggtggcagaatcttactccacagacttcagcagactagtcatttcaatacccaaagaaagacaagtgacaggggcaatggatctcaggctctgagataagtatatcagatgacactggtggctctaaggatattgcaattaagcagctacctgtagccaggtattctgctgctcttggccttttcccacgcatcgtctcgtgtcttctccgaaagaccttggaagataggcctggaagagactgttgatgccactttgaagaaaagaacactgagaactagaggagggaacactttgcccaagattactcacaaagccaagacccagagtccagcttagagaatagagttgttcaggctgccaattgcaagctcattcctctacctcatacttcctctgaggattttgacaaaatggattaattgggtgagccttggagacatgtgggaaacacctgcagacacaaaatgagtagtcatcctgtctccctttcaatagggatctgaacaggtgttttgatacttgaaagatgtgcatgtcaagtgagggtttctttctgcgatgttcaactggaactctcccatcagtagttacaattagaaatacctactgatggttagtctgaaggccattctcatggtcacctatacagtgtgtttccctgtgagctagcagacacaatgaccaggaaaaaacctatgaattccattcttaggtttcccagccaattgctcccttctgctttagaagtgactaggtactgagagtacaaacactcccactttataatgaaggcgtcatgtcaccccttcctttacaggtcctggggtccaggagacccagaatgaaggtgtcagttgggcatgaagtgttatttagtgtccattcttgatccttctgagcacctacagctggaaactaagcagatactggtcctgcattctgactgagattgtgtcttctttatgaggatagatcaaattggcagtcaggcccatgatagtcagtgcagttggggcagttgtagactttgctacaggatttcagggtttccaatcaccccacaggtaagtgaatgccaaagtcttcttttttcagaccatacaagaagtcattttgattttcaaagaagccgttttgattttcaaagaagcaggttctggtgacattattttcttccttggacaaagtggggggaaatttctaagtattttaactgagttcagggtccttagtgagcctggacagagcaaggagagggctccccactccctaagccccacagccagctctgcatcaccacacacagccagagcctgtgaggagctgccttcttccccatgtgacttgcaaagagtctcaggcaagaaaccagggcttcaaactgctagttcccatggagggtagttccctcgtgtggagcacttgtgttaggatcactgattatctgacaaaggctggtgcagaaaaaaaattgtaggcccaagtgtcaagaaccacaccagattggagatagaaaagaatagctgaaattatgtcagtggtgaaatgtcactccattgacccaccgaaaaaagaaaagaaatctgtttctaccaaacatttccagaaacgtatttatagcatgaagaaacacacatgggtagtgtgacctgtttggatgtgattacttaaaaatggaatgctctgaataggcactctctacattaaaggtatggaaggcgataggggtcagaattttaaaaatttaattttgaaaaaggtgactcacccctcatttccagagtgtaggcaattatgtcctgctttgataaaactgctagaggatggctatgcaaaagcataacgattcaaggaaacaaagtacaggtagtttttgagctgacagcagcaaaggcaccataagtcaaaatattggttttggtggagatgatcgatgtgtgtgtgtgagagagagctatgtttctaaccaagggcctaatgtttgttacagaaatgatcccagagacctacaagatgtgggaatcagcataacagggcaatgcagcaattaaccccacatcgttttctgtagttcctttttgtttcattttcttctgtctcacctcgttagaaaattcctcccagtcaggggtcgtccagtgcaggacgggggacccaagggtctcaagcctgcaagtccagaaggtgacaaacccaggagcactgggagttaagctttccttggggagggaagagccttgatgtccagcacacagcctggctataaagacacgaagcgacctacccactgtacagtccacttcacaggatcagctgaatcatgacctttaaaagttccgagttgaaactgaaggctctcctcagacctggctttttcctcagtccctgttcataccatctctgcacccacaatcacactgatttttcaaattcattttgtttttgctgtttcatttctggcattaataaaagtcttataagga

SEQ ID NO: 4090 - DNA, 2028 bp, Homo sapiens
cttctgccgcgggcggctggcccagctggaggaagcggcggcggcggccacgatgagtgcgggcgacgcagtgtgcaccggctggctcgttaagtcgccccccgagaggaagctacagcgctacgcctggcgcaagcgctggtttgtcctccggcgaggccgcatgagcggcaaccccgatgtcttggagtactacaggaacaagcactccagcaagcccatccgggtgatagacctcagcgagtgtgcagtgtggaagcatgtgggccccagctttgttcggaaggaatttcagaataatttcgtgttcattgtcaagactacttcccgtacattctacctggtggccaaaactgagcaagaaatgcaggtgtgggtgcacagcatcagtcaggtctgcaaccttggccacctggaggatggtgcagcagattccatggagagcctctcttacacgccctcctccctgcagccatcctctgccagctcccttcttaccgcccatgctgccagctcctctttgccaagagatgacccaaacactaatgccgtagccactgaggaaaccagaagtgagtcagagcttctcttccttccagattatctggttttgtccaactgcgagactggaagactgcaccataccagtctacccaccagatgtgatagctggtcaaactcagaccgttcattggaacaggcttcatttgatgatgtttttgttgactgcctgcagccgctcccctccagtcatttggtccacccctcatgccatggcagtggagctcaggaggtgccatcctcgaggcctcaggctgccctgatctggagtagagaaatcaatgggccacccagggaccacttgtcttcttcaccattgctggaaagttccttaagttccaccattcaggtagataaaaatcaaggttccttaccctgtggagcaaaagaactagacattatgtccaacactccacctccccgcccccctaagccaagccatctgtctgaacggcgccaagaggagtggagtacacacagtggtagcaagaagccagaatgcactctggttccaagaagaatctccctctctggtttagacaacatgagaacctggaaagctgatgtagaaggccaatccttaagacaccgagacaagcggcttagtttgaatttgccatgcaggttctccccgatgtaccccacagcttcagccagtatcgaagacagctatgtgcccatgagcccccaggctggtgcctctggtcttggaccccactgcagccctgatgactacattccaatgaactcaggaagcatctcaagcccgttgcctgagctgcctgcaaacctggaacctcccccagtgaatagagatctcaagcctcagaggaaatcacggccacctcctctggacctgagaaacctctcgatcatccgggaacatgcatctcttaccaggacccgcactgtgccttgcagtcgaaccagctttctctctccagaaagaaatggtattaattctgcaagattttttgctaatcctgtttccagagaagacgaagaaagctacatcgaaatggaggagcaccgaacagccagttccctgagcagtggtgcccttacgtggacaaagaaattcagcctagattatttggccctggacttcaattcagcatcaccagcccccatgcagcagaaacttctcctttcagaagaacaaagagtagactatgtccaagtggatgagcagaagacacaggctctccagagcacaaaacaggagtggacggatgaaaggcaatccaaagtatgagaggtgcgggcttgtgccatgtgtgaaacagggaagcttggggctcagtttgagttttttcttttttttttttttttgtccactaaaaacacactgatggtcaacacaggtcaaaaccaagagagaatgtgtagttttcaaggtcttggccagaacctttaggaaagaagacctgtttatacattgaaggaagaaaagaaggaagcagttgc

SEQ ID NO: 4091 - DNA, 2630 bp, Homo sapiens
gctttctaccccgcagtcccagggtatcgcaagccgtccctcacaccccacctccagcaacgccctctcgccctgtctcccccaccttcactgtgagctgcagcccccatgtccctgccgtccccctcaccctcccgggagctgtgcccacctgacccggcatttgcgcctttgtcttcgtggcccggaagtggccccgccggcggaagcacgagaagtggccacgtgctgtacagcggctggctgaggaagtcgccccccgagaagaagctgaggctctttgcctggaggaaacgctggtttatcctgcggaggggccagactagcagtgacccagatgttctggaatactacaagaatgatggctccaagaagcccctgcgcaccatcaacctgaacctctgtgagcagctggatgttgatgtgactctgaacttcaacaagaaggagattcagaagggctatatgtttgacatcaagaccagtgagcgtaccttttacctggtggctgagaccagggaggacatgaatgagtgggtccagagcatctgtcagatctgtggcttcaggcaggaggaaagcacaggcttcctgggaaacatttcctcagccagtcacggcctctgctcttctccagctgagcccagctgctcccatcagcacctcccccaagaacaagaacccacatctgagcccccggtgtctcactgtgtgccgcccacctggcccatccctgcacctccggggtgtctccgctcgcaccagcacgccagccagagagcagaacatgcaaggagtgccagcttctcccagggttctgaggccccattcatcatgaggagaaacacagccatgcaaaatcttgcccagcacagtggatacagtgttgatggggtcagcggtcacatccatggcttccatagcctttccaagcccagccagcacaatgcagaattcagaggcagcacccacagaatcccctggagcctggcctcccatggccacaccagaggcagcctcacaggctctgaggcggataatgaggcttcctccggcaagtacacccagcatggtggagggaatgccagccggcctgctgagtccatgcatgagggagtctgttctttcctgccaggaagaacgcttgtgggcctgtcagacagcattgcttctgagggcagctgtgtgcccatgaacccaggctcccctaccctgccggctgtgaagcaagcaggcgatgattcccagggtgtctgcatccctgtgggctcatgtcttgttcgctttgacctgcttggctccccactcacagagctttctatgcaccaagacctcagccagggacatgaggtccagctgccccctgtcaaccgcagcctcaagcctaaccagaaggccaacccaacaccgcccaacctgagaaacaacagggtcatcaatgagctctccttcaagccacctgtcacagagccctggtctgggaccagccacacctttgactccagctcctcccaacaccccatctccacgcagagcatcaccaacacagactcagaagacagtggagagaggtatcttttcccgaacccggcatctgcatttcctgtttccggtggcaccagcagttcagccccgccgaggagcactggtaacatccactacgcggccctggacttccagccgagcaagccatccataggctctgtcacgtccggcaagaaggtggactatgtccaggtggatctggagaagacccaggccctgcagaagaccatgcatgaacagatgtgcctgcggcagtcctcagagcctcccaggggcgccaagctgtgactcgggccaccaaaaccagagtggggccaggacagtgcctcagagctgctccgccacactctaaagctctgtaatatcagggaccgcatcccttacatagagagcagaggcctgatcaatatacatcctttgcctgcttggggcccacctgtgcctttggctggccatggtccccaccttcacccccttgctaggagcagttgccagcaagcatcctcagtctcttcctgcccctcagacccgggctcccaacagatttccactctcacacttactcatggtcctcagcctcttccttctagcctctgggctgtttccctcaatcctggaacatgaggagctaccttgctgacccggggacccaaggcccacaggccacagtggacatggaccttttcagccctggcattttttggtcaggggagaggcaaggccatcaaacgttggaatagttgagaaggaaggttaaaggtggtcttgagaagcaaaggaattagatccttagaccagcagggcagctgatacctgcaagggctcccactttcagactgaggccagagtatggcagctgctcccgggtgggagaggcagagagggaagggcaaaaggaagggaaaacatgaagacgaacagccgaaagccacaagaagcagggctggagctccagagactggggtgacaaggaccagggtcagggccccagaaatccggagctgcaggctggctctgctgctctttgctgatgccccttggggggcccttgcctgcctaagaaggcttgatctgagctgggcaaa

SEQ ID NO: 4092 - DNA, 967 bp, Homo sapiens
cctgtttctcccccatcaggagcagtttcagtctcaacttcaaaagaacaaacgcgcactcaaaacaaaggaagaccgtcctcgactgcagaggaagcaggaagctgtcggcccagctctgagcccagctgctggagccccgagcagcggcatggagtccgtggccctgtacagctttcaggctacagagagcgacgagctggccttcaacaagggagacacactcaagatcctgaacatggaggatgaccagaactggtacaaggccgagctccggggtgtcgagggatttattcccaagaactacatccgcgtcaagccccatccgtggtactcgggcaggatttcccggcagctggccgaagagattctgatgaagcggaaccatctgggagccttcctgatccgggagagtgagagctccccaggggagttctctgtgtctgtgaataacagagcccagaggggtccctgcctgggcccaaaatcacacagcagattggggtagagccggagaggacccgagactcctgtgccagcctgggcatcccctccactgccagggaaggactgcatccaagtcgcatccgtacccaggccgaggtgtccgaggcccaggctgaaatccggttgctgctgcagagaccaagtttccaaggccttgtcaagtgggctgtgccagacgatccccaggcctgtcattggctgctcttcggctcggacacaccaaacctcaccaagcacttccatttctgagggaatagaggttgtggcttccgtcaagcacccatttaccccaccctcctcctcctcttcctgcaaacttgagtcacagctgccctgctgggctcaggccccagggatgtctgagtcagcctggctggggttccagtcctgacaccgcccttaccagctgggagactccgggaacctccaaccctgctgagcctccacttcgacatccgtg

SEQ ID NO: 4093 - DNA, 834 bp, Homo sapiens
gtctcagaccaaaggcccccttatctgctccccagagcctgacgtccccccactgaattgtcacccctgagctgtctaaatgcgagggaccctaggtgaccactggtggctgtgctcaggccgggtcccccgaccttcaccccaaggctcagtgcgtggcatatcctgaacatggaggatgaccagaactggtacaaggccgagctccggggtgtcgagggatttattcccaagaactacatccgcgtcaagccccatccgtggtactcgggcaggatttcccggcagctggccgaagagattctgatgaagcggaaccatctgggagccttcctgatccgggagagtgagagctccccaggggagttctctgtgtctgtgaactatggagaccaggtgcagcacttcaaggtgctgcgtgaggcctcggggaagtacttcctgtgggaggagaagttcaactccctcaacgagctggtcgacttctaccgcaccaccaccatcgccaagaagcggcagatcttcctgcgcgacgaggagcccttgctcaagtcacctggggcctgctttgcccaggcccagtttgacttctcagcccaggacccctcgcagctcagcttccgccgtggcgacatcattgaggtcctggagcgcccagacccccactggtggcggggccggtcctgcgggcgcgttggcttcttcccacggagttacgtgcagcccgtgcacctgtgagcagcccggcggccgatctggccaacgggcctttttacaggaactgaggtccagagaggacatggacacccccagctctgtcagagtcacacgggg

SEQ ID NO: 4094 - DNA, 1073 bp, Homo sapiens
aaaaggaaatttctgaaaatggttcatattttgtggtggtgacattacaggaggtgtcctagccttctgaggctgtagcctatctgactagtctcatggatcaaatctattgtgatttttatcccccttaaggaaaatatttagtgatttgagaaggaatataaataggtcagtgtctccttctgttacagttgcctgctttcaatcctaacaaggactgatcctgcctgggagaaacaaaaataatcttgggggaaatatttaatccataattatttaatccactgcaaacctgttttcaattcacaggtgatgttgttgagagagataacatattcaatcactcctctctctttacatggaacttcccttctaaactgcaattggagagctacaggtctggtaacattggaagggcacaggcctttccaatgacattccccatcccacccccaggtttcctgcagttgttgtcagagtacaaaccttcttccacactttatacaagtgtttagacacttcgccagcagccttggttttcagagagaaaaataaaataaaaacagcacttaattaaaatggagcgtgaaacccagaaggaatcatggtgtgtgagtgcttagagtgttacagttcccacccattgtttggaatttgcatcttaattcaatataaagcctgacaataggtacagcaaagagacgaatcaagacttgggtctcacagaagttacctggtgccaacatcccatgcaccatcgtggagactggctggatgccctgtgctctatcagggcatgtcagaccaacagaggggcaaatcagagtgaagaggaagccagaagatgggagagacatttttgaaggaacaagctgccaataatgtctgcaaaaagtgaattcttccaacaactacgtgagcttggaagaggaccttgaacctagaatgagactgcagcagccccagccaacacccttctcagcttcgtggaccctgagcagagaacacagcaaatttgtccagacttctcatctacagaaactgagataataaatgattgttgttttaacatc

SEQ ID NO: 4095 - DNA, 1294 bp, Homo sapiens
gcgtctggatggtgctgagtggggcccaggcgcagatggaccagaatcccggctactaccaccagcttctccagggagagagaaaccccaggctggaggacgccatcaggacagacctgaaccggaccttccccgacaacgtgaagttccggaagaccacggacccctgcttacagaggaccctgtacaatgtgctgctggcatatgggcaccataaccagggagtgggctactgccagggaatgaattttatagcaggatatctgattcttataacaaataatgaagaagaatctttttggctgttagatgctcttgttggaagaatactaccagattactacagcccggccatgctgggcctgaagaccgaccaggaggtcctcggggagctggtgcgggcgaagctgccggctgtgggggccctgatggagcgtctcggtgtgctgtggacgctgctggtgtcccgctggttcatctgcctgtttgtggacatcttgcccgtggagacagtgcttcggatctgggactgtttgtttaacgaaggctcgaagattatcttccgggtggccctgaccttaattaagcagcaccaggagttgattttggaagccaccagcgttccagacatttgcgataagtttaagcagataaccaaagggagtttcgtgatggagtgtcacacgtttatgcaggtgtgtggggctgcacgtggctcagtcccctcccagggggccccgcctcacctgcagcccgggggctgctctgaccacccggagggtgcacaggacgggcaccagtgggcatagggcacaggatgagcctccagctctgtcctgcatctgccccctgcgcctggcctccgagggctttcctgtctatggcggccctgtcttcttggccctggcactgcggacgctgctcctggtcctaatggctgtactcatctgctgtgtgtggtgccagaagtgtggcttcccgaggcccggcctccccactgggtcctggacctggcgcaggccgtatagactcaggtcctgatgagggcgttgtgggagctgtacctgacaggccttctgaggaagccaagacgccaggagaggctcaggcctgggagtcagtagtttcctaagagggagtggaggctcggggccactctgggtgcagcatggcaaacgtgggcggtatttcagcagctgggccttcatcaaagagaagaccatgttggccgggcgcggtggctcacgcctgcagtcccagcactttgggaggccaaggcgtgtggatcacctga

SEQ ID NO: 4096 - DNA, 1446 bp, Homo sapiens
gaacttgggacccgctggcctcgctcggtgcgcgcctccctccccgcatgcagcccgccgagcgctcgcgggtccccaggatcgacccgtacggattcgagcggcctgaggacttcgacgacgccgcctacgagaagtttttctccagctacctggtcacgctcacccgcagggcgatcaaatggtcccggctgctgcagggcgggggcgtccccaggagccggacagtgaagcgctatgtccggaaaggggtcccgctggagcaccgtgcccgcgtctggatggtgctgagtggggcccaggcgcagatggaccagaatcccggctactaccaccagcttctccagggagagagaaaccccaggctggaggacgccatcaggacagacctgaaccggaccttccccgacaacgtgaagttccggaagaccacggacccctgcttacagaggaccctgtacaatgtgctgctggcatatgggcaccataaccagggagtgggctactgccagggaatgaattttatagcaggatatctgattcttataacaaataatgaagaagaatctttttggctgttagatgctcttgttggaagaatactaccagattactacagcccggccatgctgggcctgaagaccgaccaggaggtcctcggggagctggtgcgggcgaagctgccggctgtgggggccctgatggagcgtctcggtgtgctgtggacgctgctggtgtcccgctggttcatctgcctgtttgtggacatcttgcccgtggagacagtgcttcggatctgggactgtttgtttaacgaaggctcgaagattatcttccgggtggccctgaccttaattaagcagcaccaggagttgattttggaagccaccagcgttccagacatttgcgataagtttaagcagataaccaaagggagtttcgtgatggagtgtcacacgtttatgcaggtgtgtggggctgcacgtggctcagtcccctcccagggggccccgcctcacctgcagcccgggggctgctctgaccacccggagggtgcacaggacgggcaccagtgggcatagggcacaggatgagcctccagctctgtcctgcatctgccccctgcgcctggcctccgagggctttcctgtctatggcggccctgtcttcttggccctggcactgcggacgctgctcctggtcctaatggctgtactcatctgctgtgtgtggtgccagaagtgtggcttcccgaggcccggcctccccactgggtcctggacctggcgcaggccgtatagactcaggtcctgatgagggcgttgtgggagctgtacctgacaggccttctgaggaagccaagacgccaggagaggctcaggcctgggagtcagtagtttcctaagagggagtggaggctcggggccactctgggtgcagcatggc

SEQ ID NO: 4097 - DNA, 1345 bp, Homo sapiens
ggacttaagcgccccggagccgggaggcgaacttgggacccgctggcctcgctcggtgcgcgcctccctccccgcatgcagcccgccgagcgctcgcgggtccccaggatcgacccgtacggattcgagcggcctgaggacttcgacgacgccgcctacgagaagtttttctccagctacctggtcacgctcacccgcagggcgatcaaatggtcccggctgctgcagggcgggggcgtccccaggagccggacagtgaagcgctatgtccggaaaggggtcccgctggagcaccgtgcccgcgtctggatggtgctgagtggggcccaggcgcagatggaccagaatcccggctactaccaccagcttctccagggagagagaaaccccaggctggaggacgccatcaggacagacctgaaccggaccttccccgacaacgtgaagttccggaagaccacggacccctgcttacagaggaccctgtacaatgtgctgctggcatatgggcaccataaccagggagtgggctactgccagggaatgaattttatagcaggatatctgattcttataacaaataatgaagaagaatctttttggctgttagatgctcttgttggaagaatactaccagattactacagcccggccatgctgggcctgaagaccgaccaggaggtcctcggggagctggtgcgggcgaagctgccggctgtgggggccctgatggagcgtctcggtgtgctgtggacgctgctggtgtcccgctggttcatctgcctgtttgtggacatcttgcccgtggagacagtgcttcggatctgggactgtttgtttaacgaaggctcgaagattatcttccgggtggccctgaccttaattaagcagcaccaggagttgattttggaagccaccagcgttccagacatttgcgataagtttaagcagataaccaaagggagtttcgtgatggagtgtcacacgtttatgcagaaaatattttcagaacctggaagcttatccatggccaccgtcgccaagctccgcgagagctgcagggcccggctgctggcacaggggtgagcgtgcctgtcccctgcgttgctcgtctctacactgacgatgcccctttccagagttgacactggaccaactttcactgctttcctttttagtgttgtaaatacttgacatcactacactttagttgtgaattttttaaaagagcagtttaaaatcaggtcattctaccagcttttgatgattagctatgaagtcatactttttaaagaaaacttatttttacctgagagatcaataatatataaaatgtgagtgtggg

SEQ ID NO: 4098 - DNA, 7495 bp, Homo sapiens
tcctcggcggcgacagcagcaggtgtttcttggccggggccccggaagctccacctccccagcgggcccgagctgccgccgccgagcagccccgggtgagataagcagtttagacaaacactgggcgacggtggctccagcatgtatcagccgaggtggagctgcggggccctggcatgaaaggcatgagccatgagcccaagtccccttcgctagggatgctttccaccgcgaccaggaccaccgccaccgtcaaccccctcaccccctcgccgctcaatggcgccctggtgcccagcggcagccccgccaccagcagcgcgctgtcggcccaggccgcgccatcctccagctttgccgccgcgctgcgcaagctcgccaaacaggcggaggagcccagagggtcctcactgagcagcgagtcgtcccccgtgtcctctccggccaccaaccacagctcccccgccagcacacccaagcgcgtgcccatgggccctatcatcgtcccccctgggggccacagcgtgcccagcaccccccccgtggtgaccatcgctccaaccaaaaccgtgaatggtgtctggaggagtgagagccggcaggatgccggctccaggagcagcagtggaggtcgggaacgcctcattgtggagcccccgctccctcaggagaaggcagggggaccagccatcccctcgcacctgctcagcaccccctaccccttcggcctctcccccagctcagttgtgcaggattcccgcttcccgccactcaacctccagcggcccgtgcaccacgtggtgccccccagtaccgtgaccgaggactacctgagaagcttccggccctaccacaccaccgacgacctccgcatgtcctcactgcctcccctcggcctggacccggccactgctgcagcctactaccaccccagctacctggccccacaccccttcccccacccggccttcaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcagagaagctgaaggatgccggcctgcaggcgcccaagcccgtccaacaccccttgcatccggtgcccaccccacaccacacggtgcccagcctcatctccaaccatggcatcttctctctgcctagcagcagtgctgccacagccctgctgatccagcgcaccaatgaggaggagaagtggctggcgcggcagcggcggctgcggcaggagaaggaggaccggcagtctcaggtgtccgagttccggcagcaggtgctggagcagcacctggatatgggccggcccccggtgccggcggaggcagagcacaggccggagagcaccaccaggccaggaccaaaccgtcacgagccaggtggccgtgaccctccgcagcactttggggggccaccacctctgatttcgcccaagccccagctccatgctgcacccacggccctctggaaccccgtgtccctgatggacaacaccttggagacgcggcgggccgaaagccactctctgcacagccacccggctgcatttgagcccagccgccaggcagccgtgccgctggtgaaggtggagcgggtcttctgcccggagaaagcagaggaggggccacggaagcgtgagcctgcccctctggacaagtaccagccacctccgccgccaccacgagagggagggagcctggagcaccagcccttcctgcccgggcccgggcccttcctggctgagctcgagaagtccacccagaccatcctgggccagcagcgggcctccctcccacaggcggccaccttcggggagctcagcggacccctgaagcctggctcgccctaccggcccccagtgccacgggcccccgaccctgcctacatctatgatgagttcctgcagcagcgccggaggctggtcagcaagctggacctggaggagcgcaggcggcgggaggcccaggagaaagggtactactacgacctcgatgactcttacgacgagagcgatgaggaggaggtcagggcccacctccgttgcgtggccgagcagccgcccctcaaactggacacgtcctctgagaagctagagtttttgcaactttttggcttgaccacccaacagcagaaggaggaattggtggcccagaagcggaggaagcggcggaggatgctgcgagagagaagcccgtcgcccccaacaattcagagcaagcggcagacgccttcaccgagactggcgctgtctacccgctacagccctgatgagatgaacaacagtcccaacttcgaagaaaagaagaagttcctgaccatcttcaacctgacccacatcagcgctgagaagaggaaagacaaagagagacttgttgaaatgctccgtgccatgaagcagaaggcactgtcagcagcagtggccgactccttgacaaactctccgagggacagtcctgccgtctccctgagtgaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggaggatgatgaagatggagaagatgaggaggaagtccccaagcgcaagtggcaagggatcgaggccgtttttgaagcttaccaggaacacatagaagagcaaaatctggagcggcaggtgttacagacacaatgtagacgactggaggcccggcactacagcctcagcctgacggcagagcagctctcccacagcgtggcggagttgaggagccagaaacagaagatggtctcagaaagggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttttgtatgtttttattactttaactattgttataaaaagcctgccatttttaatatgtggtttgggggatttttgtttgtttttcctgtttgggggttttgtttgttgttttggttttttttgggcaaaaaaaaaaaaaaaaccttgcttttagtgtttgtactgctgctggtcaggacattaaaatattgaagtgtttttaaaaattaaagaagaagaaaagtaaaagagcttaccactggcgcctatgcgatcacttcatttttagtttgagttgcaccagaagctgccgtagaaagccatgcgctactgcttacctcctccactccccctgcctgcccccagcatctggacaagctaatagcaaatattacccattgctatcaagggaggagggggtagtctgtagaacccatgtgtgacagtcatgtgcacacatgggcgggggcttttaaaaacctttcaggaagtcaatgatttctgtgattgatataattctaaggtgtctgagagcaggtacagaataggaacttcagaggctttgtttaaacgcaaagctttgtaaaagccacaaggtctgagctgaacccctcctttttgaacttactgtgacaagcacaggaacggtcagaaactgggctcatcacaccaaggcaaagcaacgggcgagtcttcctccttgtcctagttactgcctatggaggcagtgtttagatcaagaaggcctctcttgctcccaagggccctcaccagaggccagggctgccagtcactggtctggggggtggaggcctgagctgagggcagggtgcctgacctgtgtgccggctgctcactgctgtgaccagcagccgagcccttggccctagcccttgctgcgcagaacagcttgctggcagctggcatcgtgtcgctttatctgcccccgcacagtttgctttgtacgtctgccaagaatcttccagttattagcaaactcagacgaatgtaccgccagtattatcagcagtcaacaagcaccttcctctccacagaagcagctggaagagaactcgaggggctgtgctgcaggcctcccctcgaaagacactgggaggtcagcatgttccacaggtgttcagagggagtctgctacaaactatcagggcaaaatctcactggatttctccactgaaaacctacttgaggtttctggtctgaaggcttaagagtcacatcttagcacttccgctctcaggcctcctcctccatcacagatgtctggatgcttttggaaatggccttggctaaagtaaaagggaaaagtagatccgataacttaaaaacgtagctcatcccttaccatccaaggggcactcccttggttggattttctatgacagcacaggggacaggtggcacaccatgagaggtctgcccagggtgggagcagtgtcactgtgctagcaatagttggcttctcccctgtcagtggaaaccccacttctgcccggcccttgagcttcttgcccactgtctccccatccttccacctacttgtggcgatctgagtactctactcttgctcaagaagtaatacgacaatcagaatacaaaccagtaaggcaacacgaataaactaagaaaaaggtaagaactgtctcaaaaacgaaagcacaccacccaagacacagtacccagtcatggtttccccatccaactattagtttcatactttgaaaacttactttcagattattctcaaagaacacagtagcacctaaatctgttttcaattgggcttaaaaattgacatgcaatctcttaagttttttgttcagctacttcacactgagtacctcaaatctgctctggagtcgattatgccacctgtgtgtcaggatgcacctgaaagccctcggctcggtccttagaccatcttcctacattacctggaagggagctgccatctgtccctctgcagagggataccttccaatagtaaattatctggttcctcactgaaacaagttatttttgcttcatatagtcagagtcagactgacatgataaaatatcatgttcctaatctgttgtctcagataagtgaccaagacgggactttccacattttagtctacattctaatcttaaaggaataaagcactgaattgggactaacattctgataggttgcacccttaagagtattcagagagcatcaaaaggagcccacaccttcagcagtgaaggattctaacacagggaatctgcagtttgtagcagaatggtattttcctcaagtagctcataatactgccaaatctcaaaagttaagctgaatttcacaccagatcctacccctttccctgagccacatgtttcacacaagtgtagaaaatgccagggatccaccacaagatggagatggtcagcacaaaccgattctgttcctctttaaagtgtatattagccacttagcaatctctatattctttcaagtaaccaagctgttgactttcttactacttgcagtagcctgtccccaacttttccatccagtgcttaacctaaaaaactccttaactctgccttgacctgaggaagaccatgctaactggtgttattttgtatgtaccctgtgcttaattctataacagtaaaccccatacgcaggtgggagggaggaacaccggtgcctcggtcactctgggggcagtttagatgctgtgaaattaaacctgttctaagtgtacttgtttgaattaattgtattgtaatattatttgttgaatgtagtaattaggtatttatgaatatattgctgtaatttctgacaacatccaaaaaataaaatcttcctaaattatgtt

SEQ ID NO: 4099 - DNA, 4366 bp, Homo sapiens
accgtgtggtgcgtaaattatagcgtccggccaaggccgcaaggggggcgccgccggtgagctggcgggtcgtgcggggaagcagcacccccgcgccgtgccagggccggccagcgtccgcagggtcctcactgagcagcgagtcgtcccccgtgtcctctccggccaccaaccacagctcccccgccagcacacccaagcgcgtgcccatgggccctatcatcgtcccccctgggggccacagcgtgcccagcaccccccccgtggtgaccatcgctccaaccaaaaccgtgaatggtgtctggaggagtgagagccggcaggatgccggctccaggagcagcagtggaggtcgggaacgcctcattgtggagcccccgctccctcaggagaaggcagggggaccagccatcccctcgcacctgctcagcaccccctaccccttcggcctctcccccagctcagttgtgcaggattcccgcttcccgccactcaacctccagcggcccgtgcaccacgtggtgccccccagtaccgtgaccgaggactacctgagaagcttccggccctaccacaccaccgacgacctccgcatgtcctcactgcctcccctcggcctggacccggccactgctgcagcctactaccaccccagctacctggccccacaccccttcccccacccggccttcaggatggacgactcctactgcctgtctgccctgaggtccccgttctaccccatccccacccccggctccctgcccccactgcacccatcagcgatgcacctgcacctctctggggtccgctaccctcccgagctctcccactcatccctggcagcgctgcactcggagcgcatgtctggcctcagcgcggagaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcagagaagctgaaggatgccggcctgcaggcgcccaagcccgtccaacaccccttgcatccggtgcccaccccacaccacacggtgcccagcctcatctccaaccatggcatcttctctctgcctagcagcagtgctgccacagccctgctgatccagcgcaccaatgaggaggagaagtggctggcgcggcagcggcggctgcggcaggagaaggaggaccggcagtctcaggtgtccgagttccggcagcaggtgctggagcagcacctggatatgggccggcccccggtgccggcggaggcagagcacaggccggagagcaccaccaggccaggaccaaaccgtcacgagccaggtggccgtgaccctccgcagcactttggggggccaccacctctgatttcgcccaagccccagctccatgctgcacccacggccctctggaaccccgtgtccctgatggacaacaccttggagacgcggcgggccgaaagccactctctgcacagccacccggctgcatttgagcccagccgccaggcagccgtgccgctggtgaaggtggagcgggtcttctgcccggagaaagcagaggaggggccacggaagcgtgagcctgcccctctggacaagtaccagccacctccgccgccaccacgagagggagggagcctggagcaccagcccttcctgcccgggcccgggcccttcctggctgagctcgagaagtccacccagaccatcctgggccagcagcgggcctccctcccacaggcggccaccttcggggagctcagcggacccctgaagcctggctcgccctaccggcccccagtgccacgggcccccgaccctgcctacatctatgatgagttcctgcagcagcgccggaggctggtcagcaagctggacctggaggagcgcaggcggcgggaggcccaggagaaagggtactactacgacctcgatgactcttacgacgagagcgatgaggaggaggtcagggcccacctccgttgcgtggccgagcagccgcccctcaaactggacacgtcctctgagaagctagagtttttgcaactttttggcttgaccacccaacagcagaaggaggaattggtggcccagaagcggaggaagcggcggaggatgctgcgagagagaagcccgtcgcccccaacaattcagagcaagcggcagacgccttcaccgagactggcgctgtctacccgctacagccctgatgagatgaacaacagtcccaacttcgaagaaaagaagaagttcctgaccatcttcaacctgacccacatcagcgctgagaagaggaaagacaaagagagacttgttgaaatgctccgtgccatgaagcagaaggcactgtcagcagcagtggccgactccttgacaaactctccgagggacagtcctgccgtctccctgagtgaaccagccacgcagcaagcctctctggatgtggagaagccggttggtgttgctgcttccttgtctgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagcaccaatgggaagagcaagccgtgggagccctttgtggcagaagagtttgcacatcagttccacgagtcagtgctgcagtccacccagaaggccctgcagaagcataaagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggaggatgatgaagatggagaagatgaggaggaagtccccaagcgcaagtggcaagggatcgaggccgtttttgaagcttaccaggaacacatagaagagcaaaatctggagcggcaggtgttacagacacaatgtagacgactggaggcccggcactacagcctcagcctgacggcagagcagctctcccacagcgtggcggagttgaggagccagaaacagaagatggtctcagaaagggagcggctccaggcagaactggaccacttacgaaagtgccttgccttgcctgcaatgcactggcctaggggctacctgaagggatatcccaggtgacggtttcccttgcactaggccgaacctatagtatagaaatattatctattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaacttgatcattaacagccccctgtgcatatgagtggatcaaaccggttctgttctttcttgtgttgccatgttactatgcctcaagcccagtttgcttttgccgcagcgatggggccagtctcattcctccccaggagtgaaacttgcttcagctgaaaaggttgggtgcattgtcagtaaaaagggcttatttgtttcattttactttcctgcaaaattttcttcaaagcaacaagtcctaggagcacacaaagcaacccaaaggcttttccctggaaaagctctttcttacctaaagataaaaccaattcacaaactgaaggtagctttttattactccgtggggagcatgtacagagctctgtgtatacacagcttcacacccaccagattgttactacagtgggttgggttttcatacagacgtaaattttgagagaaaagtcaaaggtgcttcagccttgtactgtgtatatatattaaaaaaaaaacaaagttt

SEQ ID NO: 4100 - DNA, 3597 bp, Homo sapiens
ctcttacttaaaatatagcattaaataatgctggttatttttatgttgcatatttgggacaaagagctctcttaaatgaaagataattgcaagatccggttcagcagctttgtcccttgcctcaagtttactgcagggcttctctcctctctggttatacagaaatgaaattataaaccaccagtaaccttggaaatttcaatcgattccaaatgactaaatatttaattgaatcattgcctatacttccagggatgactctggcgtttgctttttattgagggctccatgaaagccaggctctgcaatggctgctggggactgtgtctgttgcaaggaggctcccctgcagtgaggagccggggcactgcaagtctgttccatagcagccctttttgcaaatggtagttgatttttgcagaaggtttgtggccagatcgctatgtataatactgatgaagcatttttgttccagctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaagggctggacgggctaccgtggcggtctggataccaaaaatgataccacagggatacattcagtttatactgtgtaccaagggcatgagatcatgtttcatgtttccaccatgttgccatattccaaagagaacaaacagcaggtggaaaggaaacgccacattggaaacgatatcgtcaccattgtgttccaagaaggagaggaatcttctcctgcctttaagccttccatgatccgctcccactttacacatatttttgccttagtgagatacaatcaacaaaatgacaattacaggctgaaaatattttcagaagagagcgtaccactctttggccctcccttgccaactccaccagtgtttacagaccaccaggaattcagggactttttgctagtgaaattaattaatggtgaaaaagccactttggaaaccccaacatttgcccagaaacgtcggcgtaccctggatatgttgattagatctttacaccaggatttgatgccagatttgcataagaacatgcttaatagacgatcttttagtgatgtcttaccagagtcacccaagtcagcgcggaagaaagaggaggcccgccaggcggagtttgttagaatagggcaggcactaaaactgaaatccattgtgagaggggatgctccatcaagcttggcagcttcagggatctgtaaaaaagagccgtgggagccccagtgtttctgcagtaatttccctcatgaagccgtgtgtgcagatccctggggccaggccttgctggtttccactgatgctggcgtcttgctagtggatgatgaccttccatcagtgcccgtgtttgacagaactctgccagtgaagcaaatgcatgtgcttgagaccctggaccttctggttctcagagcagacaaaggaaaagatgctcgcctctttgtcttcaggctaagtgctctgcaaaagggccttgaggggaagcaggctgggaagagcaggtctgactgcagagaaaacaagttggagaaaacaaaaggctgccacctgtatgctattaacactcaccacagcagagagctgaggattgtggttgcaattcggaataaactgcttctgatcacaagaaaacacaacaagccaagcggggtcaccagcacctcattgttatctcccctgtctgagtcacctgttgaagaattccagtacatcagggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacagggttaattttgttgcagctattgatgtgtacgaagatggagaagctggtttgctgttgtgttacaactacagttgcatctataaaaaggtttgcccctttaatggtggctcttttttggttcaaccttctgcgtcagatttccagttctgttggaaccaggctccctatgcaattgtctgtgctttcccgtatctcctggccttcaccaccgactccatggagatccgcctggtggtgaacgggaacctggtccacactgcagtcgtgccgcagctgcagctggtggcctccagggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggcctctcggatgaaggtggacccaagtcagaaggagcgccaaaggccaaatcaaaaccccggaagcggttagaagaaagccaaggaggccccaagccaggggcagtgaggtcatctagcagtgacaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttctgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattcttatttactgc

SEQ ID NO: 4101 - DNA, 3800 bp, Homo sapiens
atatttgggacaaagagctctcttaaatgaaagataattgcaagatccggttcagcagctttgtcccttgcctcaagtttactgcagggcttctctcctctctggttatacagaaatgaaattataaaccaccagtaaccttggaaatttcaatcgattccaaatgactaaatatttaattgaatcattgcctatacttccagggatgactctggcgtttgctttttattgagggctccatgaaagccaggctctgcaatggctgctggggactgtgtctgttgcaaggaggctcccctgcagtgaggagccggggcactgcaagtctgttccatagcagccctttttgcaaatggtagttgatttttgcagaaggtttgtggccagatcgctatgtataatactgatgaagcatttttgttccagctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaagggctggacgggctaccgtggcggtctggataccaaaaatgataccacagggatacattcagtttatactgtgtaccaagggcatgagatcatgtttcatgtttccaccatgttgccatattccaaagagaacaaacagcaggtggaaaggaaacgccacattggaaacgatatcgtcaccattgtgttccaagaaggagaggaatcttctcctgcctttaagccttccatgatccgctcccactttacacatatttttgccttagtgagatacaatcaacaaaatgacaattacaggctgaaaatattttcagaagagagcgtaccactctttggccctcccttgccaactccaccagtgtttacagaccaccaggaattcagggactttttgctagtgaaattaattaatggtgaaaaagccactttggaaaccccaacatttgcccagaaacgtcggcgtaccctggatatgttgattagatctttacaccaggatttgatgccagatttgcataagaacatgcttaatagacgatcttttagtgatgtcttaccagagtcacccaagtcagcgcggaagaaagaggaggcccgccaggcggagtttgttagaatagggcaggcactaaaactgaaatccattgtgagaggggatgctccatcaagcttggcagcttcagggatctgtaaaaaagagccgtgggagccccagtgtttctgcagtaatttccctcatgaagccgtgtgtgcagatccctggggccaggccttgctggtttccactgatgctggcgtcttgctagtggatgatgaccttccatcagtgcccgtgtttgacagaactctgccagtgaagcaaatgcatgtgcttgagaccctggaccttctggttctcagagcagacaaaggaaaagatgctcgcctctttgtcttcaggctaagtgctctgcaaaagggccttgaggggaagcaggctgggaagagcaggtctgactgcagagaaaacaagttggagaaaacaaaaggctgccacctgtatgctattaacactcaccacagcagagagctgaggattgtggttgcaattcggaataaactgcttctgatcacaagaaaacacaacaagccaagcggggtcaccagcacctcattgttatctcccctgtctgagtcacctgttgaagaattccagtacatcagggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacagggttaattttgttgcagctattgatgtgtacgaagatggagaagctggtttgctgttgtgttacaactacagttgcatctataaaaaggtttgcccctttaatggtggctcttttttggttcaaccttctgcgtcagatttccagttctgttggaaccaggctccctatgcaattgtctgtgctttcccgtatctcctggccttcaccaccgactccatggagatccgcctggtggtgaacgggaacctggtccacactgcagtcgtgccgcagctgcagctggtggcctccaggtcggatatatacttcacagcaactgcagctgtgaatgaggtctcatctggaggcagctccaagggggccagtgcccgaaattctcctcagacacccccgggccgagatactccagtatttccttcttccctgggggaaggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggcctctcggatgaaggtggacccaagtcagaaggagcgccaaaggccaaatcaaaaccccggaagcggttagaagaaagccaaggaggccccaagccaggggcagtgaggtcatctagcagtgacaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttctgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattcttatttactgcaaccttctcatattttatatacttagatggaaaattattttttcattacagttttgatttatgtcacataatgtgtttcttttataaagaaaagtcgttgctttttaacttta

SEQ ID NO: 4102 - DNA, 3404 bp, Homo sapiens
atggacccgttaacgaaggtgccttgtgggagtcagatagcacaaaccattctatggaaagcaaagtcgtctctctccttcggcatccagccccttcagacatggccaacgaaagaccctgaactagagtcccaggtcaacctctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaagggctggacgggctaccgtggcggtctggataccaaaaatgataccacagggatacattcagtttatactgtgtaccaagggcatgagatcatgtttcatgtttccaccatgttgccatattccaaagagaacaaacagcaggtggaaaggaaacgccacattggaaacgatatcgtcaccattgtgttccaagaaggagaggaatcttctcctgcctttaagccttccatgatccgctcccactttacacatatttttgccttagtgagatacaatcaacaaaatgacaattacaggctgaaaatattttcagaagagagcgtaccactctttggccctcccttgccaactccaccagtgtttacagaccaccaggaattcagggactttttgctagtgaaattaattaatggtgaaaaagccactttggaaaccccaacatttgcccagaaacgtcggcgtaccctggatatgttgattagatctttacaccaggatttgatgccagatttgcataagaacatgcttaatagacgatcttttagtgatgtcttaccagagtcacccaagtcagcgcggaagaaagaggaggcccgccaggcggagtttgttagaatagggcaggcactaaaactgaaatccattgtgagaggggatgctccatcaagcttggcagcttcagggatctgtaaaaaagagccgtgggagccccagtgtttctgcagtaatttccctcatgaagccgtgtgtgcagatccctggggccaggccttgctggtttccactgatgctggcgtcttgctagtggatgatgaccttccatcagtgcccgtgtttgacagaactctgccagtgaagcaaatgcatgtgcttgagaccctggaccttctggttctcagagcagacaaaggaaaagatgctcgcctctttgtcttcaggctaagtgctctgcaaaagggccttgaggggaagcaggctgggaagagcaggtctgactgcagagaaaacaagttggagaaaacaaaaggctgccacctgtatgctattaacactcaccacagcagagagctgaggattgtggttgcaattcggaataaactgcttctgatcacaagaaaacacaacaagccaagcggggtcaccagcacctcattgttatctcccctgtctgagtcacctgttgaagaattccagtacatcagggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacagggttaattttgttgcagctattgatgtgtacgaagatggagaagctggtttgctgttgtgttacaactacagttgcatctataaaaaggtttgcccctttaatggtggctcttttttggttcaaccttctgcgtcagatttccagttctgttggaaccaggctccctatgcaattgtctgtgctttcccgtatctcctggccttcaccaccgactccatggagatccgcctggtggtgaacgggaacctggtccacactgcagtcgtgccgcagctgcagctggtggcctccaggtcggatatatacttcacagcaactgcagctgtgaatgaggtctcatctggaggcagctccaagggggccagtgcccgaaattctcctcagacacccccgggccgagatactccagtatttccttcttccctgggggaaggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggcctctcggatgaaggtggacccaagtcagaaggagcgccaaaggccaaatcaaaaccccggaagcggttagaagaaagccaaggaggccccaagccaggggcagtgaggtcatctagcagtgacaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttctgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattcttatttactgc

SEQ ID NO: 4103 - DNA, 3458 bp, Homo sapiens
actagaagcaagaatgtagcctgggtaatatctggaacactttcaaactgcatgcattgatgtgttgcccattttcagctaagagagggaggactacaaaaggttaaatttctcatataagattaattcagccatctctgtgaaatggtggaagcagaatgccattagactctctaatctcatttctctcatgctgtctttcttggagcctgtcaaacagtgtcctggcagagagtcagttctctggttgctaaacatcagagtcagtctctttctgcatgtgccaagagggctgtaatttagaaaatgcaacctaccttttaaggaaggatgaaaagctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaagggctggacgggctaccgtggcggtctggataccaaaaatgataccacagggatacattcagtttatactgtgtaccaagggcatgagatcatgtttcatgtttccaccatgttgccatattccaaagagaacaaacagcaggtggaaaggaaacgccacattggaaacgatatcgtcaccattgtgttccaagaaggagaggaatcttctcctgcctttaagccttccatgatccgctcccactttacacatatttttgccttagtgagatacaatcaacaaaatgacaattacaggctgaaaatattttcagaagagagcgtaccactctttggccctcccttgccaactccaccagtgtttacagaccaccaggaattcagggactttttgctagtgaaattaattaatggtgaaaaagccactttggaaaccccaacatttgcccagaaacgtcggcgtaccctggatatgttgattagatctttacaccaggatttgatgccagatttgcataagaacatgcttaatagacgatcttttagtgatgtcttaccagagtcacccaagtcagcgcggaagaaagaggaggcccgccaggcggagtttgttagaatagggcaggcactaaaactgaaatccattgtgagaggggatgctccatcaagcttggcagcttcagggatctgtaaaaaagagccgtgggagccccagtgtttctgcagtaatttccctcatgaagccgtgtgtgcagatccctggggccaggccttgctggtttccactgatgctggcgtcttgctagtggatgatgaccttccatcagtgcccgtgtttgacagaactctgccagtgaagcaaatgcatgtgcttgagaccctggaccttctggttctcagagcagacaaaggaaaagatgctcgcctctttgtcttcaggctaagtgctctgcaaaagggccttgaggggaagcaggctgggaagagcaggtctgactgcagagaaaacaagttggagaaaacaaaaggctgccacctgtatgctattaacactcaccacagcagagagctgaggattgtggttgcaattcggaataaactgcttctgatcacaagaaaacacaacaagccaagcggggtcaccagcacctcattgttatctcccctgtctgagtcacctgttgaagaattccagtacatcagggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacagggttaattttgttgcagctattgatgtgtacgaagatggagaagctggtttgctgttgtgttacaactacagttgcatctataaaaaggtttgcccctttaatggtggctcttttttggttcaaccttctgcgtcagatttccagttctgttggaaccaggctccctatgcaattgtctgtgctttcccgtatctcctggccttcaccaccgactccatggagatccgcctggtggtgaacgggaacctggtccacactgcagtcgtgccgcagctgcagctggtggcctccaggtcggatatatacttcacagcaactgcagctgtgaatgaggtctcatctggaggcagctccaagggggccagtgcccgaaattctcctcagacacccccgggccgagatactccagtatttccttcttccctgggggaaggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggcctctcggatgaaggtggacccaagtcagaaggagcgccaaaggccaaatcaaaaccccggaagcggttagaagaaagccaaggaggccccaagccaggggcagtgaggtcatctagcagtgacaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttctgatgtaatttctcaacaaaatgtggcttttagcctgtcagtgatctattggaccaaaccttctgcacactcggccagttccctctcc

SEQ ID NO: 4104 - DNA, 905 bp, Homo sapiens
tacctcccccttgatgggtggcgggatcccggagccaacgcagaccggacgtcggaacgccgctttagccccgggacagctgcccagcctccaggcccactgatggacccgttaacgaaggtgccttgtgggagtcagatagcacaaaccattctatggaaagcaaagtcgtctctctccttcggcatccagccccttcagacatggccaacgaaagaccctgaactagagtcccaggtcaacctctctgtctcggaagacctaggctgtagacgtggggatttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgtgcacttagagaacccagaataccacaccagatggtatttcaaatattttttaggacaagtccatcagaactacattggaaacgatgccgagaagagccctttcttcttgtccgtgaccctttctgaccaaaacaatcaacgtgtccctcaataccgtgcaattctttggagaaaaacaggtacccagaaaatatgccttccctacagtcccacaaaaactctttctgtgaagtccatcttaagtgccatgaatctggacaaatttgagaaaggccccagggaaatttttcatcctgaaatacaaaaggacttgctggttcttgaagaacaagagggctctgtgaatttcaagtttggggttctttttgccaaagatgggcagctcactgatgatgagatgttcagcaatgaaattggaagcgagccttttcaaaaatttttaaatcttctgggtgacacaatcactctaaaggg

SEQ ID NO: 4105 - DNA, 1256 bp, Homo sapiens
ctgactgagaggttttggtggcggtacagacacttttaactcacagtaaaagcaaaagcaacagctcaagcagcctccttggagaaaacctgaaaattcaacttgttcaagagaaggtcttgtacgtgcctaagttctagagcctcctgacgtgagcatggctgagagtgaggaccgctccctgaggatcgttctggtagggaaaactggaagtgggaaaagtgcaacagcgaacaccatccttggagaggaaatctttgattctagaattgctgcccaagctgttaccaagaactgtcaaaaagcatcccgggaatggcaggggagagaccttcttgttgtagacactccagggctctttgacaccaaggagagcctggacaccacctgcaaggaaatcagccgctgcatcatctcctcctgcccagggccccatgctattgtcctagttctgctgctgggccgctacacagaggaggagcagaaaaccgttgcattgatcaaggctgtctttgggaagtcagccatgaagcacatggtcatcttgttcactcgcaaagaagagttggagggccagagcttccatgacttcatagcagatgcggatgtgggcctaaaaagcatcgtcaaggagtgcgggaaccgctgctgtgcctttagcaacagcaagaaaaccagtaaggcagagaaggaaagtcaagtgcaggagttggtggagctgatagagaaaatggtgcagtgcaacgaaggggcttacttttctgatgacatatacaaggacacagaggaaaggctgaaacaacgggaagaggttttgaggaaaatctacactgaccaattaaatgaagaaattaaactagtagaagaggataagcataaatcagaggaagaaaaggagaaagaaattaaattactaaaattaaaatatgatgaaaaaataaaaaatataagggaagaagctgagagaaatatatttaaagatgtttttaataggatttggaagatgctttcagaaatatggcataggtttttgtcgaaatgtaagttttattcttcctaatttactgtgatttgttaatggatgaattgtattttgcaaagatagttagagaaatacctccttccccttagctttattaaggtatcattgataaataaaaataaaatatgtttaatgtatataatgtgatttttaaatatatatatatatatacacacattgtgaaataatgaaataaaggtaattaacacatcta

SEQ ID NO: 4106 - DNA, 502 bp, Homo sapiens
ggccccgccgacccacggcccacgacccaccgacccacgaatcggcccggcccccgcgttcaccatgtctggcttctccagcgtcgccgctacgaagaaagtggttcaacagctccagctggaggccgggctcaacagcgtaaaagtttcccaggcagctgcagacttgaaacaattctgtctgcagaatgctcaacatgaccctctgctgactggagtatcttcaagtacaaatcccttcagaccccagaaagtctgttcctttttgtagtacaatgaatctttcaaaggtttcccaaaccacttcttatgatccagtgaatattcaagagagatacatttgaagcctgtacaaaagcttatccctgtaacacatgtgctgtaatatacaaaattctacttttgtctgtccttaacatctacctctgaatttttatgaatttctacttcacaagggtaattgttttatatacattggcagcagcatacaataaaacttagt

SEQ ID NO: 4107 - DNA, 3229 bp, Homo sapiens
aaaggacccgggtagttccgcttccggcagcgcgagataaatcacgagaggaagcttaaatctgtcgtttgaatttaggaccacctcggttcacaatggtccgtagtggaaaaaatggtgaccttcatcttaaacagattgcatattacaaacgaactggtgaatatcattcaactacactgccaagtgagagaagtggcataagaagagcagcaaaaaaatttgtcttcaaagaaaaaaagctgttttatgttggaaaagacagaaaacaaaatcgtttggtaattgtttcagaagaggaaaaaaagaaagtcttaagagaatgccatgaaaatgacagtggagctcatcatggtatatccaggaccctcactctggtagaatccaattattattggacatctgtgaccaatgatgtcaaacagtgggtatatgcttgtcagcattgccaagtggcaaaaaatacagttattgtagcaccgaaacagcaccttctcaaggtggaaaatccatggagtttagttactgttgatctgatggggccttttcatacaagcaacagaagtcatgtatatgctataatcatgacagatttgttcaccaaatggattgtgattttgcctctatgtgatgtttcagcatcagaagtttctaaagctattatcaatatatttttcttatatggacctcctcagaaaataataatggaccaaagagatgaattcattcaacagatcaatattgaactgtacagattgtttggcataaagcaaattgtaatttctcacacctctggaactgttaacccaacggaaagtacacctaacacaatcaaagcatttctctccaaacactgtgctgaccacccaaacaattgggatgatcacctatcagctgtttcatttgccttcaatgtaactcacttggaacctactaaaaatacaccatattttcaaatgtttagtcgaaatccttatatgcctgagacttcagatagtcttcatgaagtggatggtgataatacaagtatgtttgccaaaattctagatgcaattaaagaagctgataaaataatggagaataagacaacttcactgggccagatggagaacaacaatttggatgaactaaataaaagcaagatcattgttaaaaagaaacccaaacaattaaatccatttcatttaaaagtgggtcatgaagttttaagacaaaggaaaaattggtggaaggatggtcgttttcagtctgaatgggttggtccttgtgtcatagactatattacagaaagtggatgtgctgtcctgagagacaacactggggttagactgaaaagacctatcaaaatgtcccaccttaagccctacataagagaatccagtgaacaagaaagtctttatctcttgcaaggttcagtagtggcagatcatgactacattggattgcctgaaattccgattggagcatatcaagcaaatattctggtggaagatgcaactattggtatagtcgataatgaattactgacatcaagcaaggatcgtgaactattagaatatagaaatacgaaaatctctccattgatagacgatcatagttctcttgaaaagcagactttcagtctgttggactcttcaaaccaggttcttgaatacttaagttagtaaataccaaaatttatttaaattgtttgtttagaatataaattcttaatgatatcttattcattaaaaacgttgtatagaagaagtatcttgacacattcttaatgactatattctgaaggtttattttatagttcttatctaaaattatgccacatttgaatatcagtatacgtacatatgaaggcaaaggaagcatgtaatatatagaattcactttttcttctaaaaagagaacaggcaaagcacccctacttcttgggaaataaattccagcccaaatctctcaaacctttgtatggttttggcaccgtttctaagttttaaattttctgaaattctctaccatttaaacagtaagtttgaactaccttgaatggaattgataaatactgaatcaactgtaacaatgaatgaaatgaagcttctttctgtttcattagaacttctaaaaacaagattgtatgaaaaaatatagggttatttaataggctttcacagaatattggtaatttcaaattatctaattggttagatagggtcaggattagggtctgaaactatgtattggttgggaaacaatttgtttattttcatactatatattaaagataaaaccatcgaccaggcatggtggcccacacctgtaatcccagcgctttgggaagccaaggcaggatgatcacttgaccccaggagttcgagaccagcctgggcaacacagggagaccctatctctacagaaaaatgtttaaaaattagccaggtgtggtggcacatgcctgcggtcccagctactcaggaggctgaagtaggagcattgcttgaccccaggaggtcgaggctgcagtgagccgcgctcatgccacagctctccagcctgggcgacagggcaagacctgtctcaacaacaacaacaaaagtatccgttaagaattttttctgcaatcataaaatcataaaataaccagtatcaaagattttaaactgtaatttctatgatattcataaatataaaataaatattgttcaataaatatttattctaaagcactatgaaaagaactgtgggaaaagtaaaagatgagtcaaacgtgtacctcattcttataaaggacttactgtctggtaggtaataaactatgtaagccatgtacagcacaagttaaggcatgctaaattgcagaagacaggtgtagataatgtacttagggaggcaaaaagagagaagttgtttttacataggaaatttgtgtttatccttatggaagaaggatcatttaagcttgaccttgaagaatgtataggatttggtaaatggatacaaaagaattaggggagaagtaatacacagaaatggaaaagtattgtaatgattcataaaaaggcagggcttcttgttgtctacactgcctcgggtataaagtgaagaagcaagataatgagggataaagctgaaaaggtaagtaggaaaccttatggagagctttgaatactattaaggattgatatgtgcccctcccaaaatttgtgttgaagtcttaacccccaccacctcaaaatgt

SEQ ID NO: 4108 - DNA, 1040 bp, Homo sapiens
cttaaatctgtcgtttgaatttaggaccacctcggttcacaatggtccgtagtggaaaaaatggtgaccttcatcttaaacagattgcatattacaaacgaactggtgaatatcattcaactacactgccaagtgagagaagtggcataagaagagcagcaaaaaaatttgtcttcaaagaaaaaaagctgttttatgttggaaaagacagaaaacaaaatcgtttggtaattgtttcagaagaggaaaaaaagaaagtcttaagagaatgccatgaaaatgacagtggagctcatcatggtatatccaggaccctcactctggtagaatccaattattattggacatctgtgaccaatgatgtcaaacagtgggtatatgcttgtcagcattgccaagtggcaaaaaatacagttattgtagcaccgaaacagcaccttctcaaggtggaaaatccatggagtttagttactgttgatctgatggggccttttcatacaagcaacagaagtcatgtatatgctataatcatgacagatttgttcaccaaatggattgtgattttgcctctatgtgatgtttcagcatcagaagtttctaaagctattatcaatatatttttcttatatggacctcctcagaaaataataatggaccaaagagatgaattcattcaacagaaagtctttatctcttgcaaggttcagtagtggcagatcatgactacattggattgcctgaaattccgattggagcatatcaagcaaatattctggtggaagatgcaactattggtatagtcgataatgaattactgacatcaagcaaggatcgtgaactattagaatatagaaatacgaaaatctctccattgatagacgatcatagttctcttgaaaagcagactttcagtctgttggactcttcaaaccaggttcttgaatacttaagttagtaaataccaaaatttatttaaattgtttgtttagaatataaattcttaatgatatcttattcattaaaaacgttgtatagaagaa

SEQ ID NO: 4109 - DNA, 2140 bp, Homo sapiens
ctcagtgcgcgtgcgcggggcgggcgggtgcgcgcgcacttcctcctcgcccccacccagacccagaaggcgccaccatggcggcgcccccgcagcccgtcacccacctcatctttgacatggacggacttcttctggatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccaggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaagtgccttgtctttgaagatgctcccaatggggtggaggcggccctggcagctgggatgcaggtggtcatggttcctgacggaaacttgagccgagatctgacaacaaaggccaccctggtgctgaattccctgcaggacttccagcccgagctgtttggtttgccctcctatgagtgagagggagggcctcagtcttccgcccccagcccactctcatggtccacactgctgggggaaagggaaaggaaatcagcaactcttcaatcccaacctgcgctgtgattttagcctcctgagattggagtttccatcccatgttggtttgtcccagtctaacgtgttgataaaatgtgacttgacggttgagacaaaaaatacagtagagacagaaacgaagcccagaacaaagatgaaacttgaattaccatctcagaagtcaagctgatggagtatgtgataaagtgaatgtacatgtatatacacacacacctccatatatacatgtgtgtatcagtttggtaatatgcaggtaggcattacatgcatatgtatgtagacatatgcatgcatgtatatgtaaaatatatacttttccaagacaaaatggaacatcacttctctcttctagtttttctgaacactggctgggaaatgtaaactgtgtatgcatataagtatatgctttatgtatgcatatgtatgtagatatgtttatatctatcgtctgcatcactctcctcagtgttgatgtcaacatgcaatgacaactgataaagcgagatggtagttctgcctggtttgcagtctgagtgggaaagtcctgtttttgatgagcactccttgttagctaacatttaaattctttttgtgacctcagaatgtctctggatctttcctcattgactgactctgtgccacgtcatccatagtttattgttagtatgaacacaactgtaacatttacctggtatctacatccttacctgcattggaaaatgtttgctacctcacaacaaccatttgcctcctttaagaacactgatgggctgcactttttggatagaaatagaatttgatttcagaatgtatgcttggtgagtctcagtgcccaggaacacttttggaataatttatcagacattgaacttctgtgattaatcgcttttatagatttactcagtctttaaaattcgtctctgatttgccagagaaaaacggtggtagccatggaaatcgggagtgaaggagcactgcttcattgtggctcagcccttcctaggggcctctgccctttgatgtccttgagctactcttcagctctggaagttgtggacaaaccgtaggaatgtatgtgtgcgtgtggtggagtgattgtctgtgaatgacaggccctggctattgattgatgttgcatcaatttagcaaattcatttcctcattcttgatggcctgaatatatgtctgcacttttaatgctcctcttaaccagttgtaacatcttaccatttccctaacaaattgaattagtttaataaaatcttttgacacatgtt

SEQ ID NO: 4110 - DNA, 1334 bp, Homo sapiens
cgcgcacttcctcctcgcccccacccagacccagaaggcgccaccatggcggcgcccccgcagcccgtcacccacctcatctttgacatggacggacttcttctgggttatacaggaagcatagtggcagctgcttcgggggagtcctcaagaggcttacaatcacggtggacggatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccaggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaagtgccttgtctttgaagatgctcccaatggggtggaggcggccctggcagctgggatgcaggtggtcatggttcctgacggaaacttgagccgagatctgacaacaaaggccaccctggtgctgaattccctgcaggacttccagcccgagctgtttggtttgccctcctatgagtgagagggagggcctcagtcttccgcccccagcccactctcatggtccacactgctgggggaaagggaaaggaaatcagcaactcttcaatcccaacctgcgctgtgattttagcctcctgagattggagtttccatcccatgttggtttgtcccagtctaacgtgttgataaaatgtgacttgacggttgagacaaaaaatacagtagagacagaaacgaagcccagaacaaagatgaaacttgaattaccatctcagaagtcaagctgatggagtatgtgataaagtgaatgtacatgtatatacacacacacctccatatatacatgtgtgtatcagtttggtaatatgcaggtaggcattacatgcatatgtatgtagacatatgcatgcatgtatatgtaaaatatatacttttccaagacaaaatggaacatcacttctctcttctagtttttctgaacactggctgggaaatgtaaactgtgtatgcatataagtatatgctttatgtatgcatatgtatgtagatatg

SEQ ID NO: 4111 - DNA, 825 bp, Homo sapiens
ctcagtgcgcgtgcgcggggcgggcgggtgcgcgcgcacttcctcctcgcccccacccagacccagaaggcgccaccatggcggcgcccccgcagcccgtcacccacctcatctttgacatggacggacttcttctggatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccaggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaagagctccatccatagacctcgtctgctcaccgcacagaaatgccagggctgccgggatcccttctcagcgctcctccttctgtgtaatcaactgcttctctgctctgatgacacctgaccgcacctccagctcacagccacagtgcatggagaccccgagccttctacttgggtgtcccacgatggcctcaaacccaacttgtcacaaaagctacctctccttcctgccaccaaaatgg

SEQ ID NO: 4112 - DNA, 2188 bp, Homo sapiens
ctcagtgcgcgtgcgcggggcgggcgggtgcgcgcgcacttcctcctcgcccccacccagacccagaaggcgccaccatggcggcgcccccgcagcccgtcacccacctcatctttgacggacggacttcttctgggtgggtagtggccgccgcctccgggcggtcttgtgtgggcgtggggacggatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccaggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaagtgccttgtctttgaagatgctcccaatggggtggaggcggccctggcagctgggatgcaggtggtcatggttcctgacggaaacttgagccgagatctgacaacaaaggccaccctggtgctgaattccctgcaggacttccagcccgagctgtttggtttgccctcctatgagtgagagggagggcctcagtcttccgcccccagcccactctcatggtccacactgctgggggaaagggaaaggaaatcagcaactcttcaatcccaacctgcgctgtgattttagcctcctgagattggagtttccatcccatgttggtttgtcccagtctaacgtgttgataaaatgtgacttgacggttgagacaaaaaatacagtagagacagaaacgaagcccagaacaaagatgaaacttgaattaccatctcagaagtcaagctgatggagtatgtgataaagtgaatgtacatgtatatacacacacacctccatatatacatgtgtgtatcagtttggtaatatgcaggtaggcattacatgcatatgtatgtagacatatgcatgcatgtatatgtaaaatatatacttttccaagacaaaatggaacatcacttctctcttctagtttttctgaacactggctgggaaatgtaaactgtgtatgcatataagtatatgctttatgtatgcatatgtatgtagatatgtttatatctatcgtctgcatcactctcctcagtgttgatgtcaacatgcaatgacaactgataaagcgagatggtagttctgcctggtttgcagtctgagtgggaaagtcctgtttttgatgagcactccttgttagctaacatttaaattctttttgtgacctcagaatgtctctggatctttcctcattgactgactctgtgccacgtcatccatagtttattgttagtatgaacacaactgtaacatttacctggtatctacatccttacctgcattggaaaatgtttgctacctcacaacaaccatttgcctcctttaagaacactgatgggctgcactttttggatagaaatagaatttgatttcagaatgtatgcttggtgagtctcagtgcccaggaacacttttggaataatttatcagacattgaacttctgtgattaatcgcttttatagatttactcagtctttaaaattcgtctctgatttgccagagaaaaacggtggtagccatggaaatcgggagtgaaggagcactgcttcattgtggctcagcccttcctaggggcctctgccctttgatgtccttgagctactcttcagctctggaagttgtggacaaaccgtaggaatgtatgtgtgcgtgtggtggagtgattgtctgtgaatgacaggccctggctattgattgatgttgcatcaatttagcaaattcatttcctcattcttgatggcctgaatatatgtctgcacttttaatgctcctcttaaccagttgtaacatcttaccatttccctaacaaattgaattagtttaataaaatcttttgacacatgtt

SEQ ID NO: 4113 - DNA, 1376 bp, Homo sapiens
acttcctcctcgcccccacccagacccagaaggcgccaccatggcggcgcccccgcagcccgtcacccacctcatctttgacatggacggacttcttctggatactgaacggctgtattcagtggtgtttcaagaaatatgtaatcgctatgacaagaaatacagctgggatgtaaagtccctggttatgggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaagtgccttgtctttgaagatgctcccaatggggtggaggcggccctggcagctgggatgcaggtggtcatggttcctgacggaaacttgagccgagatctgacaacaaaggccaccctggtgctgaattccctgcaggacttccagcccgagctgtttggtttgccctcctatgagtgagagggagggcctcagtcttccgcccccagcccactctcatggtccacactgctgggggaaagggaaaggaaatcagcaactcttcaatcccaacctgcgctgtgattttagcctcctgagattggagtttccatcccatgttggtttgtcccagtctaacgtgttgataaaatgtgacttgacggttgagacaaaaaatacagtagagacagaaacgaagcccagaacaaagatgaaacttgaattaccatctcagaagtcaagctgatggagtatgtgataaagtgaatgtacatgtatatacacacacacctccatatatacatgtgtgtatcagtttggtaatatgcaggtaggcattacatgcatatgtatgtagacatatgcatgcatgtatatgtaaaatatatacttttccaagacaaaatggaacatcacttctctcttctagtttttctgaacactggctgggaaatgtaaactgtgtatgcatataagtatatgctttatgtatgcatatgtatgtagatatgtttatatctatcgtctgcatcactctcctcagtgttgatgtcaacatgcaatgacaactgataaagcgagatggtagttctgcctggtttgcagtctgagtgggaaagtcctgtttttgatgagcactccttgttagctaacatttaaattctttttgtgacctcagaatgtctctggatctttcctcattgactgactctgtgccacgtcatccatagtttattgttagtatgaacacaactgt

SEQ ID NO: 4114 - DNA, 2184 bp, Homo sapiens
aacttccggcgtccgtcgggcagcagcggggctgtctatcccggctgaggacccgcggccagtgcgggtggctggctttgccattagcgggggcctttcctgaggacggcgtacggagtgtggggaatgaaggatggcagcatgccgtgcattaaaagctgttttggtagatctcagtggcacacttcacattgaagatgcagctgtgccaggcgcacaggaagctcttaaaaggttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccggttactcctggatggagcacctctgatagcaatccacaaagccaggtattacaagaggaaagatggcttagccctggggcctggaccatttgtgactgctttagagtatgccacagataccaaagccacagtcgtggggaaaccagagaagacgttctttttggaagcattgcggggcactggctgtgaacctgaggaggctgtcatgataggagatgattgcagggatgatgttggtggggctcaagatgtcggcatgctgggcatcttagtaaagactgggaaatatcgagcatcagatgaagaaaaaattaatccacctccttacttaacttgtgagagtttccctcatgctgtggaccacattctgcagcacctattgtgaagcagtgtgtgcatctgaagcaacttgaaatgcagcttcttattgtctggaatgaatcccttaccaactcagtgccagcatcggtagacaccagtcagtgctgatcgctttttaaccctcttttgttgtgcattaattagaaagaaaggtattgaattgcggctagccagtaagccttgctaatctcttttattttgtaactgaagatgagacccaaagaaagggaaagctgagattttgtgccattccttttaaaatattcatcaggttaggtggggctgtgggggaaaagctactacagggaagagtgttctctgctgtctcttcactggaaaacagggaggggggatttcagactgtgaagaaagttgaatggtggtttttaaattataaagtaatgtattaaaaggtgcattaggctgtagttctaatattgagttcaactgtgaaatccatcagatgtgccaaatggagaagacagaaagcaacaaagtgaattgttctttagcccaagtggtacagtgaatttgctttaacagatgttgaaaactaaattttctactgtattcccagcacgggtgacttctttttctcttcattagccagagatgactaatttaaatttagaaccagattttaatttaaattaatatttccattaataacctattcattgcagatacctattatactgtgtaacagttgttttggaaattttatgtaaaattaaaactatcagtattttacagatgttttaattagacattgttattaacaggaacagtgcagaaactagaatcaagccttataatatcttatagaccatgcatttttgaagttagtgtccactagggtcctattaactgtacatttgcaagatttcattatttttgcctctgacactatgggaaaaattttttagaagctattgggacagattcaagcttttatgcacttggttactacagctgtaaaatgaaatctcgtcttgtagcatggattattcttctcatgttaaacccaccaaaataaaggggactaaataggtaatgattttcctagtgcatttgcatactgtgataatcctgggccttgcaatagttctacagggctcttgggcattgaattattaggatgtaattgtacatcattgtagtgttcaccttattgaagctcactctgatgttaatgagcttcgggttttgatgcttgtttagagatcagcagtcttggatgggagggaacaaagctaaataaatgttagtttggtg

SEQ ID NO: 4115 - DNA, 620 bp, Homo sapiens
cccccgcaaaagttagtacctgcgaagctgcggcacaaagagtggttccgggctctcattacggaggccgggacctgggaccgaccagccgcgcctcctggctgagggttccgcgctccggagctgcagtgaccgtacacgtcgccgatagacacctaaggcttcagaagggtcctggctcgcaggccccagacgttttgctcctaagactccgcgagttgtcgcacccacgtcgactggcgctcttcagtgcttccctcactggttaagcggtcactcccgccttaagcccagcagccggtcgcttcccggcgccgccatcgttagtgtttgttttcatccgcttcgagagaagattataaatggcagagccatttaactgtggttagctgttggattctgatactttcttaaaaatacgttcttgcaccaacatcttcattgggaacagttcagaaaaagcaaagaggagagccaacattcacatttaccatggctataccaataacagtgcttgactgtgacctcttgctatatggccgtggtcaccggacattggaccgttttaagctggatgatgtgactgatgaatacttgatgtccatgtatgggtttccacg

SEQ ID NO: 4116 - DNA, 1619 bp, Homo sapiens
tatataaatgtgctatggagtgggctgcagtggctcctgcctggcctcagttacttgggaggttgaggtgggaggatcgcttgagcccaggagtttaagacctgcctgggcaacatagtgagaccccatctctacatccaaataaaataaaataaaataaaaaggtaaaaaaaaaagagagagagagagcacgataatttttgtaccaggaatgaaaagggagcccaaaaatctaagcagtgagcaggtgctgaaaccaacgtactcacagagcaagccaaacaggattagactttattactggggactgggcttgaacctccgggctgcagcatcagaggctaacagaatggagagtaaaaaggtgggcaaaagacttggggctggaaagcagcagatgggagcagaattgacagaacagcacatggccaggatatccctccccgctaaaatactaggatactgacttagaaaagcagagggtcagggaaatctaaaaaaaaaagactgacatttctatttaagagacattgcctaaattgctgattaaataaacagatccaaccagatctaaataatattggacatttaattagttttcctattacactgcaggtacagcctcaggaatacttataggcaaaattaaagtgctacttttctatctgcctctctgagttggagtgagttaaatgtgtaacccccacattgtatataataatctcttacaatcttgttcatagtgccacctatggtcacgaccaattagagctggtaaggcagctgtactgtttgcttcagccaatgagggtaaatgtactatgttgctaaaactctcagcccatgagtactctcctgagctatcctcagccaggcatgcactgcaagatgggtcatttgtgcttctttggcttaactttctgccattgactttgggttctagggaacagattgaccccaaacatctgacataacctacgtaagtgacagtgttggcttagaataaagaaacaaagactatcatggcatttttttaataaagcaagtgttacagtgacctgttttggggactgccagagattaggtggcagttgccttctagatctagccacaggagaaaaaattaaagagccatatgactgtgaggcagatcctcatcagggaggaggcgcagtgtctttttaaccactttgaagaccaacagccaagacatcttgagctagttgtggtggacagagagttccaaacacctcagccaccaggaaaagggagtggccaggaagaggctgcaggctcaagggctgggattctcccacccacctaaggaacctactgagcatcgaaccactccaacttgccttgggaggaggacttgaatgctaccaaagactgctcgacaggcctgcaaggcaggactacttttgtgagaatttgaagaccatgccgacctgtcatttaaagcacccatctctgcctgagctgtcagatttgccaagttctgggttgtctcataattatttactcagtacaaaataataccagccatgatcctcagtggtaagtagcagaaatcaactgtatttgtttgctaaggctgtgctaataaagtgctgtaaacc

SEQ ID NO: 4117 - DNA, 1471 bp, Homo sapiens
tgggcaaaaagatcaaaattctacagaagaatctgatggctaaatggctaatttgcaaaacacaatgccctgtacattttgaggacatcctaaaacatgtgtaaacttttcagaattcagtttaccaaagttatcaaacttaaaaatgattaaaatttatttgctactgcaaagaattcaaccaatttctccaatgactactccatattcattttgaaaaacagtaccggatttaaagcttacacaacaaaattcacaaaagtgttatatgtgcctatatgacatataggcacaaataactgcagacattctgaagctaacactgctcaaccaggaaaaaaaaaagactgcaattggatatgtaataacagctatttaagacggcagtaacgtgttaaaatggttcataaaaatcacatcataaggccctgaaattctagtaaaaatatctctaagtaaacttgtgaactactactaaataactaattttctctctctctgtagtcactcattttatctttggattactttcccattctatcaccacgttgctttctctgaacttcattttacatttgcatattatttattccattagcaattgctcatcccagtctgaatctcaaaattctactataggaggcatttggcattctgtggaataagagaattttgagatggaaatgatcaaccagctcaaaacctcgtaagctagagttcagttaagcttagcacaatgatgaaaacaatttctcattaaaacttctttcattccctctacagaagcagtaaccctgggtacagttaaaactgcctgggtctttaagctttgtcacctcggacaagtcattatacctaacctcccagggcctcagcttccagagtagttaaatggaaaaacaatagcatctatctcaggttattagattatgaaatgagttaacacacgcaaacaggctgaaagagtccctggtgcgcagtgcaggtattagtcatttagaggtatagttactattacaggaaggtagtaacttagaaagacttacctttaaggtccaacaacctaatctacatatttgtatatttctaaggtaagagaatttttaaaagtctattttcaccccgtaaacctaatgcaggaggataaggcacgggttactacaggaaaaagtaatgcagactgggggatgcgaaccaaagcacagacgaatgtgccccgacgattcctccgagaacataatgaaatggcggaccttcctgccagaggagcgcacagtcacccaggcaggtgatgtgacacacacgttagggtctaaaggtcccaaggctggagtcccctttactggaccctaaacatgtctgcctcctgccccgcaatcagacttagagaactgtggacggtggaaagtcttatcatgaccaggccatccttcgctggggtgaacggaaagcattcagaaggggaaaattg

SEQ ID NO: 4118 - DNA, 1150 bp, Homo sapiens
gggagtggttaaatgttaaattttacgatgtacgtatttaacccccacacgccccaaacaaatctgacaaaagttaaagaccattccctaggtgtagctctgttcctacatgcaaaattttacatattgttccagggagctcacggtcttctcaggttcatctgtggaaccattcgacaaccaaatgttatggggaagccagtctcatgagctccaacacattcttcagtgcaatcagtggcaatccctgcccacttaggacttttcgaatagtgctcatccctgacttctggataaacttctttgcagaagcccatttgactccaaggacagaaaaaaagagtgcaggttgttattatgcaaagccacagcattaaggagctcaatattcttctagatatctgccctcctgtctgagaatcccatacttagagtatagcaggtcccatctccatttgggatggtggtggtggaaaagggggcgtctctgatgagcagagcatctttaatgcctgctcaggccagagcccctttccaaagacttcgagactgccgtgggcctgctgactcctctcacgctttcaagctacagtgcttcccatcacattgcagaaggccgccttgggtcatatctcgcaaaggaagagctattaacaaatattccatttgtatttcctgcgtggccctccatctggaaatatcttttatctggcaacttttgcaaaatgaaccaaatcttgaaggaggtcttggcaggtttatgctagcctctctatcactccaacaagtcatttccatcctcgccttcacaagggtcaagcaattgtgacttgggttgggagacggggctggcacggaatggtagcaagtcatctaggctctgaggcatctttttaaccctgaaaacgtccacttggagggcaagagccaaatctaaaaaattattatacacactgtctctcagctcaaatatgtatgctctcactccaagttcagatcacaatttacaattccgcattttgtaattgttaagtgcagtctggcttccccaaagacctcaagctcattctgcccaggattaaatccaagagccttcttagcccagtttctggcatgcaggaagcatacaataatggaagaaatgaatgaa

SEQ ID NO: 4119 - DNA, 1799 bp, Homo sapiens
ctgttggccacagtgcttgcacatggccttgccatgtggcatgggcacagcatggtacctggattctacagagaatgccctaacagtaaatgttccaagagctcaaaaccacaaagcttctcataactcaatgtggaaattaggcagtcacttctactgcattctattggttacaaaggacccacctgggttcacaatggtatgagtactgggaggcatggttcattgaggaccatctttgtcgacttgctatcacaggcacaaaatcgtttcaaaaacacatatttttaaaattccctctcctcttggctcataggtcaatgggaaagctgtctgagacaatatgaaaatcaatgatgccactctagcattagctgaagatccccttgatttcatccagcagccaagacactaagtgacccaaaggaagaaaagggtgatcagcgtggctgtgtggtcagtaagtaaatgtgcaacagctggagtaaattagaactaatttagtgcataacttcagcaggaataaattttgttaatcttcaaaaagtcaaaacaaggattgtaactttcacagtatctgaatcacccaaattttactacaagactcttgtcctcattgttgcacttaccagttccgtactgataataaagaaaaattactattgaccttttcctaacaaagaacaatttttaaaattttgtttttacaataggaccctatggagctgttgttttaatattatgtaaattaagtaattttatctactctaaacaaattgctttatcagttgtagtcgaatctgactactcttatgcttattttattattaatccaagtaaatattctctattgaacatagattagcagtttacaaattagataaaaacagaaaacaaatcacttcaacagtattaactagaaatatgctagctactccttatttcagaataaggtgtcacaattcttccttttaaaatgttgtattgtatcatacttaaaaatatataaataattcctgaataaaagcatccaatatttatcattttattagtattagcctttgggaaaaaatttgatagcatgattttataaagctcttgcatttgctttaaatttagctaactattttgaccacaaggtggagctgtgatgtcacaatttggcaagatttgtaagatacaaaaactatgtaaatacagacgaaaataatttaataaaataggataatctcatcttgcaaatatgcactatttaaaattaatcaattctccaaacattaattatcagaagaaaactatcatttaatttgtccagttctcacttagcagttattgagctttatcatatataaattgtcttcagtagatgcagaattattctgtcatttcacatcacgatcccagatttagtgactttaaaccagtgttaaaatgtctttcaaaattattttgtaattaatcacagaataattcattaaccattacaaaatgtaatggttacattacatccttattttgttatccaatattgactagaggatcatccattatatcttctaaaataattctttcagttgattatttgtgttttgtattgttaaacaggcagaaacttctaattttcaaaagagagtattcagattttgagtcaaccaaatttcagtgaagatagactagcatgctaaactcatcgtctcttgaattattaaataaacaaacattaccaccacttcaataatatctgtcaggaatgaaaccacttttccaaatgaatgtttcctgatctattttaatatatt

SEQ ID NO: 4120 - DNA, 997 bp, Homo sapiens
agatgaaaaccgggcgggatggcagccccggggccagggatgcgggagccgccgggaagacccgcgcgccgctcgactcagagggactcacaccttcccccgacaaagaggcggccccactgtcgaccaagtgcccaaggcattgtgggagtcatgattccaagatgcccgcgacggaaaatggaacttgtcagctccttgtcatgggagcattgtgggcgccacaactcattcagctgcagtgaaaagactgttgcatgtcgctgtgcagcctcttatcgccgaggtctggcttccgctgctgctgcgcggcccctcccccgcccgcccagccccaccaggaagcccagggcggactcgtcgagctcctaatgcacgcggcggcgagaaaaacgctcttcaactttccgccggcgccctcccgcgcttccccgggccacagggtcgcctgtcaaccggacagagcccgcaagagcgggtcatgggcggtcgcccagcggcgccgagagcaggaggaagccggagcccgcgcgggcgccgtggatcccctcggcctcccgttggtatcttccatctcatgcgttcagcattgtaacctcgcggcgggcgtgcagaccggacgccctcccgcttcttctaccgactgctaggcacaccagtgggttcattttgaaagaggcccttgcaccgggctttgcaaggaagccggcaaggttagattgaaggttagaagccaattagactagaatcctgcgatctggtgagactgccgccttaaaatgcaccaaacagtttttgaacctggagggctaacaggcgggaaaaacatctgcaagactgccaccgtgtatttttctcaagtaacaggctatccacagttttggaattccttagtgaaactgtcacacaggcacaaacacatgtcagctttccttctagtttgtaaataatatttgtaatttacaggccactgtattcccaactttgcaccatgtga

SEQ ID NO: 4121 - DNA, 1538 bp, Homo sapiens
ggctacgcaagaccttcagttccggattaggaggccccgccccccggcccgagggaggggcggagagacccgctcctgcgacttagggcgatgccaccttaaagggcttgacctcctcgaagccagaactgcggaagaggatggagaaagaaacgctagatagacccaggattcgaacccacaacagcttggatgcaaagctcattttgaattctgaagagctgggagtttagcagtggacgaccaaacaaaaaaataccagaagacggtgaaagcagcagctggaaatgagagaaaaattaagaaatagaaaatgctgtttcatgtattagggagtgcacatctttaaagagaagtgaagaacctttttggctaggcgctttctggggaccttggcagttatcaacaagtcactctgaaactaacagaaggtgaggagggagtaatccagaaaggaaactgccatttttgctagggcaagaaagtagacctagcaatgcaatgccatcaaggagttagctggctctagcgttctccgaactttgcaactcattttatattacattgtctgcgtcaagaaatttcaagtaaatgccttgagattttatatgtataaaatgtagtctctggccaggcggggtggctcacgcctgtaatcccagcactttgggaggctgaggcgagtagatcacgatgtcaggagatcaagaccatcctggctaacatggtgaaaccccgtctctactaaaaaatacaaaaaattagccgggcatgatggtgggcgcctgtagtcccagctactcgggaggctgagacaggagaatggtgtgaacccgggaggcagagcttgcagtgagccgagatcgcgccactgcactccagcctgggcgacagagcgagactccgtctcaaaaaaaaaaaaaaaaaaaaaagtctcagaagaagtgtcaagttgactaaatgatttttaagtcccttccactctactatatcacaataatttcccctattttaccttatttaattttcacaacaaccctgcagcctgtaagtaggtgactcctccatggtcagcaggtggtcagtggtcgaactatttaggactatctgatgctctttcctctgctcaccattgcaatacaatgagaaaaatgcaaatgaatctaagtacagtgttctctgggaatatgaagatagaactaaaaactgcctgagagatcagggcaggcttctagaaagttgtgtctaactagtcttgaggtttacataaaccacaccaggctgatgggactgggaagggcccactaagcagtgagaccattcccttttggagagtccttgcatcccctcccagatttcctctttgaggggaaggtgagagaggaggtaaaaggggtgaggaatggagaataactcattctggttcttgtttccccttttccacataaaagtatatttgtcttgtgttccatacaccagtccatactgatgtgatggtgttttttatgcttccttttgaataaacatttcattcttaa

SEQ ID NO: 4122 - DNA, 981 bp, Homo sapiens
agctccggtgctggtgcggcgggggactgcggggccagcctcaggtagtagcagcagcagcagcagcagcagcagcagcagcagcagcagcagcagcagcagcagcagcaatgtttcacttcttcagaaagcctccggaatctaaaaagccctcagtaccagagacagaagcagatggattcgtccttttaggagatacaacagatgagcaaagaatgacagcaagaggcaaaacttcggacatagaggccaaccaacctttggagaccaacaaagaaaattcatccagtgtgactgtatcagaccctgagatggaaaataaggcaggccagactctggagaacagctcattaatggccgagctcctgagcgatgtgccgttcaccctggccccgcatgtgctggcagtacagggcaccatcactgaccttcccgaccacttactctcctatgatggcagcgaaaacttatcacggttttggtatgatttcactcttgaaaattcagtgctctgtgattcataacctttatgtctgtttgcaccttaacagctttaaaatatgttcgcctattttatctaacctgtttgatgttctttgccgtttcactgtttaaggtcctcagcaaggatcataaagcaaagaaaatagcattatgttcactactctatttttaagaaaaaggtacatttgtatacaaattgaacttaagttctacttcctttctcccatataataaatatacaaattaggctatgaaggttttaggaaaggactcgattccttcagatggtctctcaaaatataacacctcaaatttatcttagaagaactgtgaaaaagaattgtggcatttttcagtcactacagctccgaagtctgagcaagaagtgggtgtgaagtctcctctctggtttgtaggaagttgaattggtgttattcctgcatttttttcttccacagtgtttatgaatgaattcag

SEQ ID NO: 4123 - DNA, 6938 bp, Homo sapiens
ttgttggctttcaatgtagttgtctgttatgagagacagtttttctttcagaggagcttgtaactgattaggtgggattccaaggaaaaagagacttttgaatcaacccagttgaaagaaagatgacagcagccctgaggaagaaacttcttgtacactttcttacacagaaagcattttgcttttgttgctaaagatttggtttgaatgaaagatgctgatcagaaccaatggggatcagatagacaagctcccagcatggagtggctgtcacggccgtgatgaaaacagggccccttcagtgtggaaccgtgggagacgcggaacacaacacagggtggtggattcctgggcggagctctgcctgccccacgggcctgtggtctgctctgtctgccggggcccagtttaccgaactacttggtggccagatagccaccgtagggcgtgagcggccggcacgaaagcccagggcctctgtctcccgggagctgctggcgcggcgcggctgggacacgccgtactcggtgccacgttcttgcccagttcctcgctgtggtgagctgctggctgttaggaagcctttccctcggctgcggccctcccacacggcccccagacccctgactgcagggtgggcgggcgtaccaggggaggcactctggccggcccgcttggcagcagggccacagctcctcctcgcagggctttgtgggattttaaaggatgaatcgtcttgttctccatgctccccctgccgcccatgcgcgccatgctctgtgtgaggatgaattggagggactggccatgagcggtggcttttttcgtgtttggggtcgggagggtgttgggtggaatgaacatcaagggaaccacccattgagcttagaaattcttgccaggcagttggtttgtgtttgtgtttagatgagagcagtgttgattgcagtttgacatctgattttttttttaattgagttggtacaagcaggatgtcattggctaggtgacaaagtcactgggggaccaaataccaagatgcccgttggtgagagagaccctccccaggaccctccccaggcgcctccttctccgtgacgttcaggaccctccccaggcgcctccttccccgtgacgttcaggacccctccccagggccctccccaggcgcctccttccccgtgacgttcaggaccctccccaggcgcctccttccctgtcatgttcaggaccctccccaggcgcctccttccccgtgacgttcaggaccctccccaggcgcctccttccctgtcatgttcaggaccctccccaggcgcctccttccctgtgacattcaagaccctccccagggccctccccaggcgcctccttccccgtgtggttcaggaccctccccaggcgcctccttccccgtgacgttcaggaccctccccagggctctccacaggcgcctccttccacgtgtcgttcaggtgacgaggcgagaccccgcgctggacgtggcactcgggtgttggagtgaggtggcggcgccgtgtgcttgatggtttccatcagagaagagtcagccttcctccagaaggagcgggggatggtggttccccagcccggaaggaaaaggagccgagctctagctgtgatcacggcctcagcctgcctgcctttgtgcatggaaggaacttgctagtgaccgctgctctcctgggcagtgtaagagtgttgtgtggaggccgggggcgctggaggccagtctcgttttcatagcccagatggctcccggcgcaggttgcagtcacctccattactctttcacgagagagctgcagcaatgccatctggggcctggccacacctggtcactggtgtcccgaggcacacaagcagtccctgccggaagctgacacactgtcatggccaagggccacagtgcaggtaccacggtgacccggcttccctgagtccagctcacgcccgttttccttgtctcaaccttcagagcccttccaagcccccactggctgcagcccacccaggggacccacctttagaggctggactcaggcttcactgaggggtgagaagcgcaggtttacaaagctctggctgggaagaaattgagtaaccactccctgagaaacaaacggagacgtttaattacatgaacgcacacattttaaaaaccgcctgtgcactcccggagggcagagcctgcctctctggttatttttgtgtcctccattcacttacaggctgtgacaaaccctgtgcccacgctgcctccactgccgggagactcagggctgggggagacatgccctggtcaccactgcggagactcagggctgggggagacatgccctggccaccagtggtgagccagcgagacaggaccccacgcgcgctgacccggggacgccatggaactcactcgcgattcctgcacgcgcgctgacccggggacgccatggaactcactcgcgattcctgctcacagcacgtttcctgctcgaaaaccaggagagcctccacgtgccgactagctctgtccacacatccattgcgcagctctgcagcggaaggaccttcagtaaagacgctggtttgtaacgagagaagcgttccaaagtgtcacacgacattgtttattactaaaaggagcagaatttctttttaatcttgacagtgttgttttcgtaacagtatgatttaaactgttacattcatttaggaaaactttttttcatttcataagtaatcaagctatctttccagcttaaaagcaaagaaaaaaggctcagggtaactttttaaaccacttcatcaataagaaaagttctctctgtcattgcacggcgtgattgtacacagtattagcaagcagttcacatgcgccagggccgacttggaaggaaacacaggttaacactgtttcctgtccgagttcacagagatgtttgcagcaggctcagttgctttggcagctggagcgagggtgcctcttccgcgtggctcccctgagcagagaggcccctgtggtttttttctccgccgggctctggggacagggtttctgtggaaatggcaaatggtgcagatgagcagagtcctgctagagaggtcagctcagcgtccaggagggggcgcctgcccccgaggaggccacggacatgcctgggaagttgctgccggagaagtgtgctctgatgtggctacatttggggacgcgggctccccagaggcccaagcgagaaagccgggggttcccaggctgggggtgcaggacgggccaggcactgccctgcagggcccgcccccctgcccctgcaccctcacacccatcttcctctctcagcctgaccccagggcctgggagcccccggcagaccggccctccttgccaaacagtggctgccctttatggactcggcgcctggcagagccactgtggaggaggagttggctgtcatggtcaggggaggcagcccttgggttgtcaaggttggtggtcaacgttgaacccatatctgctggaatctcccggtctgttccacacacgatcatgcgggaagctctgggacccgaaggctgttctgatctcgggggtcacaagttctcacagcagcctggggtcaccagggaccagacccggcgttagcctctgtaaggagctgcctggctgctgggctgagctttgttgcaggcccaggaagatgaccaagaaggacagagcagagccccatctaccactgctgggagggcccgagggagcacgtgcacagcagagccccatcctccactccctgggctcgaagaggcttcctcggtgtggatggcagctgttaacgagcagtggtggtgcagctggaggcctctgtcccatggggcacagacgggagaaggatggcggacgggtgtgcacgcttgggaggacgggcgggcggcataggcctgagcaggtggcatgggcgcacgagaagggtgtgtctgagacaggatgtttatcccaaatgccaggagtggacgaggcggacgagtggcagtgaggctgagccagcaacctccttggcacctggggacagtcgcttcctcagtttctgcgtaccgactgcctcacctgacacgcggcctgggcgcgagagaagccaaccaggtgcctgagttgactgactccttccgccctccagcttcctccctccgccctccaacctcctccctccaccctccaacctcctccctccgccctccaacctcctccctctgccctgcaacctcctcccctctgccctccaacctcctccctccgccctccaatctcctccctctgccctgcatcctcctcccctccgccctccaacctcctccctccgccctccaacctcctccctccgccctccaacctcctccctccgccctctgccctcctccctctgccctccagcgttctccctcctccctccaccctgtttcctccctccacctcttctctcctccctccaccctcttccttctaccctcttccctctgccctcttcttctgccctcctccctccaccctctttcctccctcctccctccaccctctgccctcctccctctaccccctgccctcctccctccgccttatctggaatcggggtcttggtcctgggctggaggcagaccctggcccgggcgaggttaaaggtactgcaggagggcggcatcatgatgtcctgaagcttgttgcgcccggtgctgtcggccggctgaaggcagaaacagtcacagcacctgcagctatggaaggcgacgactgaaaatctaataggcaccttgatgtcaagtttccaagaccaaaggcaagaacagtcagatcaaacttcggaagagtcagagaaagtgagcatgacctagaggagggagacggtccttccgctgtctcctgcagagcgtctgtcgcacgtatgaggtgaaatccgcactgtcccatgaagactgtgaggggagttgccacccgcacacggcccaggagcgccagcagcttggggaccaccacaggcctcagggtctcttcagtccgacgggtccagctgtcgataaaacctcccggggaaggagtaaaggacaaccaagaacctgaactgcaaaagtatgaaaaacatttcatttccctcgagttctccacactttaggtctgcagcgccttgggggtgactgatggccctccgtgagacgcggtggccatgtgcttctacaagtgaaaaggagcaagtgtggttagagcctggagtatggacgtcccggggaccgctggcccatggcctggcttggggccttacaggggagcgagctgagtgaatgcaggggagggcccgtctttctacagtgtgtatcttgtttttgagacagactcactctgtcgtccaggctggagtgcagtggcgcgatctctgctcactgcaacctctgcctcccgggttcaagcgattctcctgcctcagcctcctcagtagctgggattacaggcacctgccaccacgcctggctaatttttgtattttttttttagtagagatggggtttcactatgttggtcaggctggcctcgagctcctgacctcaggtgatccacctgccttggcctcccaaagtgctgggattacaggcatgagccaccgcgcccggccctgccctgcttttctacatcaccactgtcttgtcagttagctcggctcaggcattgcatgcctgatctgtatctttgggaatcctgtgaggtaatggttctagatccaaaagaatggataaagagactgtttcagttcccgaaattatccaggcacattctgtgcgctactgaacttcagaaagcaccagtccatccagtgtgcagaggctggtaagtaaaacaggccagccgtgggcacagacagtttcaccagaggccccggggcagagggtcttctccagctcttccagggcggggctcatctgttcctgggccagaggtggacctgtctgcaggcttgtaagggtggggagacgccagcctggcccatgggctgtccacacccaccccccgcagaccgcgctgctgtctgcaggggatgccaccacttcctcctggcctcgggtgcacaggtgaaacatgaagaagctattggggcggaaaatggctctcaccaggctgctctcgggttaatgaaaactcgtcaaattctccatgcagcagcagccagccgggcacatgctgtcctgccctgcccgactgtgtgcagggaagcaggtcccctgggcctgggcggagggactgcgtgcctgtcagggaaggccgaggctccggacaggcgggaagcagccttctgcttaatcaccccatgtggaaaccaattaaagattcgattctctcagacccggggcattttagccttggttgaatcctcctggaattcacagggaagtggctttgccctctgccctcgctgctggaaggcaaggggccgttctcgccttggttttctaggttgtgttgcggcaggagctgactgcccctaggcctagatctctgcacaacttcgctcagggacacctgcctctgtgcatgtctcatggtgtgaatgtgtttcctgctcacaggtaccgttttgtgtcatgcagttactggaatgtacaaaagcagctgtgatctttgtgagagctgcacagagcaggagtctgagagctgcacagagcaggagtctttatttggttcacttctggtctgcagcaaccacttgctactaaaagatggaaaagatgtacaaaaatgtcacagccctttagaaagcgacattatcagaaatgtatgaccttcagtcctccctccctctcctatgcccccaccagaccaggcggcgagaaggaacagggagtgaacatgtaacggaaaacaataaaactgaatttaactggaacat

SEQ ID NO: 4124 - DNA, 856 bp, Homo sapiens
gcgcagggcccccgcctggctctacaagcccgggccgcggcccccgccttccccgccgcctcccggcgctccgtgcccgccccacgaggccggcggctgctgctacctggggccgttgctgcttgtgccgtgagcgacggccagccattgtccccgccgctccgtcagccgcgcccggccgcgcgcgcaccggaaggcgcattggcgtcttgcgggctccgggccgggtgggcaggatggcctccacaagccgcatggcgcgcatggggagcctccgttgatgccgccgcgccgccctccgaggctgcatccgcggaagcccggctccccgagcgctccggcccggcccggcgccccggacctgagtgcgtccccatgaaggcgcccgggctggcccaggcggccgtggcagaggagaccccggactgggcgcccgagctctgccccagctccgaggcgcggtcgccggagccgcctgccaaccgccttcaagacttcgacacgctggtcaccgtgggaaagcaactagaagccatttgtgtcaagaaaaacgttgacctcttggcgagaatgcaaagaagggaacgcttgcttatacgctgttggtgaactgtcacccctacaactcagcttgcaaccagccctggccaccagtttccccacactgagctgaatatcggacatgcccatctcagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 4125 - DNA, 1808 bp, Homo sapiens
ttgcttccccatgtctcaatttgttaaatcttattgttctatgtaatttgaattgctacatcctttctgttgactagctccttgctcagaataacttttccacacctggaactttggcgtaggagttcttttcacttttatgcatttcccgcgacattacagggtgagtacgtagcagatgagtgcttgtgagcctttcctctgggattcacacagatggctcactcctaactttggtgagtcattcagtggccagatgtttgcctctttcctcctccccactctacccccacaattcagtgtactgttctttgaatgacatcccctcttgtttttgcctctctttctcctgatgcaatggccaaaatgctggaaatggctgccttaaatgtagggaccattaggatctcgctcaacacagaacccaggccacctgtaataacacagctggctcccagtcctgaaaccctgcctttctgccctgaatggggtgcagagaaccagtccagacacctgaaactgccacccttcttcatctgtaggtgcaggggccctctgtatcaggaagagagcctctctgaaatccactgtcattctgggcttttcctggaccagctctccttacctacccccttctctagcctgtcagtttcactcattcattggacatttataagcactaagtatgtaccaggcatcatgctggcctttggtggtaccaacaaataaagagactgctaaatgcagaaaaataggcacagagtaaagacttgtaagtctgtaaaggagtgctcagtgagaagtcacacaagctaagtttccaaggaccatttgcagatcactgctgaacattctccatcctgcctactttgtattagaggacttcttgcagggagaaatataatcagcaggatcctcgctcagagacctggcagacaccaccttaacccagtgatcaaagttaacctccccagtacatgtacaactactgctgccctgaaaggatgcactgagaacatttctgtgtcatttctaccacagatgcgctacttgaatctaattatgaagagacaagagacaaacccagattgaggggcattcagcaaaataattgccctgtactctttaaaaaacggcaatgttgagaaagacaaagaaagactgaggagctattccagttaaagtaggctagagacactgggaaccaaatgtgatgcatgatccaggatattcttttattacaatgagcatcattgggacagttggtaaaatgtgaatattgtctgaagagtataatattgtatcaaagttaatttcctggtcttgaggattgtactgtggttatgtaagagaatgtccttgtttttaggaaatagatgttgaaatatcttgagataaagagcattatgtcggcgacttattatcaaatagtacaggaaaatgagtgtgtgtgtgtgtgtgtgtgtgtgtgtgtgtggagagagagagagaagggagggacagagggacagagagatataaaaccaatgcacctgggtgcggtggctcacgcctgtaatcccagcactttgggaggccagggtgggcagatcatgaggtcagaagttcgagaccagcctaaccaacatggtgaaaccccgtctctacaaaaatacaaaaatcagccaggcgtggtggcacgcgcctgtaatcccagctactcaggaggctgaggcaggagaattgcttgaacccaggaggcggaggttgcagtgagccaagatcacgccactgcactccagcctggtgacagagcaagactctgtctc

SEQ ID NO: 4126 - DNA, 895 bp, Homo sapiens
ggcgggagggacacgccgatgggaacatcccagctggtccaggcctctgctccccccagctcctcctccctggcgggcagctcttctgggctcctgaggtgctgcgcagccccttccctggccctgggacccccagtgcctgagatgaaagaggagttgcttccatggacggtcccagtgcaagctggggggcgctggcctcaggacaccaggcatccaagacatagggacaccagaagccccggctctgcctctgaggtccagcagccccaaagcccctgctcagaagccagcgatgggagggcagggcctgcctgtgggacccatcatgggcgcagcaatcgccaggccctgggcagacagcagcacagcctgtgagtccagggctggggagcaggcaggtgacaaccagtgtcctactttcctgcattaaaacacccaaatcaacaggacggagaaggcccggaagaggggacctgagggagccagccgggcgctcagcctgcttcgctgggatgcttgtcgaggtcgggacggcaccaccaaactcacctctgtgcgccctgcggggcccaggagactcggtcctccctgggctcccccaggcctggggtggacgttggaataaagtggggacaacacgatgagagaccccagccctggaggtgccctcggccaaagcccgagatcaaagctgggagattcgtggctggacagcaccacctggtggacacgttggagattaccaaagccgaacagtcaattcgttcttggttctgggattttcttaattgggtcttagctgggccttcctttctctttccccagtagcaggggctttgtgactatcagaaacacctgccaggcctgggcaatatggcgagacctcatctct

SEQ ID NO: 4127 - DNA, 2828 bp, Homo sapiens
aacacaggttggccaggtgcccgtcacaccagccccaagtgccccaggggtcgtgcagacctgtccaggtgtgctgctgaccagcagggctggccgctcatggagacgcatcaccagcccgctcccagcatcctgctccatgaaggctgaccgctccatggctgggtcctcaggttctgagctgaaggaggagaaaaaaaccctgtgagaggccacagagcaggcccaggacccagaacgggcatctcctgccatggcaaggcctgcaggctcccaacagttggggtgcccagccgcatcagcagcaccaggccacccctgccaatcgaggcatgggcttgctttctctaatattgtttctgggtgctaaggttacaacagcaaacaagactgactcattccttttctccacgggacttactgtcttatcatcccctggactcaagatgagggtgctaggatgccctcccacaccaccccagcttacccaggggcacacctcagggtatgtggacctgcacaaaggtcccttccttagccccatgagacaccccaggggacacacaggtccacagatcctgccacaggcctgggaacccattggcaggagagtaagacagtgcaggggtccacaaacatttcttaaggggccagagagtaaatacttcaggctttgcaggccagacgttctctgttgcaaaacgcaattctgctattgtagctcaaaggcggctatagacaactcagaagttaatgagtgtgttgtgtcccaatgaaacttgatttacaaaagcaggagactggcctgtagccttagtttgccaacccctggatgagtgggttcccaggtctgcagtgagaaggggagaggccagggcagtggcgagcaggagagaaggcagctgaggatgggaggcctaccaggccctgaacagagagtgcgtgctgcccaccttcatgaggagccggtgctgcaggtccagaggtgcctctttaaagaaagatgccagcttgtcgtagacggtcacagccctgcaatgaaatcatggcaggactattgcattagtccagcgtggaggctactttctgctcaaaccactcatttgggtcccgtgcccaacgtcacccatcctcagcaaaaccaccattatttccttctgcctggtttccagaaagttcccctaaagccctgaggaatcaccgaatgaaaggggctttttacaaacaggaaacttaagtggagtgccaatacacaacatggattgcagcaggctcggtctaagataaaaccagacggtggacaacaggccaggtaagacccacatggtctgcactccctggttctgttattgtgtggaggaatgtcttagtctgttgctcctgtgggtgtagctaaagcacaaaccaggagtcctcatccttagaaagcagttagacagacatctgagaaccaatcccaaactgcagccttccacagaaccttctggaaccttctggaatgcaacttattactgccagagggtctttgatgagagtctactctccaccatttgtcttcagagagaatacccacctattctctttccgtggaaaggtaagttattggagtttatgcagtctggtatattaattgagagctttacttcaaagaatgtcacgtttatggttcagtctcacagactgggttaaaaaggcagtgttgactattaagttgtaaattactatgatgatcattattattgaagcaagctgtgagaaatgagcattatcttacaatatctgcattttagtgaacctgaaggaagagtgtattgctggaattacagaagcctgagaaccacaggggaattctcactgcagggtattcagggtcaaaagctgattctattttgcatgctcaatccttcgtcaatttatttttatttctttctttattttttgagacagggtcttactctgtcgcccaggctggaaggccttggtgcaatctcagctcactgcaacctcgcctcccgggttcaagtgattctcctgcctcagcctcccacgtgactgggattacaggtttttgcttgtctgatgactgatggctccacccagacctgccaaccactcccgcggccccatccagaagtggctcagcgtgcatgaggaccatctccaacatccctgtgattgtacccccaaccaaccagcagcaagaacctattgcctagtcacctcccctctctttccccaactatcattgaaaaagtctggcttccaaattttccgggagactgatttgggtaataataaaactccagtcttctgttcagccagctctgcatgaattaagctctttctctattgcaattttcctgtcttgataaattgtctctacctgggcagggggcaaaatgaacccatagggtggttacagtaccttgctgggtcacttgatattcctggagggtcacgggaagcgctatgtgaatcccacttctgatattgtaagattctctccagggcctgaaagcttaaggggttgagcaactcctcccttctcaggcccagccccagggcgcaaggccgcttgcatcagcagcgtgcgtgagcagatgcgccagcaagatagcaaaagcaggaagagagccagccggaagacaagtacctctgaagatggagaaagaggccatctgggtacaacgttgcagttacgtcagaccaggacacttcctgtttacaggagactataaaacctttgccccatcctcacttggggctgacgccgttttaggcctcagcccgccagcacccaggctctcattaaaacagcatgttgctcc

SEQ ID NO: 4128 - DNA, 547 bp, Homo sapiens
ctgacatcctgcagcacaatcacccggttgtgggcctccttcaggttggaagtgaacatggatcggaagaagcagctctgagctgagaggaccagccgatggagctgaaactcccggccttccaccgaaatggtgacatcagcaaagagctcctcctctagacacagtttcatgatgccttgagccacacggcctgaatgtgaccgatctttgaaagtgtagttcacaaagtagttctcatccatggatgctccaggctcctctggtgattccatgctagccaacttctctctctgccagctgtctgcaaagcaacaccatcttgagtaacctgaggaattcacagccatagtctgtgaatccaactgtccaactcagggagggaaaaggaagaagtgagagcaaagtgggtccagattggccttagtcctggccctatccatgatgtccctgacgctatcctttaaccaaatctgggttcgttatccccagtggcgcccctccgctaatgatataaataaaagttccaactctgggtgttttcctg

SEQ ID NO: 4129 - DNA, 1814 bp, Homo sapiens
tggcctgagagtagccacttgtccgcaatcacagggacgttttatgcctgtcaagggagcttcctctctcctcttcctccccctcccaccttctgcctggcagctttgccttctctccaagagaagggtccacccaatcagaactcctcttccttttcattcctggattaaagcacttgtaatcagtaaccagaaagttccagagcgggagagaccggaaggcactggagtgctatcggacgggtgtctggggcagagccaggagggcgagcctcttctctccccgcctgcccttgctcacttccccctccatgccaggtgctgtgggagcagctgggcctggccggggtcggcgggtgaagctatccgcatggtgtctggagcaccgtttctttgcttcctggatgggctggatgggctcccgtgttcttcaccaatggcagcgttaccagcaccaatggcagcgttaccagcaagaaggcaaaggcaggagcacatcgagggtgggagccagggctgtggggtcaggagtcccgctccttgccgcgggaagcctggctcagccacctccagcacacttcggctttgtccagcataaaaggcagagcgacgttttcactgcaggctgtttcccaccagggcaagtgggacagggcgagtgctgacgtctgcaggcatggtgtgcatttaggggtgggcggcaccgagggggcatcatttggcataggcgggcccgggggccactgggctagatgactggctggttgctgggggcaggtgtcacagcctctctgagcaccctctaagtggaggacagaacattgttgggaggagtccaggcataaagtgacataaacagcgcagagaatgggaccagcgcacctgagaggtgatcattagcctcagcaactggatgggacattccgaagagctcccagccaacacagatggtcactccagaggctgacatttaaaaggaaggggcccggccgggcacagtggctcacgcctgtaatcacaacactttgggaggctgaggcgggcagatcaactggggtcaggagttcaaaaccagcctggccaacatggtgaaaccgcatctctgctgaaaatacaaaaaattagccaggcatggtggtgggcacctgtaatcccagctactcaggaggctgaggtaggaggatcgcttgaacccaggaagtagaggttgcagtgagccgagattgtgccattgcactccagcctgggcgacaagcgaaacttcgtctcaaaataaataaaagtaaggggcacagggagggggccccagctcgtgccccttctgtgtgggctgcacatggtgacttccttccagagagcacagagtgggaggtaggcaaggcgtctccacagtggagagcccgacccactgtctcagcccagaggtcaaggctggcaccatcaccgagaggtcacacgggcagatgtgacagggcgcttcaccactgggctcttcctcccagacccataacccttgtcttagtattagaaaaacactggcagaccgggcgcagtggcttacacctgtaatcgcagcattttgggaggccgaggtgggaagattgttcaagagcagtctgggcaacatggtgagaccccatctctacaaaaaaaattttttttttaattagccaggcgtgatggcacatgcctgtggtcctagccactagaggctgaggtgggaggatcactggagcccaggaggtcaaggctgcagtgagctgtgatcacaccactgcactccagccttggcgacaaaccaagaccctgtctcg

SEQ ID NO: 4130 - DNA, 1500 bp, Homo sapiens
aagagcggaggtagagggaacgacgcatgcttgagaaatggcgggaaacagaggaggctcgaggcttgctcacacgcacacagccaactgcttctggaccgccttgctcacacgcacacagccaactgcttctggaccgcctgaaaggcaacctcgcccgccgcggtggtgtggggcgggcatcccttgagactgtgctctggaggcctggagaaacagctttctatcctcagcactggggagagcaggcctcaatccctgcctttgcctgccgcccctcttccttccctctcaaagcatacccagcagccccggcgctgagaaacgcgttactctcttatcagctgtgggagagacaagacagactggcctctgggcggaggggccgccattgcctgccctctggaccagggcctcacagataccctcagcttcaggattagggctgcgttggtttttccccccacatcaggggacttcaacaagtaacctccagttccatagataaaacttgtattccccccttctccatggcaggggttttgagcctagagaaggaagatcggagcttcctggggctcctgtgaagcaggcagggggcagcactgggccccgggaagaggcggagaaggcgagggagtgcctgcggtgagcccagagccttgggcccgttatcctctgatgctgctcccccaactttcctgccgtcagtccctgaccttgcctgagaccttggcggctcccgcacctctctcccggctcctccttgctgagaacacaacccgcaaggcccttccgcctggctggactgagtcccctatggaggcagcctggcagggagcaggtatcttcctggcagaagaggacagacctggtaaactgagagactgttgatgccccaatgttctgcctagcctgcctggaaactccagaaggccacaacaactggattctcttttctgatttttgctgcagcttctgctttgtaatcatacggacagttgtgcttgtcagagttaacggtgaagtccacaaaacaaatttccacatcggcagtcaaacctgtgggtcattggagtggtcctgagctggagaagcaaaagaagagttagcgatccatggaaatgcaaagctgacttcagggtcctgtgtcattccttgtgacactgagtagagtgagggtcctgttgccattggacagctgcagcctgggactgaccgggaggctctgattgtttatccaccacagaccaggatctcccctctgggctgcagatgcctaagaagaaaggaactgaaccaactctggtattggggtccacagatgccaaataaggcccctggagtagaggagaggttaagactgtggctgaagacaaatctcctgtaactgatcttccagttacggtctgtgtgaccttgatatagtgactgtatttattgccatgtggctcagtttcccctcagtgaaatagtataaatggttaatggttttggctt

SEQ ID NO: 4131 - DNA, 1989 bp, Homo sapiens
cattcttgtaacccaggctggagtgcggtggcgtgatctccgctcactgcaacctctgcctactgggttcaagcgattctcctgcctgattctcccaagtagctgggattacaggtgctcactaccatgttggctaattttttgtatttttagtagagatggggctttaccatgttggtcaggctggtcttgaactcctgacctcaagtgatccgcccacctcggcctcccaaaatgctgagattacaggtgtgagccaccgtgcccagtctaaggcacacaatttgcaaaggaaattgaggctctcgcacaaatccagtccaccctgtacttacacccaacatgcaggaggtgttgactctcatcccttgactcaggacatgtgtgtaattgttaatgtcatcgcaaggccttttgacaagtgtaattgtgacatataccttggcctagcatctgagttatttgttgtttcctgggtccagctcacagtgccatatcactggatccagacccttggtaatgtgattctattctgccttgatacagcccacaggggtcattgtgacatcgctgggcattgcacctaggtgatttgagtctcctcttctgccttggtgctgcccacaggtgtattgtgacatattgctgggcgtatgttatgtgactcttgcttgtgccctaaacacataggccattgtaacattgctgagtgcaacacccaggtgatgtaacgcttcaccctggacctgtctacagagggcattgtaatatatgtcttcaccaatcacccaggaaatgtgactttttattcctccctgttctgtactcacagggggtattgggacatattgggcccagcacctagctgatgtgacttttctttattctaggttctgacaacaaaggagattgtgacatattgctgggcctaacactaaggtgatgttagttatttgctttggctgtgcccttggaaggcattgagacatactgctgtgcccagcaccaagatgatgtaacgtgactcttctgcttcaggcctgccaaaagaaaagattgtgacagatcactggacccagcacctaggtgatatgactctcctcatttgcctgagacctgcatattttagacattgtgatatacaactggaacaaacacctaggggttggaaggctcctgcctgagtccctcccacaggaggccttgtgatgtttttttgtttgttttttgttttctttgagatggagttttgttattgttgcccagactggcatgcggtggcgcaaccttggctcaccgcaacctccgcctcccgggttcaagcagttctcctgcctcaacctcccgagtagctgggattacaggcatctgccaccatgcccggctaattttctatttttaatagagacggggtttctccatgttggtcaggctggtctcaaactcctgaaatcaggtgatccacctgccttggcctcccaaaatgctgggattacagttgtgagccactgcacccagctttgtgatgtatttctgcatccatcatgcaggagataaaactctgtatttttgcctgcattctgcccacagggaagattttgacatattgttgggcccagcaaccagtcgttttgtctgtcatatctgggcccagcacccaagggatctcactcttctacctgtgccctgctttcaggagggattgtaacatccctggtcaagcccccagtgatgtgattctcctgtttgatgcctgccctcagggaggattgtgacatagccctggcccaacacacagttcatgtaactcttgaatttgctctttacatacaggtaggattgtgacatatatctggccaagcgtacagatgtaatgatgactgtcataccttgaagaagccaatagcagagagaatgttgctctcaggcttaggaaaatgaggaagtctttctgtacaaaagtcataaagaattactactctctcacat

SEQ ID NO: 4132 - DNA, 933 bp, Homo sapiens
gtgggatgtctctctctcccccactctctgtttccctttctttttttgtcccctctctccagggctcctgatttctcttcagcctgacgctcttttcagttaacggcaaggcggtgcacccaagtccggtggtgtcctacctggtgacctcctacctgtgctgggacgccagcgacttgatgctgcactccggagccgtgtcctacctaagcccagtgggcatgtgaagcagagggcagcccttgaatgcgcggcggctgagctaccgcgggtgggccgtgcagcagggcgcagcgaggcggacatccaaacagcggaactcagacgctgactccgagcgcaccccgggccttcccatttcatacaccctcgaggatgagacccaagcacctccaaggaatagcacccgaggtcttcaggacaccgaccggtagccatggccagatgcccggccaaccccttcagcgtggccacgccctggatattcgacctcccctgaggccccaccccctgatatcaggccacgccctccgaggggaccggtggcaaactccagccctcgctctagggcccgccctttgcggctttgtccctgcccactgggtcctcacagtacctccaccccagaggcccagcatcccctcccgttctgcagacacttgtccagcgtcccgctgagctcggcagtgtggctagtttgtgtggccctgcccctggtgcccagccagggtggtctgcatggaacttctttcccggagttccggcctcagctccgatgtccacccttgtccccaggtggacacagcaccgcccagcatttggtgcaactccacccttctgcagaacgggcccctccctgggaaggcatggcttgcaataacatccctctgtaccttttctggcttccccgccacaataaaacctctcagcctc

SEQ ID NO: 4133 - DNA, 1860 bp, Homo sapiens
gcttcttttttaatttttgttttttaaatttttatttcaatagtttttgggatacaagtggttgtttacatggataagttctttaacggtgatttctgagattttagtgtacctgtctcccaagcagtgtgcactgtacccaatatgtagtcttttatccctcacccccgtcccaaccttccccctccgagtccctaaagtccattgtatcattcttacgcctttgcatcctgtgcttctttcttgcctcccatcaacacattctcctactgaagtatggtctttctaaactataaatgtaccactcccctgatcttactgttgccaagccaaattcctaggtcttataaacaagactggcttctttattgctccaaacttatatccctagcttaccatgcttttctcatttttatgccctcactcatgatgttctctctgcttgaaatctatcacatccttctgccccaactccttttacaagtaaactttctcttgaaagctgagccagatcaaatctagataggtgcctctcctcctagtgcctaaagtcctttatctagctgaattgtaattgcctcttatctctcccattagactatgtgtttaaagaagacagacctatgtcttagtttactgtatattcatagtgcctagcatattcatttaataaatgaatttttaataggcacttgattaatggttattgaattgtgttttcagagaattaaaaacaaagcctaggaaaacaggttaacaatgggaaatcatggaaggttcatgatcaggaaagtaacaggaatatgaagaagactggtcagattccacaactctgagccacaattatctttggaaggagtcatttacctgcatgtttaaaggtcacagcataactgtttcccttccttattcttctatccctgcaattatcttctctttctaccctctcctttagctatcacatctactgctaccacttcctttttcacttctgcagatgagttcctaattggtttcctgaagtaatttttaaatgacctctaaaatacaggattttccagtatcgacctagtctcctaggactgtattttaacccagcacttccacactggaaagtactattaaaaaaataactaaaaatgtgtaaaacaatttagcttcaagaatattacacaccactgtaaagtcagaaacctaaatgtatgagaatttagtatataaataatagcattaatatcgtagcactttgggaggccaagacagacagatcacctgaggccaagagtacgagaccagcctggcaacacggcaagactccatctctaccaaaaaaaaaaaaaaaactttaaaaactagacgggcatggtggtgtgcacctatagtcctagctactcaggaggctgaggcaggaggatcgcccaggtcaaagttgtagtaagccataagcacaccactgcactccaacctgggcaacagagcaagaccctgtttcaaaaaatatatatagcattaccacttaaagaatattacacagccaataaaaaaggatattatatagaatatctaaggagagaaacaagatggttaggggacagtgatgagacttactttttaccacatactcttttgtaccttttgtatttgtacctcatacatgtattacctagtcaaaaaaaaaaagaaaatttaaaaaaataagcttacttttgaaatattatataggtgtattacttcttgattcacaaagatgtacaacacattgttaggtgaaaaacgaaaccacaaaacagtattacagtattgtaatattaacgtgggcaacgggtgtatacatttaagcataatattcactagaggatt

SEQ ID NO: 4134 - DNA, 1933 bp, Homo sapiens
cttcctttccatcctccctggtcaggggagcccaacagcaacgcgagggcacccgaccctctgcctgcacctggagggcgcccgggtccccccaagccacggccaggacgtcgcgtggtggggcagggaaaggggcgccgccgctgctggaaactagccctgtgcgctccgcccgcgctcccctcccggagatgtctcgagcgcctctggcgcgaacaaagcccggccgcccccgagaaacttccgtgcatgaaggtttcctccttgactcggcagcagcggccgccgcagggcacagaggcgggaacgcgcggcgggggaccagggcgtctctctccggagcgctgccgcctcctggactccccgctccagctccaaggaccggcatcgctgccgcagccgggaggccgagaacgcgcggtggcgacgccgccccaggccacgcggcgaggcggttccgaacggactcgggattcgctcctgggcgctgtggggccgagtggagccaagcggccgtttttcagctccgcccttccgaaaggctgccgcagggtcggggccacgtggggcccgcggcagaggggctgggggaacgccacgggcggccctggtgaaggtgcccgccggtctcggcctgacccccaggccctgttctggcacgcgccccacctgcgcgcacagtgagaccggcgccctagcctgggaatccggggaatctccagcccgttgccttttccataaccccgtcttctttttcacactagctctgagggtggaaggcagggaggtgccagccacgttcccttccacagagggaactccctgttggaattcctaccccggcttcctgccgtctgtcctggaacacattgctccaggcctccgagcctcagtttcctcgtttgcaaaatgggggcgataacagagcgtcctcaaaggggataagacggaagaagttggctcatatcagggctcataattgttgccaagtattaacaggtaaccacaatcacactccacaaagcttcccttttagtgtcagtgaaattaatttaaaagaagtttccgaaagtcaagtgtgtgtgtgtgaatcctgagataagtcaggtaaggggggaaatgaccacctcacggccccaggctggtgaggaagtcctagccacggaggcggtgctgcaggacctggcctggtggcatagcgtggcgggcgggttcaccgtggagagacgaaggaggtgctgcggcttgtgagaaaaggcccacaaccccatgcagttatttatgaaatggttttccttcctccagggcttggggctcctgcccactcgtatcaggtcccgggacccccccggtggtgtcctcagggctcccgccgtcccaggccgccctccacttctggaagcagacacgaggccacgagacccactgcttttgggtatctgctttcattcctgacactgccctttaagagaaaaaagtacccacattgttcccagatggagagggtccctcccagagggtgaggcactgccacaggggctcacggccctgccaggagtggaaggtgcacacccagaagtatttctcctgtgaaggaagggggctgagcttcgctgcagacctggcctcaggtgtggatgagcttcgctgcagacctggcctcaggtgcggagtctgcgggagcagcatttccaggcagacctgacagaaggtgcctttgagaggtggtgagctccgtgttacaggaggcttgtgagcacaggtagcccatcttctggtgatgatgctggagaagcaattcaaatgtcagaagcaggactggactctgtttccaaaactcacgtctggattctaccccctgaaaacattatttacacaatgtttttcctttaaacaattcacacatttgattaaaagggtaagtttatttttt

SEQ ID NO: 4135 - DNA, 1572 bp, Homo sapiens
tctatttttttttttaattttttgattacggccattcttacaggagtaaggtggtatcatattgtgcttttgatttgcatttcccagatcacagctatttaaaacaaaacaaaaacctaaatttaaaggcctggaataaatcttaggcctaccattatcttcctcaaactagttcaagttctttagttcatttctatttcacaaagatgtttaccaacattactgactcaaacagactatggtcaatccagtcattttctcactctgccatctgtcaaaacaagttgatttttgctcactagagaacatattcataatgcagcaaaataaacttgtatgcagcttattttcggaagtttaaattttattactactttttaaacacagggctgcatttgacatgtttacactcattcccagtgatttccagcagtggacagtaaagtcatttagaaatttgactgcaagcaaattattaccatgccaaactattaaaacacattattgactgattgactgacaaggtctctgtcacccaagctggagcacagcagcacaatcatggctcactgcagccttgacctctcgggttcaggtgatcctcccacctcaacctcccaagtagctaggactataggtgcatgccatcacgtccagctaatttttgtatttttcggagagacagggtttcaccatgttgccccactagtcttggaactcctggactcaagtgatccacctaccttggcctcccagagtggtgggaacaggcatgagccaccacacagggccctaaaacacatttttttaaaacacatttggctatttagtttttattttcaccaaaatggacatgaggaaactatggatcagatataagaggactgccttaccaataggtcattattctttttgcatcaactgccttcccaaccactgaccaatataataaagactacagaactacctctcaataagaagcaggaacataaccttaaaccagtatcttccttgttacgttcttcctaactacttataaaatctccagttctcttcctactacataaccttcccacaatcaaaccaacagctcaaagacatctaaaattacaagatcatttcattacgtgctcctaaaagctgctcctacaacttagacaactacttagggaagaaagaataaaatgttaactaatctgatgctcccatttgctataaggaaacagcctattttgatgctaaaaaggaacttaatttaaaataattccaatcactttgtgctcaaattgagctagacaaaaaatctaatcatactaaagctcctcagaaacctaacaaaaagtatcagaaactatgctgattactctggaggaggatgccttctacctctcctcatcctcttatcccacctttttgcctcctacaagttatccacaaaatattaagtaactaatcttgtacttgcaaagtggcagagttccatatggacttaagaatgtctgatggaaattactttcattatattcaaattagtagcctagaaacaaaagctaaatattgtattaatttcct

SEQ ID NO: 4136 - DNA, 1328 bp, Homo sapiens
tgtgtgcaacaatggcaatggctgtcctcatactgtctcgctcaagatcagcttcaaatgctgcttccggccaggatgcaggggggaccagttccgcctctagtgtctggggcttagatttctcaggtcatgctgcctctccctatctgacacccagaatctccccagaaagacaagatagacacttccctgagattagaagctagctattcaatctaggtgaacatgccattttggagattagacaaactgagccctggaggagtcaaacgactccgagtaacccagccagccactggcacaggtgtggtgaggagccaatgccaaaagtgggtgaaagagctgggcaatgttcccaggctggcagccaggaaaccagggcttggggtccctggatcctcaggtgcggtgaagaggcaaggccaaaagtgggtgaaagagctgggcaacattcccaggctagcagtcgggagagaccagggtttggggtcactggatcctggctctgctactgaattgctatgtgactgttctgtgcccctgcttcccttgtctggtggctacaggaaggcagatgtggctcatcaccctgcctgtgccatagtctggctgcattactgagtcatttgacctctccagggctcagtttgtctatctccaaaatggcatactcacctagattaatgagctagcccctgatctcatgggagattctttctcatctttctgctgccttctcctccatttctctgctcagaaggggaactgtgtcagcagatcagggctggctattggaggcttttggaagagtaaatccaagtcatagcttcatgtctctctgcgctgggcaggaccaaggctaggcttttttatttcaataggttttggggtacaggtggtttttggttacacgggtaagttctttagtggtgagttctgagattttggtacacctgtcaactgagcagtgtacactgtacccagtatgtagcctctaatccctcaacctctcccaccctcccctgtgagtccccaaagtccattatattattcttcttcacctttgcatcctcatagcttagctcccacttaaaagagagaacatcacaaagtcaggagttcaagaccagccgggccagcatggtgaaaccccgtctctactaaaaatacaaaaattagccaggcatggtggtgtgcgcacctgtagtcccagctacttgggaggctaaggcaggagaattgcttgaacctggtaggcagaggttgcagtgagccgagttcgcatgccactgcactccagcctgggcgacagagcgagactccgtctc

SEQ ID NO: 4137 - DNA, 2558 bp, Homo sapiens
aattagcgtgggaggaagagacagtgaagcagccccttaaaaatggtctttcgggtggaaacactttatttgggaagcaaagtgcaagattcagcaatagaaaccactcagtgtccttggtgaatgatttgatcctggccatcagaacctttacttcagccagcaataaactcttagaaacagaagcttcgaggtatgtactcctgttctgcacgaacaagttttctggttgaacatgctgaacctcttaaaaaattcagaacaagttttctcagagtttacaaagggatttcaatcacatgaagagaggaaaacacactgagtcgtaacagtgacatcaaaatacttttgaagttgactgaaaatgtggttgcttttgtttgagaatggcaaattaaagaattggatattgggttcttatctcagaagaaacaaaggaggagaccctgaaaaactgaacatgaagaggaagaagtggagttatgcaactcttcataagaaaatctccatctgtttggagaagtactgcgtccttccggattatcttctacactatgccttattgttatctggctggttccaccaccggtcagaagaatgaaaattgcagatacctattctgtgtgtttctctccagaatggtggatgttagagaccctactaaggatttgtggactcactaacgtagtctctaaaaggttggacatccctacccaaggctcaaatggtaacaggtccatgccttacttgtgtcagttctcttattgaaagagcatctcctaaccatcctaccaataagggtcttactctgttgccctggctggagtgcagtggcccaatcatagctcactgcagccttgacttcccagcctcagttgatcctcctaccttaatctcccgagtagctgggactgcaggtttacttatactaagattttcttctgcctctgccaaccctgagacagcaagaccaattcctcctctcccctgtcctcctcctcgcctactccacatgaagacaacgaggatgaagaccttcatgatgatccatttccacttaatgaacaaacttcaggaaattattcaagaagagaggcatggtggtatgctggaaagtctgctgagcttgaaagtaggtaacccaggctcctgttcctgttctcattgatgagttccctgacttcaggtgagtcacagcttctctggactttcatgtccttttgcaaagtgagtctgatcatttctaggatcttttccagccctgagattgtatgagctgcaatagctaagagatatgggaaagtgggtcattggaaagttgttttcctaactccacaggcaacaatgtgcctcattcttagtcatcaaaggcaaatacgaagggatgggaagcactctcttcactgtccatttgcaagcagaatcactcttcacttgattgtccagtgtctgtatagtctctcacagagcccagcacatgtgggcattctgtaaatggccattgagaactgccaggtctgtggctgctacagagcacaatgatgatgataatggtgttgatgatcatgatgatgatgggctggtgtatcgaggcacagacccaaggaaggctaatgagaatgtttctagggaagcttcctgcatgtcactcttcttccttctacttcctctaggttcatcttccctgactaacagggagccagggctataataacgggaaggaagtcatcatgtgattctacctagaaacgcaggcatcaacttgaaatgttttctctttctcttgtaactctggaatatggctccttggattggaggtggcaaataccacgggttaaacaatgtcattctgagctcttttagtactgaataatgcaatatataccatattctaccctcttaaagaaggagtgtatcagctatgtgcctgatatggtttggctctatgtccccacccaaatctcatcttgtagcacccataattcccaggttttgtgggagggacccggtgggagatgattgaatcatgggggctggtctttcctgtgctggtcttctgatagtaaatgggtctcacaagatctgatggtttttgaaaacaggagtttctctgcatgagctctctctgcctgctgccatccacttaagatgtgacttgctcgtccatcgccttctgccatgattgtgaggcctccccagccacgtggaacttagctcaggacagcaaccagacctgagattcttttcaacttatacgctgttgatgaatgtggtttctggatgaaaaactgagaacagactgaccctctggccacagctactcgcgtcagggacgcatagttgcaggtgcatgctgtctggtttggtttgccaagtcaaaatagttgtgtttcccgctgtggtgagagtttccaacttcagacggggcaagagaaattctaaacagtttgccctttgcagatgtattgaaatagtactgaaatttactgattttccctcatgttttttttccgtgcttttatcactaccctgaaaataaacaaggagaaaaggcaagc

SEQ ID NO: 4138 - DNA, 1717 bp, Homo sapiens
ggaactttatttttaaagtattctgaaaattttccaagaattttaaccaccacctacttcccttaaacacacacacatttttatcttacaattataacccctattgcagtacaaaacaagaaacaataattctaagttagccagccaatcaaactacttcagtaaatgatcatactacagcctggaatcactcaaacaaaaaattcttctagttctctttaaagatatttatcgtttattttttcatgaaaccaaagtaattgattcaacaatactaacagttctagcatgcaacaaaccatctactatctaatgtttaatcttcttaacatgtatattttcattcctataaagtttccataagaagcttgcaatgacaataaaggtaaataagtacagttgtcccttggtatccatggggtattggttcctggaccgtccccccaacccacagataccaaaaatccaagtatactcaagtcccttacataaaatgacatatttgtatataaccaacgcacatccgcctgtatactttatccctagactaatacctaatgcaatgtaaatgctatttaaataactgttatactgtatttttatttgtattatttttattttttctaatatttttgatctgcaattggtttaatccacagatgcagagtacatggatacagagggccaactgttttgttacaggtacttcaaatagcactacagtacatctttgacaaaatttttacaatattccacctttcaatatgaaacagcttaaaaaggcatgggtcaaaaataaagtatagtagtatcacttacgcaaataaagtctcagaatcatacaagcacaacactgttaggactctccctgtttaggctgggaaaaacattatacaaaacattttcttcaaataaaattacataaattgcttagaaaaatgccaaaatcaataatttcaaacatattaaggagaaaaccttgaacattattggaaaatataaactagttattccttgcttttaacagatgagttcttgacaagttttgtgtaaagcaaattctgtaaaccattatcttgcttgcactggaggaacatatctcaaggaaacctaagagaaagtgttctttaaagcatgtgattctcctgtttttgctggatgtctgtatctacataataaacaggcacacttctacatcactgggtattttactcagactgtcatgtttcatctctgtaaattaaacccaagttacttaaaaatcacctgtggtaaaagaagcaagcagatcacccccacctactatccctcccgcctcccccctgtcaaaagaaagttctcagtttatgatgcaaaacttacaattgttcatttatccacattctcaatagaggattttccactatatttaagtatggcaggataattacccacctgttcctcttttcagcttagaaacataacggttcattccttttattgctagagaatgtcattcctgaagattttataaacaaaggcaaatatgaaggaaaatttgtaattatgaaataagtcctttgtagtaaagaatatttcccaaatcataacagttctatttggaatgatacccacaactctacaagcatcttatccctctacaggaatgactaccttattaattaaaataaaaatttaacaagcatcaaaataaaattctttagcaatagactcctgc

SEQ ID NO: 4139 - DNA, 1047 bp, Homo sapiens
cgcgcgatgggctctgaggcggcgcagctgctggaggctgccgacttcgcggctcgcaagcaccggcagcagcggcggaaggaccccgaggggaccccctacatcaaccaccccatcggtgtggcacggatcctgacccacgaggcgggaatcactgacattgtggtgttacaggcggccctgctccatgacacggtggaggacacagacaccaccctggatgaggtggagctacactttggggcacaagtgcggcgcctggtggaggaggtaacagatgacaagactctgcccaagctggagagaaagaggctgcaggtggagcaagcgccccacagtagccccggggccaaactggtgaagctggcagacaagctgtacaatctgagggacctgaatcgctgcaccccagaggtaaaaatacaatagctgggccaaggggaagttttcaggacagctcattccatcaggaactcatggccttgaaccaagcttgccaggaagtggggaaaaggcagtgctttccttgacatcacgctagcaagtttctgtcgactcttatgcaggatggtcagaacatcgagtccaggaatacttcgagtgggcagcgcaggtggtgaaggggcttcagggaacaaaccggcaactggaagaggctctaaagcatctgttcaagcagcgggggctgacaatctgatcagtgcttgaagctatccagaggcacaactccagcctcgttcaggccggacaggattcatacgccatcttttctgtgtctcctgagctccctccatccttcccagatattagaggccaaaaaaagacttgcattttttctcagtctgaaggtctcctgctaactaagctgagccccgcgtggtgggaatcagatgtacccatccatttctgatgcactcaccgcctctccccaagtcttgggtctgtttgctattttgcatggtgggatctctggcccctcagggacttgagattatttaagtactagttcctaacacgttctggaaaataaaaataactctgggttaa

SEQ ID NO: 4140 - DNA, 926 bp, Homo sapiens
cggccgcagtcgtcggccccatccgcgcgatgggctctgaggcggcgcagctgctggaggctgccgacttcgcggctcgcaagcaccggcagcagcggcggaaggaccccgaggggaccccctacatcaaccaccccatcggtgtggcacggatcctgacccacgaggcgggaatcactgacattgtggtgttacaggcggccctgctccatgacacggtggaggacacagacaccaccctggatgaggtggagctacactttggggcacaagtgcggcgcctggtggaggaggtaacagatgacaagactctgcccaagctggagagaaagaggctgcaggtggagcaagcgccccacagtagccccggggccaaactggtgaagctggcagacaagctgtacaatctgagggacctgaatcgctgcaccccagagggatggtcagaacatcgagtccaggaatacttcgagtgggcagcgcaggtggtgaaggggcttcagggaacaaaccggcaactggaagaggctctaaagcatctgttcaagcagcgggggctgacaatctgatcagtgcttgaagctatccagaggcacaactccagcctcgttcaggccggacaggattcatacgccatcttttctgtgtctcctgagctccctccatccttcccagatattagaggccaaaaaaagacttgcattttttctcagtctgaaggtctcctgctaactaagctgagccccgcgtggtgggaatcagatgtacccatccatttctgatgcactcaccgcctctccccaagtcttgggtctgtttgctattttgcatggtgggatctctggcccctcagggacttgagattatttaagtactagttcctaacacgttctggaaaataaaaataactctgggttaaggtttaa

SEQ ID NO: 4141 - DNA, 5614 bp, Homo sapiens
gccttttccctccggctcgggagcgtctcgcttgcgccccgggcccgcggcgcccgcgcggctgcgagcctcgggtggccgcgtgccggctccaggaagccggagagggcgcggcggccaggatggcgcggcacgggccgtgcggctagacgggagccgagggaaccgccggctcgcgccctccgttctttcccggagccggcttcacgcagggccgggaacggccgtgcctctgggatccgccttcgctgacgccgggcacctacctggacgcgagcgagcgagatgcccaaccccaaaaacagcaaaggcggccgcaaaaacaagcgcgccaacagcagcggcgacgagcaggaaaatggagccggggccctggcagcggcgggcgcggcgggagcggcggccgggggggccctggcggcggcggccggttgcggggcggcggcggcgggcgcgccgggcgccggaggcgcggcgggcgccggaggcgcggggactggcgccgcgaacgctgcggccgccgcgggggctgcggccgcgggcgatgccaaaaacgaagccccatgtgccactcccctgatctgcagcttcggtaggccggtggacctggagaaggacgactaccagaaggtggtgtgcaacaacgagcactgcccctgcagcacctggatgcacctgcagtgcttctacgagtgggagagcagcatcctcgtccagttcaactgcatcggccgcgcgcgcagctggaacgagaagcaatgccgccagaacatgtggacaaagaagggctacgacctggccttccgcttctgctcttgccgctgtggccagggccacttgaagaaggacacagactggtatcaggtgaagcggatgcaggacgagaaaaagaagaagtctggctccgagaagaacacagggaggcctcctggtgaggcggcggaggaggcaaaaaagtgcaggcccccaaataagccccagaaaggcccaagccacgacctcccccgccggcattccatggaccggcagaactcccaggagaaggcagtgggtgccgcagcctacggtgcccgttcccccggtggctccccgggccagtccccacccacgggctactccatcctctctcctgcccacttcagcggcccccgctcctccagatacctcggggagttcttaaagaacgccatccatctggagcctcacaagaaggccatggctgggggccatgtgttcagaaatgcccactttgattacagccctgcggggttggcagttcacagggggggacacttcgacacccccgtgcagttccttcggcggctggacctctccgaactcctcactcacatccccaggcataagctgaacactttccacgtgcgcatggaagacgatgcccaagtgggccagggggaagacttgcggaagttcattctggccgcgctcagtgccagccacagaaacgtggtaaactgtgccctgtgccaccgggcgctcccggtgttcgaacagttcccactggtggatggaactttgttcctaagcccgtcgagacatgatgagatcgaatatgatgttccttgtcaccttcaagggagactcatgcatctgtatgccgtgtgcgtggactgcctggaaggggttcacaagatcatctgcatcaagtgtaagtcacggtgggatggcagctggcaccagctgggcactatgtacacctacgacatcctggctgcctctccatgttgtcaggcccgcctgaactgtaagcactgtgggaagccggtgatcgacgtgaggatcgggatgcagtacttctccgaatatagcaacgtccagcagtgtccacactgtgggaacctggactaccacttcgtgaagccattttcctccttcaaagttctcgaagcttattgatgaaagctttgctttagtaatagctattttattgatattattactttattacatatcttttatagggaaacattctgtgacattaatttcctttctaatttaaaggagagttactttgttgtatgtgtgccactaaaataggggctgcccttgccctgtcttgattcccgagtgttaatctgtggttttgaccagagcccagatgggtaatcctgtgcatttgggttggggttcactcttaccaagaatctttgatgcagctttaagatggtggggaggatggggtgaatttaggaaaggaatttgtggttataaactaagagcttgataggagttggaaggaaactcttactaaaatgttaactttctaaaaaccttcttttagatcttccttgggcctttggaaaaatatgtgacaagtgaatgtaagtctgtgcctggagagctaatagtgcattagtctatctcagcctagtgttctgcagcacacatgggcaggcagtttactcacactgacaggtgacctgaaagtggcacaagtgctgtttctatcactattgtaatttgccagttcatttttcatgctgaaagtaatatccaaattgtaagacatatgaaagatattagtgttgcaaatatgtttaggtaaactgacctataacagaatatgtgaaatgaatttggaaataatgcaagaaggcagaactcaatcatttaaattgtgtctttgaagttggtaatatagcttttaaggagaacccatgaataacctgatttgggcagtgatgatttattacaggttgcactgttgaagtgtcatttggtgtcaggttcttctcacaggtaaatctttcagccacagaatctaactggtgagcttcagaaccaataattgccacatttattgtcctcaaaattgcttatggccatgtataaccaattaattctgagtttccaaaatcaaagatttgaccttaagagggaagggaaaaaagtgtgaaaggatgatgaagaaaataattttactatttcttttaaaagtatgttttggaaaatcaatgattttaatgcatagcagtatgtttgaaaaatagaccattctaaaaagcccatgataccttactgttgatgaaaaaggatgatcatatatatagaacttgattagtcagagcattgggcattccaaaatacagcctttggttcagtagattttaatgctttaaatagactgacgtcgcatacccttatagaattggaatatgatttctcaaaaattaatttgataatttcatgtatgatgtgcatatatgctaaaagaatgcagaaaatcattttatgaatagccaaatttggggttgatgtgaacattttatgttactcatttggtttatacttttttttttttttttttaactgtgtggtttttcttttcagaagtatttaggcaatattgcacgtgagtttcagttctttttttcttttttttgagatggagtctcactcttgtcacccaggctggagtgcagtagtgcgatctcagctcactgcaacctctgcctcctggattcaagcgattctcctgtcccagcctcccaggtagctgggactataggcacgtgccaccacacccggctaattttttgtatttttagtagagacagcgtttcaccatgttagctaggatggtctagatctcctgaccttgtgatctgcctgcctcggcctcccaaagtgctgggattacaggcgtgagtcactgtgcctggccaagtttcagttctatatgaagtatttgatgttttgtttgaaacaatacagcattaaagaaccaatgttattcactaatatcattcatctttcagtttggatgatttggtttgctgcatctaggttggtgtttgatcatctgaaaaaacatttcagtgggaagaaatgcataaaatgcctataagaagtagaaagtcattgaactgacagtgtttgatgcaactaaaagaggattgtaagacatagctttctgcaaacttgtctttaatgcacaaagctgtagtggtgaattaactatctccttattgattctctcctgtacccagatgcaaaaagtgctaagtttctcttgtcctcgtaataccatttggattttatttctgaatttaaatagtaaaatatttatgatgctgatctttaacccacctaaaattttatagtgaaacctgctttatattgttgttctgaagcttacaattgacctatacattgcattcagcaagctcctgaatttagaactgccgtcagtgtagtgtatgctgtgttccatgttgcctttttagatggctttctaccccctgaacaataaataggatgaggttttactgtaattgggtaaagtttactcttggacattatttcgatgctaaagtaaggattctgtggatgttacttaaagagaaaagcataagagcatgaagcatatctgggaatatcttttgcctttaagacgattcattcttgtctagagggaaaatctggctgatttgggaataaaatataatcgaatattcaacaccatgaagataaatcttattttggaaatctactgaccttaataccccaagcttgccctgaatactttgattggaattggaatatatcaaaaaaggttagtatttttgttgtagttaggatactaaaaggatattagttacccaagagatccaatttgtttttctgatgaatagtgttcagtaaaatgaagcagtcttaagagtgactaataatttcaaagtgatttttcgtctattcttaatattttttaattatttatttttaagagttttataccttgagcagatacaatgatctgctttagtgagaggacaatttctgattgattgttttctcttcaggccatctcacctcttcattctcttgttacatttgaagcagttgatataatgggtttatactttaaaagatagacatggtgccatgaagttggggagttgggtgaattatcccattctagttacagaggagctttccttaaatgccctttaacttctaggttttgttcaagaagttcattttctgagtaaaaggtattttcatatatgttgggggaaaattaactcatctaaaaagaatcttattaggtatttgaactctaaaactaacagataagacagatatgtaccttattagagcaccagaactaatttgctaagtcttttgtttagtcctgcaagactgatgcttaatacacagtctgttctcctgtgtctaggtcaggaactccagtttgcttttctgttttgtgtcctggtagcagctgttgagtaactttcattggaggttgggaaggaagtgaggagaaagtgttcttgtttagtgttttatttcctataataggatgctgcctaacccagttcatctctatgtcctgttcactgaatattccgggtaattgaaagaaaatataatggatgggctccattaaaaccagctcaaaaataaattcttgtcagtaaagatttcttgtcaagatgtcttggattgcacttttgttgaggaaagacagtgtaaatagttaaagaatgttgataaaattgaaacatttggttgtggaattgtgtgtggttttagagggtttctgtttgtgaaatgtatgtattaaaaataataaaattccagaaactaa

SEQ ID NO: 4142 - DNA, 3410 bp, Homo sapiens
tgaccggcgacgcgggcaagatggcggcgctgggggtggcggaggccgtggcggccccacacccggctgagggggccgagacggctgaggcggtggagctgagccgcgccctgagccgcctgctgccggggctggaggccgacagcaagccgggccggcggcgcgccttggaggccctgcggcgcgcgctggaggagccaggccctgccgccgaccccaccgctttccagggcccctgggcgcgcctactgctgccgcgcttgctgcgctgcctgagcgaccccgccgagggctgccgcgcgctggcagtgcacctgctggatctgggcctgcgccgcgccgcgcggccccgcgatgccctgccgcgcctgctgcccgcgctcgccgcgcgcttggccggccccgtgcccgcgcgccgcccgcccgaggcctgtgaggagctgcgcctggcgcttgtgcagctgctgggcctggccgtggacctgtgcggcgccgcgctcgcgccccacctggacgacgctctgcgcgcgctgcgctgctccctgctcgaccccttcgccgccgtgcgccgcgagagctgcagctgcgccgccgccctggcgcaggccacgcccgaccacttccacatgcagtcggagtctctgatcgggcccctgatgcagaccatctcccaccagcactggaaggtccgtgtggccgccattgaagccacaggcgcagtgatccattttggcaacgggaagtccgtggacgacgtgctttcccattttgctcagcgactgtttgatgacgtcccgcaggtccggcgggcggtggcctccgtggtgggcggctggctgctgtgtctgcgtgaccgttactccttcttccacaagctcatccctctgctgctcagtagcctcaacgacgaggtgcctgaggtcaggcagctggctgccagcctctgggaggacgttggcctgcagtggcagaaggagaatgaggaggacctgaaggacaagctggactttgcccctcccaccccaccccattaccctccacatgagcgccgccctgtgctgggctgccgggagctcgtcttcaggaacctctccaagatcctccctgccctgtgccacgacatcaccgactgggtggtggggacccgagtgaagtcggcacagctgctcccagtgctgctgctgcatgccgaggaccacgccacgcagcacctggaggtcgtcctccggaccctgttccaggcctgcaccgacgaggaggcagccgtggtccaaagttgtaccagatccgcagagctcgtcgggacgtttgtcagccctgaggtgtttctgaagctgatcttatcgacgctgaagaagacgccctctgcctccggcctcctggtgctggcctccgccatgcggggttgcccccgagaagccctccagccgcacctggcagccatcgccacagagctggcacaggcccacatctgccaggcatctgaaaacgacctctacctggagcgcctgctgctgtgtgtgcaggctctggtgtctgtgtgtcatgaggactgtggcgtggccagcctgcagctcttggacgtgctgctgacaatagtggccctcgcaggtgctaccggcctgagggacaaggcacaggagacgatggactcactggccatggtggagggtgtcagcagctgccaggacctctaccgcaagcacattggtcccctcctggagcgggtgaccgcgtcgcaccttgactggaccgcacactcgccggagctcctgcagttcagtgtcatcgtcgcacagtcaggccctgccctgggagaagccctgccacacgtcgtgcccacgctgagggcctgtctgcagccctcccaagacccgcagatgcgcctgaagctgttctccatcctgtccaccgtgctgctcagagccacggacaccatcaactcccaggggcagtttcccagctacctcgagacggtgacaaaggacatcctggcccccaatctgcagtggcatgcggggaggacagccgcggccatccgcacggctgccgtgtcctgcctctgggcgctcaccagcagcgaggtcctgtcggcagagcagatacgggacgtgcaggaaacactgatgccccaggtcctgaccaccctggaggaggattcgaagatgacgcgactgatctcatgccgtattatcaacacgttcttaaaaacctcgggcggcatgacggatccagagaaactcatcaggatttatcctgaactcttaaaacgcctagatgacgtgtccaacgatgtgaggatggcagccgcctccaccttggtcacctggctgcagtgtgtcaagggtgccaacgcaaaatcctactatcagagcagtgtccagtacctgtaccgagagttgctggttcaccttgacgatccagagagggccatccaggatgcaattttagaggtcctcaaagagggcagcgggctgttcccagatctcctggtgagggagacggaggccgtcatccacaagcaccgctcggccacctactgcgagcagctcctgcagcatgtgcaggccgtgccagccacacagtgaccacgctggtttcagccacggcacacccttgtccccacctgagccagagtttgtggcctttaaatctcataaacaaggcacctctgtgccagcagtgagactgtgacagcaagaatgtactcctcaggacacctgcccactctttccctggaataacagcctctgagtggattctgcatgttatgtgatttgttctgttcatcgagagggctcccaaacatctgcagctgatttgaaattaaaagtaagtcgcagccgctcctcccgcagccacttcagcagcatcttagattttaagcctcacgtgcgcagctggttcatgaactattggctgcatcctgcttaggtgcccaccaagaaggtttttacctacttaacaaaaaagaaagaagccaaagtgattagaaagaaatgaaatctctttttgggttctgtctactgaaatttaatatctcagtgaacagactaaaaggaatttagaatcctaacaacttatcagatttctcctgttttaaatatactgggactttaaaggttatatgtccggtcaccgtatgttttaagtcggtgttaatgctaacagtgttgaaaacaatatttcatgagatctaattgtggttgcccctataggtagcaggaaagtaaagttgcatttccctctcgcacattctacacccaagtgcctaaaagatctcattgtaagtgggtagtgttaccggaagccattgtgttcacacgggggaaatgccgtatatatttttcaacaaatattaacgtttatactttcatgtttgaaaatttaattaaaaatgtttgttttaa

SEQ ID NO: 4143 - DNA, 2552 bp, Homo sapiens
tgaccggcgacgcgggcaagatggcggcgctgggggtggcggaggccgtggcggccccacacccggctgagggggccgagacggctgaggcggtggagctgagccgcgccctgagccgcctgctgccggggctggaggccgacagcaagccgggccggcggcgcgccttggaggccctgcggcgcgcgctggaggagccaggccctgccgccgaccccaccgctttccagggcccctgggcgcgcctactgctgccgcgcttgctgcgctgcctgagcgaccccgccgagggctgccgcgcgctggcagtgcacctgctggatctgggcctgcgccgcgccgcgcggccccgcgatgccctgccgcgcctgctgcccgcgctcgccgcgcgcttggccggccccgtgcccgcgcgccgcccgcccgaggcctgtgaggagctgcgcctggcgcttgtgcagctgctgggcctggccgtggacctgtgcggcgccgcgctcgcgccccacctggacgacgctctgcgcgcgctgcgctgctccctgctcgaccccttcgccgccgtgcgccgcgagagctgcagctgcgccgccgccctggcgcaggccacgcccgaccacttccacatgcagtcggagtctctgatcgggcccctgatgcagaccatctcccaccagcactggaaggtccgtgtggccgccattgaagccacaggcgcagtgatccattttggcaacgggaagtccgtggacgacgtgctttcccattttgctcagcgactgtttgatgacgtcccgcaggtccggcgggcggtggcctccgtggtgggcggctggctgctgtgtctgcgtgaccgttactccttcttccacaagctcatccctctgctgctcagtagcctcaacgacgaggtgcctgaggtcaggcagctggctgccagcctctgggaggacgttggcctgcagtggcagaaggagaatgaggaggacctgaaggacaagctggactttgcccctcccaccccaccccattaccctccacatgagcgccgccctgtgctgggctgccgggagctcgtcttcaggaacctctccaagatcctccctgccctgtgccacgacatcaccgactgggtggtggggacccgagtgaagtcggcacagctgctcccagtgctgctgctgcatgccgaggaccacgccacgcagcacctggaggtcgtcctccggaccctgttccaggcctgcaccgacgaggaggcagccgtggtccaaagttgtaccagatccgcagagctcgtcgggacgtttgtcagccctgaggtgtttctgaagctgatcttatcgacgctgaagaagacgccctctgcctccggcctcctggtgctggcctccgccatgcggggttgcccccgagaagccctccagccgcacctggcagccatcgccacagagctggcacaggcccacatctgccaggcatctgaaaacgacctctacctggagcgcctgctgctgtgtgtgcaggctctggtgtctgtgtgtcatgaggactgtggcgtggccagcctgcagctcttggacgtgctgctgacaatagtggccctcgcaggtgctaccggcctgagggacaaggcacaggagacgatggactcactggccatggtggagggtgtcagcagctgccaggacctctaccgcaagcacattggtcccctcctggagcgggtgaccgcgtcgcaccttgactggaccgcacactcgccggagctcctgcagttcagtgtcatcgtcgcacagtcaggccctgccctgggagaagccctgccacacgtcgtgcccacgctgagggcctgtctgcagccctcccaagacccgcagatgcgcctgaagctgttctccatcctgtccaccgtgctgctcagagccacggacaccatcaactcccaggggcagtttcccagctacctcgagacggtgacaaaggacatcctggcccccaatctgcagtggcatgcggggaggacagccgcggccatccgcacggctgccgtgtcctgcctctgggcgctcaccagcagcgaggtcctgtcggcagagcagatacgggacgtgcaggaaacactgatgccccaggtcctgaccaccctggaggaggattcgaagatgacgcgactgatctcatgccgtattatcaacacgttcttaaaaacctcgggcggcatgacggatccagagaaactcatcaggatttatcctgaactcttaaaacgcctagatgacgtgtccaacgatgtgaggatggcagccgcctccaccttggtcacctggctgcagtgtgtcaagggtgccaacgcaaaatcctactatcagagcagtgtccagtacctgtaccgagagttgctggttcaccttgacgatccagagagggccatccaggatgcaattttagatgtgcctggttccccttcaccttctgccatgattggaagtttcctgaggcctccccacccatggagaactgtgagtcaattaaacctcttttcttcataa

SEQ ID NO: 4144 - DNA, 2313 bp, Homo sapiens
agtcggcagctgctcagctttgctgcagttttcctgctcgatgtgtgctgctggtgaggccaccaggcctgttcttgtcaagagagaccttccgggagcaacagatgttacaggagagactggggatgcatggacagcttttcagaggtccggcgggcggtggcctccgtggtgggcggctggctgctgtgtctgcgtgaccgttactccttcttccacaagctcatccctctgctgctcagtagcctcaacgacgaggtgcctgaggtcaggcagctggctgccagcctctgggaggacgttggcctgcagtggcagaaggagaatgaggaggacctgaaggacaagctggactttgcccctcccaccccaccccattaccctccacatgagcgccgccctgtgctgggctgccgggagctcgtcttcaggaacctctccaagatcctccctgccctgtgccacgacatcaccgactgggtggtggggacccgagtgaagtcggcacagctgctcccagtgctgctgctgcatgccgaggaccacgccacgcagcacctggaggtcgtcctccggaccctgttccaggcctgcaccgacgaggaggcagccgtggtccaaagttgtaccagatccgcagagctcgtcgggacgtttgtcagccctgaggtgtttctgaagctgatcttatcgacgctgaagaagacgccctctgcctccggcctcctggtgctggcctccgccatgcggggttgcccccgagaagccctccagccgcacctggcagccatcgccacagagctggcacaggcccacatctgccaggcatctgaaaacgacctctacctggagcgcctgctgctgtgtgtgcaggctctggtgtctgtgtgtcatgaggactgtggcgtggccagcctgcagctcttggacgtgctgctgacaatagtggccctcgcaggtgctaccggcctgagggacaaggcacaggagacgatggactcactggccatggtggagggtgtcagcagctgccaggacctctaccgcaagcacattggtcccctcctggagcgggtgaccgcgtcgcaccttgactggaccgcacactcgccggagctcctgcagttcagtgtcatcgtcgcacagtcaggccctgccctgggagaagccctgccacacgtcgtgcccacgctgagggcctgtctgcagccctcccaagacccgcagatgcgcctgaagctgttctccatcctgtccaccgtgctgctcagagccacggacaccatcaactcccaggggcagtttcccagctacctcgagacggtgacaaaggacatcctggcccccaatctgcagtggcatgcggggaggacagccgcggccatccgcacggctgccgtgtcctgcctctgggcgctcaccagcagcgaggtcctgtcggcagagcagatacgggacgtgcaggaaacactgatgccccaggtcctgaccaccctggaggaggattcgaagatgacgcgactgatctcatgccgtattatcaacacgttcttaaaaacctcgggcggcatgacggatccagagaaactcatcaggatttatcctgaactcttaaaacgcctagatgacgtgtccaacgatgtgaggatggcagccgcctccaccttggtcacctggctgcagtgtgtcaagggtgccaacgcaaaatcctactatcagagcagtgtccagtacctgtaccgagagttgctggttcaccttgacgatccagagagggccatccaggatgcaattttagaggtcctcaaagagggcagcgggctgttcccagatctcctggtgagggagacggaggccgtcatccacaagcaccgctcggccacctactgcgagcagctcctgcagcatgtgcaggccgtgccagccacacagtgaccacgctggtttcagccacggcacacccttgtccccacctgagccagagtttgtggcctttaaatctcataaacaaggcacctctgtgccagcagtgagactgtgacagcaagaatgtactcctcaggacacctgcccactctttccctggaataacagcctctgagtggattctgcatgttatgtgatttgttctgttcatcgagagggctcccaaacatctgcagctgatttgaaattaaaagtaagtcgcagccgctcctcccgcagccacttcagcagcatcttagattttaagcctcacgtgcgcagctggttcatgaactattggctgcatcctgcttaggtgcccaccaagaaggtttttacctacttaac

SEQ ID NO: 4145 - DNA, 3511 bp, Homo sapiens
gcgcacggcttgcccatgtgtgctgcagccgtcagccggcccagctgagcagcagcaacggaccttgttaacggcgcggcagcctccaccgcctgctgttgccctcctctctcggtggtctgtccgcccagcgcacgtcaccatgggcaagagccggacgaagcgcttcaagcgacctcagttctcccctacgggcgactgtcaggccgaggcggctgcggcggcgaatgggaccggaggcgaggaggacgacgggccggcggcggagctgctggaaaagctccagcacccgagcgccgaggtccgcgagtgcgcctgcgcagggctggcccggctggtgcagcagcggccggcactcccgggcctggcgcgacgagacgccgtgcgccgcctcgggccgctgctgctagaccccagcctggccgtcagggagactgcagccggcgcgctgagaaatctcagtgcttgtggaggttttgaagtttgtgatgacatggtgactaaggatatcatgacccctctggttgcgctgctaaaagagtgtagtgctggactggattcaaatgagatgtctctgcaggagaaaaaagatcagaacagaaattctattgagaacatagccaatgagactgtgaacgtgctgtggaatatatgtgaatgcagtagtagagcagtgtctatattcaacaaagaagggtgtttggagattgtgttaaagtatttaagtaggtttcctaccaatgttgacctggctatttcagtagcatattgtttgcagacagtgactgaggataacccagagctgctgaagtctttcagtgctacagcattgaacatgctggaatcagcactgctttctcctgtcagttccatggaatctcttctattgaagacattggtagcaggcacaatttggaatctaaaggacattattccatgcaagagtcaagcagaaatcataaatgccttactaaagatcttatctgaagttttgggaatggatgctggtgaaatggttattcaaatgaaagaggctgaaacgcaaaggttaaaaactgctgcagaggctgaggaaatattagagaacactaatggggatgatttgattgaagatgatgaaatggaaggaatttctcataaaagaagagtcagaaggaaaactttcgtttcagatttacttccgcccactgacaaggaactgagagagactatagcattgctgacagcccaacagactgctctggaaattattgtcaacatgtgctgcaatgaagatccctctgatgacgaatgggaagagctttctagcagtgatgaaagtgacgcatttatggagaattccttcagtgagtgcgggggacagctgttttctcccctctgcctctcccatgaagttcacacggctctcaccaactacctcatcccaaagaagatttttgagaaaactgcctttccaaacagcattgcagttgacctatgttctaggaaccctacttggaaacctttgattagaaaaatgaacactattcagtgcagagccctcttctgtctccagagtcttgtgtccctcctggatgtggagcacctgggaggagccgcagcccttcagacgcttgcacagcatctgtcacagctgcttttttctcaaccagattttgctaaacatgttgactttctagaagccataagtagtgctttgagggcccttttgcaaacaatggcctccaagaacatttcccagtgcatgactcctgatcagctgatgacattatgcaaagcaggcattcatagtagtaatgtcggggttagagtgaatgtcgttagcattttaggaatcactggcagcgtccttgccaaagaagatggtacacttgaaactcttaagaacattgggtgctttctgcttgaagttaccaccaaagatccttcccttgtggtagcaggagaagctttggatgccctctttgatgtttttgcagatggtaaagaagccgaaagagcctcgattcaaattaaattattatctgctctgaaagaattccagccggtctttaaaatgaagatacgtaaagaagggagaggtaactatagcacagatcagctgtgtgttcttgacaatgtgaaaatgaatttgcgaagatttattgcttatcaagaaactgttgagaaaagactgacttcttaaacaatccaaaaaagaaaccagttcttcccccaaagtattcaatgcttagaatactaaaaggttttctttgaatgtatatgtttctgaaagtcattttttaatgattacattctgtacattctgtaaaaacttcaaaacctggccaggcatggtggctcacgcctataatcccagcaccttgggagaccgaggcgggtggatcacttgaggtcaggagtttgaggccagcctggccaacatggtgaaaccgcatgcataagcatggtggcacatgcctgtgatcccagctactcgggaggctgagggaggagagtcggttgaacctgggagacagaggttgcagtgagctgagatcacgctactgcactccagcctgggtgacagagggagaccctgtctccaaaaaaaaaaaaaaaaaaaaacttcaaaacctgtcagaaactctgttgctggtttttttgtgtgtgtgttttgtttgtttgttttgttttgttgtttttttcttttttgagatggagtctcactgctgcccaggctgtattacagtgctgcgatcttggcttactgcaacctctgccattccaggttcaagcgattctcatgcctcagcctcctgagtagctggaattacaggcacccaccaccacaccttgtttttgtttttggttttttggtttgtttttttttttcagtagagacgggtttcaccgtgttggccaggctggtctcaaattcctgacctcaagtgatccgcctgccctggcctcccaaagtgctgggattacaggcatgagccaccgtgcctggccagaaactcttttttaagtgatgagatctgtgtggcatttctagcgctctctaaattatgtctctggcatattttaatcactggaaactcaaagagtggaagagtggaagtgcgaaggaatctcaggtagctcttaactaattcgccagcagtgaagaaacttcaaccaatcatgttttccttgaattttgcaaagaaagaaaatccaaagcattgcttggatgttcttttaaggcattttatatcagttgaaccttaaactgaaatatgaagacaagctttataaactagttttttgatatgaagtatatcaattatgtttgccttttgtgaagaagtaaatgagttgaatttctatttcacttactagattatactaatgagctaatggggtcattgccatcctccctactcatgactttgatgagttattgctgtaacatcacttcttgatttaatttgatatggaatcagaattgggagaaggtatttttaaataaacaactttttaatggaaa

SEQ ID NO: 4146 - DNA, 3469 bp, Homo sapiens
ggaacctaagaaaccaaggaaggcttaagatgcagaaccttgcttctctctgaggactgccttttaggaggccatttggaaagtaattttgaaacactgctcctttgccagtatctgaaaggtgctggatggtgtcagctggaagatgaggggcaacctgaggtagctgaaaaaactttggattaggtgtcaaaagggtgccaggtctcatctccaggcctttcctctaggccaggcagtgtggaaggaagcatttgctgggacgcggtatgaccaggacccagaagggaaagacctttctcccccattgcttctatcagtcactgcccccacgactgggatggggcatgattttaaactactcaaaattgaaaggcaaggaggagtgtgcctctgtctccagtgtgcctatggtcttcttcagctcacagtaccgtctacaccgcaagagccaatatttgaaaatggctgctgcaaaccttaccttctctcaggaggtggtgtggcagcgaggcctgcccagcattccttatagccagtacagctttgaccacctctacaataccaatgacatcatccatactccccagatcaggaaggcccggcctcagaaacctgttagcttcaagttcctgggttcctcaagtcccttaacaggagacacctccctggctgtgaagacagaaagctctgccaatcccgaaaagaagctgaagaaatcaaagccagccagcaccgtccgggaagcaccccgccctctcatccatcatccctgcatgcatccagatatgctgggtcggccaccttctctagatgtgaacctggaggaaagagaagcctggcttctgcctcctgagaaggaggccagagcgtgggaggccactgtgctggaaaagctgaacgagcgcacagcccgatggatccagagcaagcgtcctcgaaggcctggggcatcccccaacaagtggcagagcttcctgcgccagcagtacgactggagtcacattcgggatgagcttacctctgccagtgacctggagctcctgaaacagctggaggcagaagagacagcagagtttgaggatcaaagtgtcatcctgcccccacaggaaaagaagaagccagaactgctgcttcccgtttactacagattgcccagttacttccaacaagcagagacagttgagatcatgcctggcaacaagagcactgaggatatccatgaaaagacgagcctctcccagccccaaacccagagctactttcgccaggtgactccccgagctggaaagtttgcctactccacagacaacacctttgaacaggagatttactttgatgaagtccagatcatccaccagattggtgcaaagagagaccagattgtcctggaaaacctaaatcggtacaacaagcagctatctaaggtcttccctgaaactccagaaaagtggagtgcccaggcaattcctgaagcatcttacagacctgtgcaaggagccctgcgctggactgctttgcccacccccgccaaggatatgctgctgcaggtgggtgagaaggatgtgcctattaagaccaggagattgaagaagcaggcaaaatcactgcaggaggatgtgacctgggaactggtggtcctgcggaggatgctgaaggaatggaagactgcctgggctctgatcatagagtggcaccatgagacagtagagaacctgcttcagagcttgggagacctgcatgatgacgttcggatcaaagctatcaccacatgtgccacagctgctttggaacggccccggattgccaccagccagagagactcagacaagaccatccaggacttgccggaggttctactgcctgccctagaggctgctctttgtgacaagaatgcccatgtgcggatggcagcagcaatatgccaatatgccatacagtcacataatccccttgcccggaacatcatgcagactgcccttctgaagggtaacagtgtggatagctgggctgcagctcagtgcttggctctggaaggtactgctacttaccctgtgattaagaggatcctccaccagctgtttacaaagaagaatgaggacactgaggaacagtcttatatcctcctgagctatctgagtgagaagacaaccctgatacacaccatgcttgctgtggagctgaacagctgtcaatggaagaaccggattgtggcctgccaggctttctcccggatcagtggaaatgtctgcttggatatgaaacataagttgatccagctgatgtggaatgactggaataaggaagtgaggagagcagctgcacaggcgcttgggcaaatgagcctcgggaaagaggtgcacgacataatcagggtcaagctaggtcaaggaaattcccaggagcgtgtggaagctctctacctgataggtgagctcaagcttatgaccgccaagcttctcccaagcttcctgcactgcttctctgatgacttcacagcagttcggcgggcagcctgtttggcagctggtgccctgcagatccgcgacaagatggtgcttgaatgcctcctgaacctgatgcagagagatccttactggaaaatcaaggcctttgccattcgagctttgggacagattgggcaagtaagtcccgagctgacggatcttctgctctgggctatccactatgaagagtcaccaggtgtacggctggaagcttgccgtagcatcctagccctgaaacttcaaggggaccgggtcagggacaccttcctagacgtgctgctcctggagaaccacgatgctgttctaaaagaaatgtaccagacaatgaagatactcaacttaggaaatgaaggaaaccaagaaatgcttcaggagatcaagaacaggattaaaacactaagccaaaaggacttgctgacacacaaaatactcaagctggagatggtcatgggaaaagtgagggaggaagcaaaacgtgtttacttgaaacccaaaggagaacaaggaccactaacactccagactttactccaagaaacttttcaggatgagatggttcttcctagaagaccttccgaggtttgtgacactgaagcagtgataaagcctgtgaagccccgcgcaccaaatccctggttacaaagttcagtcccaggcctaaccacacgaagcaaagttcgttcatcacttgtcaaagatctacgcacctcccccgagaaaaggattgctgtgggaccatttagatccgactacccagctctttatctgggtaaattctcagagagaacatttttttctcccatcatgtcttctccctctggaaagaaaggtgctcatctctaagctgaacacttgtcttacttcaagatgcaggaagcagtggacctggtcacattgggtctttttaattgatactgtacaatcttgttgtcactatgtttataaagagaaattatttaaca

SEQ ID NO: 4147 - DNA, 3523 bp, Homo sapiens
aagatgcagaaccttgcttctctctgaggactgccttttaggaggccatttggaaagtaattttgaaacactgctcctttgccagtatctgaaaggtgctggatggtgtcagctggaagatgaggggcaacctgaggtagctgaaaaaactttggattaggtgtcaaaagggcgcagtcccagcatttctggaggccaaggcaggaagatcgcttgattccaggagtttgaaaccagcctggacaacatagtgccaggtctcatctccaggcctttcctctaggccaggcagtgtggaaggaagcatttgctgggacgcggtatgaccaggacccagaagggaaagacctttctcccccattgcttctatcagtcactgcccccacgactgggatggggcatgattttaaactactcaaaattgaaaggcaaggaggagtgtgcctctgtctccagtgtgcctatggtcttcttcagctcacagtaccgtctacaccgcaagagccaatatttgaaaatggctgctgcaaaccttaccttctctcaggaggtggtgtggcagcgaggcctgcccagcattccttatagccagtacagctttgaccacctctacaataccaatgacatcatccatactccccagatcaggaaggcccggcctcagaaacctgttagcttcaagttcctgggttcctcaagtcccttaacaggagacacctccctggctgtgaagacagaaagctctgccaatcccgaaaagaagctgaagaaatcaaagccagccagcaccgtccgggaagcaccccgccctctcatccatcatccctgcatgcatccagatatgctgggtcggccaccttctctagatgtgaacctggaggaaagagaagcctggcttctgcctcctgagaaggaggccagagcgtgggaggccactgtgctggaaaagctgaacgagcgcacagcccgatggatccagagcaagcgtcctcgaaggcctggggcatcccccaacaagtggcagagcttcctgcgccagcagtacgactggagtcacattcgggatgagcttacctctgccagtgacctggagctcctgaaacagctggaggcagaagagacagcagagtttgaggatcaaagtgtcatcctgcccccacaggaaaagaagaagccagaactgctgcttcccgtttactacagattgcccagttacttccaacaagcagagacagttgagatcatgcctggcaacaagagcactgaggatatccatgaaaagacgagcctctcccagccccaaacccagagctactttcgccaggtgactccccgagctggaaagtttgcctactccacagacaacacctttgaacaggagatttactttgatgaagtccagatcatccaccagattggtgcaaagagagaccagattgtcctggaaaacctaaatcggtacaacaagcagctatctaaggtcttccctgaaactccagaaaagtggagtgcccaggcaattcctgaagcatcttacagacctgtgcaaggagccctgcgctggactgctttgcccacccccgccaaggatatgctgctgcaggtgggtgagaaggatgtgcctattaagaccaggagattgaagaagcaggcaaaatcactgcaggaggatgtgacctgggaactggtggtcctgcggaggatgctgaaggaatggaagactgcctgggctctgatcatagagtggcaccatgagacagtagagaacctgcttcagagcttgggagacctgcatgatgacgttcggatcaaagctatcaccacatgtgccacagctgctttggaacggccccggattgccaccagccagagagactcagacaagaccatccaggacttgccggaggttctactgcctgccctagaggctgctctttgtgacaagaatgcccatgtgcggatggcagcagcaatatgccaatatgccatacagtcacataatccccttgcccggaacatcatgcagactgcccttctgaagggtaacagtgtggatagctgggctgcagctcagtgcttggctctggaaggtactgctacttaccctgtgattaagaggatcctccaccagctgtttacaaagaagaatgaggacactgaggaacagtcttatatcctcctgagctatctgagtgagaagacaaccctgatacacaccatgcttgctgtggagctgaacagctgtcaatggaagaaccggattgtggcctgccaggctttctcccggatcagtggaaatgtctgcttggatatgaaacataagttgatccagctgatgtggaatgactggaataaggaagtgaggagagcagctgcacaggcgcttgggcaaatgagcctcgggaaagaggtgcacgacataatcagggtcaagctaggtcaaggaaattcccaggagcgtgtggaagctctctacctgataggtgagctcaagcttatgaccgccaagcttctcccaagcttcctgcactgcttctctgatgacttcacagcagttcggcgggcagcctgtttggcagctggtgccctgcagatccgcgacaagatggtgcttgaatgcctcctgaacctgatgcagagagatccttactggaaaatcaaggcctttgccattcgagctttgggacagattgggcaagtaagtcccgagctgacggatcttctgctctgggctatccactatgaagagtcaccaggtgtacggctggaagcttgccgtagcatcctagccctgaaacttcaaggggaccgggtcagggacaccttcctagacgtgctgctcctggagaaccacgatgctgttctaaaagaaatgtaccagacaatgaagatactcaacttaggaaatgaaggaaaccaagaaatgcttcaggagatcaagaacaggattaaaacactaagccaaaaggacttgctgacacacaaaatactcaagctggagatggtcatgggaaaagtgagggaggaagcaaaacgtgtttacttgaaacccaaaggagaacaaggaccactaacactccagactttactccaagaaacttttcaggatgagatggttcttcctagaagaccttccgaggtttgtgacactgaagcagtgataaagcctgtgaagccccgcgcaccaaatccctggttacaaagttcagtcccaggcctaaccacacgaagcaaagttcgttcatcacttgtcaaagatctacgcacctcccccgagaaaaggattgctgtgggaccatttagatccgactacccagctctttatctgggtaaattctcagagagaacatttttttctcccatcatgtcttctccctctggaaagaaaggtgctcatctctaagctgaacacttgtcttacttcaagatgcaggaagcagtggacctggtcacattgggtctttttaattgatactgtacaatcttgttgtcactatgtttataaagagaaattatttaacag

SEQ ID NO: 4148 - DNA, 824 bp, Homo sapiens
gaaggtttaagatgcagaaccttgcttctctctgaggactgccttgtaggaggccatttggaaagtaattttgaaacactgctcctttgccagtatctgaaaggtgctggatggtgtcagctggaagatgaggggcaacctgaggtagctgaaaaaactttggattaggtgtcaaaagggtgccaggtctcatctccaggcctttcctctaggccaggcagtgtggaaggaagcatttgctgggacgcggtatgaccaggacccagaagggaaagacctttctcccccattgcttctatcagtcactgcccccacgactgggatggggcatgattttaaactactcaaaattgaaaggcaaggaggagtgtgcctctgtctccagtgtgcctatggtcttcttcagctcacagtaccgtctacaccgcaagagccaatatttgaaaatggctgctgcaaaccttaccttctctcaggaggtggtgtggcagcgaggcctgcccagcattccttatagccagtacagctttgaccacctctacaataccaatgacatcatccatactccccagatcaggaaggcccggcctcagaaacctgttagcttcaagttcctgggttcctcaagtcccttaacaggagacacctccctggctgtgaagacagaaagctctgccaatcccgaaaagaagctgaagaaatcaaagccagccagcaccgtccgggaagcaccccgccctctcatccatcatccctgcatgcatccagatatgctgggtcggccaccttctctagatgtgaacctggaggaaagagaagcctgg

SEQ ID NO: 4149 - DNA, 552 bp, Homo sapiens
agaaccttgcttctctctgaggactgccttgtaggaggccatttggaaagtaattttgaaacactgctcctttgccagtatctgaaaggtgctggatggtgtcagctggaagatgaggggcaacctgagagacggagtttcaccatgttggtcaagctggtcttgaactcctaacctcagatgatccacacgcctcagcctcccaaagtgctgggattacacgcatgatccaccacgcctggccgattgacttaattttttatgctgtgtacaaaaggacccaggacctgccactctgcttttggttctagagggctatttgttggaagtgggtgctgcctcataatgctggtcacgtaatgtgtgccaggtctcatctccaggcctttcctctaggccaggcagtgtggaaggaagcatttgctgggacgcggtatgaccaggacccagaagggaaagacctttctcccccattgcttctatcagtcactgcccccacgactgggatggggcatgattttaaactactcaaaattgaaaggcaaggaggag

SEQ ID NO: 4150 - DNA, 3465 bp, Homo sapiens
ggaacctaagaaaccaaggaaggcttaagatgcagaaccttgcttctctctgaggactgccttttaggaggccatttggaaagtaattttgaaacactgctcctttgccagtatctgaaaggtgctggatggtgtcagctggaagatgaggggcaacctgaggtagctgaaaaaactttggattaggtgtcaaaagggtgccaggtctcatctccaggcctttcctctaggccaggcagtgtggaaggaagcatttgctgggacgcggtatgaccaggacccagaagggaaagacctttctcccccattgcttctatcagtcactgcccccacgactgggatggggcatgattttaaactactcaaaattgaaaggcaaggaggagtgtgcctctgtctccagtgtgcctatggtcttcttcagctcacagtaccgtctacaccgcaagagccaatatttgaaaatggctgctgcaaaccttaccttctctcaggaggtggtgtggcagcgaggcctgcccagcattccttatagccagtacagctttgaccacctctacaataccaatgacatcatccatactccccagatcaggaaggcccggcctcagaaacctgttagcttcaagttcctgggttcctcaagtcccttaacaggagacacctccctggctgtgaagacagaaagctctgccaatcccgaaaagaagctgaagaaatcaaagccagccagcaccgtccgggaagcaccccgccctctcatccatcatccctgcatgcatccagatatgctgggtcggccaccttctctagatgtgaacctggaggaaagagaagcctggcttctgcctcctgagaaggaggccagagcgtgggaggccactgtgctggaaaagctgaacgagcgcacagcccgatggatccagagcaagcgtcctcgaaggcctggggcatcccccaacaagtggcagagcttcctgcgccagcagtacgactggagtcacattcgggatgagcttacctctgccagtgacctggagctcctgaaacagctggaggcagaagagacagcagagtttgaggatcaaagtgtcatcctgcccccacaggaaaagaagaagccagaactgctgcttcccgtttactacagattgcccagttacttccaacaagcagagacagttgagatcatgcctggcaacaagagcactgaggatatccatgaaaagacgagcctctcccagccccaaacccagagctactttcgccaggtgactccccgagctggaaagtttgcctactccacagacaacacctttgaacaggagatttactttgatgaagtccagatcatccaccagattggtgcaaagagagaccagattgtcctggaaaacctaaatcggtacaacaagcagctatctaaggtcttccctgaaactccagaaaagtggagtgcccaggcaattcctgaagcatcttacagacctgtgcaaggagccctgcgctggactgctttgcccacccccgccaaggatatgctgctgcaggtgggtgagaaggatgtgcctattaagaccaggagattgaagaagcaggcaaaatcactgcaggaggatgtgacctgggaactggtggtcctgcggaggatgctgaaggaatggaagactgcctgggctctgatcatagagtggcaccatgagacagtagagaacctgcttcagagcttgggagacctgcatgatgacgttcggatcaaagctatcaccacatgtgccacagctgctttggaacggccccggattgccaccagccagagagactcagacaagaccatccaggacttgccggaggttctactgcctgccctagaggctgctctttgtgacaagaatgcccatgtgcggatggcagcagcaatatgccaatatgccatacagtcacataatccccttgcccggaacatcatgcagactgcccttctgaagggtaacagtgtggatagctgggctgcagctcagtgcttggctctggaaggtactgctacttaccctgtgattaagaggatcctccaccagctgtttacaaagaagaatgaggacactgaggaacagtcttatatcctcctgagctatctgagtgagaagacaaccctgatacacaccatgcttgctgtggagctgaacagctgtcaatggaagaaccggattgtggcctgccaggctttctcccggatcagtggaaatgtctgcttggatatgaaacataagttgatccagctgatgtggaatgactggaataaggaagtgaggagagcagctgcacaggcgcttgggcaaatgagcctcgggaaagaggtgcacgacataatcagggtcaagctaggtcaaggaaattcccaggagcgtgtggaagctctctacctgataggtgagctcaagcttatgaccgccaagcttctcccaagcttcctgcactgcttctctgatgacttcacagcagttcggcgggcagcctgtttggcagctggtgccctgcagatccgcgacaagatggtgcttgaatgcctcctgaacctgatgcagagagatccttactggaaaatcaaggcctttgccattcgagctttgggacagattgggcaagtaagtcccgagctgacggatcttctgctctgggctatccactatgaagagtcaccaggtgtacggctggaagcttgccgtagcatcctagccctgaaacttcaaggggaccgggtcagggacaccttcctagacgtgctgctcctggagaaccacgatgctgttctaaaagaaatgtaccagacaatgaagatactcaacttaggaaatgaaggaaaccaagaaatgcttcaggagatcaagaacaggattaaaacactaagccaaaaggacttgctgacacacaaaatactcaagctggagatggtcatgggaaaagtgagggaggaagcaaaacgtgtttacttgaaacccaaaggagaacaaggaccactaacactccagactttactccaagaaacttttcaggatgagatggttcttcctagaagaccttccgaggtttgtgacactgaagcagtgataaagcctgtgaagccccgcgcaccaaatccctggttacaaagttcagtcccaggcctaaccacacgaagcaaagttcgttcatcacttgtcaaagatctacgcacctcccccgagaaaaggattgctgtgggaccatttagatccgactacccagctctttatctgggtaaattctcagagagaacatttttttctcccatcatgtcttctccctctggaaagaaaggtgctcatctctaagctgaacacttgtcttacttcaagatgcaggaagcagtggacctggtcacattgggtctttttaattgatactgtacaatcttgttgtcactatgtttataaagagaaattattt

SEQ ID NO: 4151 - DNA, 7640 bp, Homo sapiens
atggaattagctcatagcttactgctgaatgaagaagcatacaatcaactaggtgaagttcagaaggcagagtttatttttgagtggttgagatacttggagaagctcttgttggcaaccagcaggaatgatgtaagggagaaacagaagactcttgttgaacagctcctgtctttgttgaacagctccccagggcctcctacccgcaaactgcttgctaagaatctagccatactttatagtattggagacacattctccgttcatgaagcaatcgataaatgtaatgatcttattcgtagcaaagatgattctccaagttatcttcccactaagcttgctgctgtggtatgtttgggttccttgtacaagaagttgggtagaatactgggtaacacctttactgatacagtggggaatattcttaaagctatgaagagtgcagagtctcaaggccgatatgagattatgctaagtctgcaaaatatattgaatggactaggagctgccgctgcaccttgtcacagggatgtttataaagctgctagatcctgcttgacagatagatccatggctgttcgttgtgctgctgcaaagaatgaagccatctttatgtggagtacggacctggacagtgtggccacactgtgttttaagtcctttgaaggttccaattatgatgtgcggatttctgtttcaaagttactaggcataatattagctaaagctgtaatttctaaacatccaggaacagcagcctcacgtcaaagcattcgcagagtatctttggaggaagttctggaattactaggaacagggtttctacgtgggagttcaggattccttcgagccagtggagatatgctgaaaggaaccagttcagtcagtagggatgttcgagttggagttactcaggcttatgtggtatttgtttcaacactaggaggagcttggctagagaaaaattttgctgcctttttttctcatatcctaagccttgcgtcaccgtcacaccctaaagccacccaaactcagatcgatgccgtctgctgtcgccgttgtgtttcatttattcttcgaactactataggtggtcttcttggagaaaaggctcagcttgctgctgtaaaggatatttgccaggccatctggaagctaaagaaagttatggatgccgtaatgagtgatggtaatttggaaacccggcttggttccacagatgtagccgctagccaacatatgctggtttgtgctttacaagaacttggaaatctcatacacaatcttggcaccacagcggcacctttgctacaggattcaagtacaggtctccttgacagtatcttgtcagttattcttcatcctagcatttctgttcgactagcagcagcttggtgtttacactgcattgccgtggcattaccctcctacctaacaccactcttggatcgttgccttgaacggcttactggacataagtcttcacctgaagcagtgactggcttcagttttgctgtagcagctttgttgggagcagtaaaacattgtcctttaggaattcctcatggaaaaggcaagattattatgacattagcagaggatttgctgtgttctgctgctcaaaacagtcgcctttcagctcagcgcacacaagctggatggttgctgatttctgctctgatgacattaggtcctgcagttgttagccatcaccttgctcgagttctgctgttgtggaagtgtgtctttccagcatctcctaaagatctagaaacagaaaagagccgaggagattcgtttacatggcaggtgaccctggaaggacgagctggtgcactgtgtgctatcaagagctttgtttcccactgtggtgatcttcttactgaggaagtaactcagcgtcttcttccaccacttccttgtgctgtggatttgctaactcagctttcttcaatactaaaaatgtatggaagtcctttgaaaacaccgtcagtggtttatagacaaagactttatgaactgttgattttattacctcctgagacctatgaaggaaacctctgtgctatcctcagagagctggctgctgacttgactgcccctgatattcaggtggcagcatctacatttttacttccacccctctgtcatcaggatgatcttttgatactaagtcctttcctacaagagactgaccatagatttattgaagaacagctcctgcttggtaatggtgttgcttgcggaagtcttgaatatgacccttattcgatttatgagaaagatgtagagggagattcagtgcctaagcccttacctccagcactatcagttattagttctgcatccaagctctttggggttgtatgcgctcatgtgggagaaactcaaaggcttcttatattggaacagcttttggacagtataaagcacacaaaaggagctcgtcagcaagtggttcagttacatgttgtttcttcagtttctagtttcttgaagtacgtggctggctccaagggatgtttaggtccagaagaaatgaaaagatttgccttaacattagttatgggagccctagaaagccccaaccccttgctgagatgtgcagctgcagagtcatgggctagattagcccaagtggtagatgatggagcttttactgctggattagctcaagttagctttgacaaattgaaatcagcaagggatgtggttaccagaacaggacactcattggccttggggtccctacataggtatttaggaggaataagttcttctcaacacctaaattcttgtattggaatcctttatactttggcgcaggacagcacttctcctgatgtgcagacctgggcattacattctctatcattgatcattgattctgctggcccactctattatgtgcatgtggaacctaccctttctcttattataatgttgttgttaaatgtgcctcctactcatgctgaagttcaccaaagccttggtcgctgtttgaatgcccttattaccacgttaggtccagagctacaaggtaacagtacttcaatttctaccttaaggacttcctgtctactgggttgtgcagtaatgcaagataacccagactgccttgttcaagctcaggccatctcttgccttcagcagcttcatatgtttgctccacgacatgtcaacttgtctagcctggttagctgcctctgtgtgaatctttgtagcccctacttgttactgagaagagcagtactggcttgcttacgtcagcttgtacaaagagaagcagctgaagtttcagaacatgctgttatgcttgctaaggatagcagagaagagttgactccagatgctaacatcagagaagttggccttgagggggcattgttgatcttactagacaaggagacagatgagagattatgccatgatatcaaagagactttaaattatatgcttacatctatggcagtggaaaaactctccctgtggttaaagctttgtaaagatgtacttgctgcatcagctgattttacagctgtaacttgtgtggatacaatgcaagaagaagaaggagataaaggggatgatgcctcagtcctgaccaccagacgtgatgaaaaatcccatccttttaccaatccccgatgggctactagagtctttgctgctgaatgtgtctgtaggataattaaccaatgtgagaatgctaacagtgcacattttgacattgctttagcacaagaaatgaaaaaaagagattcaagaaatgactttttggtactgcatcttgctgacttaattcgcatggcttttatggctgccacagatcacagtgaccagctccgtctttctggccttgaaatgctgttagttgttattcggcgatttgcaactgttccagaaccagagtttccaggtcatgtgattctggaacagtatcaagccaatgtaggagcagcgcttagaccagccttcacttcagagacaccacctgatgtcactgccaaagcatgtcaggtttgcagtgcctggatagcaagtggagttgtaagtgaccttaatgatctccgaagagttcatcagttgcttgtttcatcgttaactaaaatacaggctggaaaagaagctctaagtcacttatataatgaaagtgcttctaccatggagatcttagctgtgcttaaagcctgggcagaggtctacataattgctgtgcaaagacataaaaaccacagacaacctttgaagactaccacctgtttagaagacggtatcagaaatggatcatgttcatcagatggactgcttgacttagtctatgcagatcttggcacactaagcagactctggcttgctgcacttcaggattttgctcttttaactttgccttcagaatttgcctcccaacttcctgctgaaggtggtgctttctacacagcagagactagtgaaaatgcaaaattgcattattacaactcctgggcacttatcctccatgctacagcattgtggcttacaagcacgggttttgttgttgctgacccagatgaaggagcatctaatctctccaggcctgtaacaccaacttccatgtgtcagggttcatcatctggggctaccataaagtcccctgaggatgtctacactgatagattccatcttattttaggaatcagcgtggaatttctatgttccttacgttcagatgcaaccatggaaagcataactgcttgtttacatgcattgcaagcacttctagatgtaccttggcccagatcaaaaattggcagtgatcaggacttgggtatagaattgctgaatgttctacatcgagtaattttaaccagagaatcaccttccattcagttggcttcacttgaagtggtaaggcagattatctgtgctgctcaagaacatgtgaaggaaaaaagacgaagtgcagaagttgatgatggggctgctgaaaaggaaactctgccagagtttggagagggaaaggacaccggaggacttgtgcctggaaagtctttggtctttgcaacactggaattgtgtgtatgcattctagttagacagctcccagaattaaaccctaaattgacaggtagcccaggagtaaaagctacgaagccacagatactattagaagatggaagtagattggtttcagctgcattggttatcctttccgaacttcctgcagtgtgctctcctgaaggaagcatctcaattctccctactatattgtacctcacaatcggggtcctcagagagactgctgtgaagttacctgggggccagttatcttcgacagttgcagcttccctacaggctctaaaaggaatattatcttctcccatggcccgggcagaaaagagccgtactgcttggactgaccttctccgaagtgccttaacaacaattcttgactgttgggatccagttgatgaaacacaccaagaacttgatgaagtcagtctacttactgctatcacagtgtttattttgtctaccagtccagaagtaactaccatcccatgccttcagaagcgctgtattgataaatttaaagctactcttgagataaaagatcctgtggtacaaatcaagacctaccagctcctacattccatctttcagtatccaaatccagctgtttcctacccatacatttactctttagcatcctgtatcatggaaaaactgcaggaaatagacaagagaaaacctgaaaacactgctgagcttgagatcttccaagaaggcataaaggtcttagaaacactggttactgttgctgaagaacaccatcgcgctcagctggtggcctgtcttttgcccatcctcatttccttccttttggatgaaaattctctgggatcagcaacttccataatgagaaatttacatgactttgctctacaaaatctcatgcaaattggacctcagtattcatctgtttttaaaagtttagtggcttcttctccagccctaaaagcccgccttgaggctgctataaagggcaatcaggaaagtgtcaaagtcaagataccaacatctaaatatactaagagtcctggaaaaaactcaagcatccaattaaagaccagtttcctctgattttttttttggaatagtaagcaccttaatataataaatacttgatcattgcctttggtgacaaaagggacattgtagacacaagtgcccttagaggtctagttgattgttttaccttaaatagctgtgactcttcaaagtaacagcatacttaacatttttgtgtgtgtgcgtggggtttgtgttttgttttgttttgtttttctatttaaaaagacaatggagctaacttgccaggaattttaagaaagtgctaaagaactaaacttactaaacaatccactgctttaaaaatgaaatgaatttcttctaacagtccatacatatgtggtatacttaatactgtgacagatataaatatgactctagtgtaaattatctgcactaatattgtatcccaattgctgatttaaaattctgctttggcccggcacagtggctcatccctgtaattccagcactttggaaggccaaggcgggcggatcacgaagtcgggagtttgagaccagcctgaccaacatggtgaaaccccgtctctactaaaaatacaaaaattagccgggtgtggtggcacacacctgtaatcccagctactcaggaggccgaggcaggaaaatcgcttgaacctggcaggcagaggttgcagtgagccaagattgtgccactgcactccagcctgggcgacagagtgagactccatctaaaaaaaaaaaaaaaaaattctgccttattcagtaattgtattaaactttctctgatttctccaagaagataaaatgattggagagctatttaggaaacctggtctaggattatccagtatacaatagtacaaattacttacagccttacagtgcaacataagatttggtgtctatatcatggttttccaccatcttttggtttagtttatattgggttcagaaattgagtcttactcattttaaatagaataagccatttccactatttttcaaatggatttttctgtttacctctgttcttaccaattttgttcattttcatttgtggcaaacatttgtatcaatgagttttaacctaggttcatatctacattgtatttagatcaactatgggtttatataaatgccaaatttagtacaacaaatttaggtcatcaggtgaatacaagtattttttttaacaggaaacattttattatagaaaaaagattaatgataaagtcatattggttgaaaaatattttttaactgtgttcatgattgttgattctccttctacttcagtgttatactgtgtgaatcaagcactgtgtcaaaacagagcatttccctcttaaaaattacaaaccgaagtgatagaagcatgtcagaattgagaagacattttgaagcaagaacaatgtgatgtacctattttattatgtttgtatataaatactattgtaaattgttcagagtgaaaacatttgacaaactctaacactacaatcattttttctaaattacataaataaagctaattttcattatca

SEQ ID NO: 4152 - DNA, 3423 bp, Homo sapiens
atggaattagctcatagcttactgctgaatgaagaagcatacaatcaactaggtgaagttcagaaggcagagtttatttttgagtggttgagatacttggagaagctcttgttggcaaccagcaggaatgatgtaagggagaaacagaagactcttgttgaacagctcctgtctttgttgaacagctccccagggcctcctacccgcaaactgcttgctaagaatctagccatactttatagtattggagacacattctccgttcatgaagcaatcgataaatgtaatgatcttattcgtagcaaagatgattctccaagttatcttcccactaagcttgctgctgtggtatgtttgggttccttgtacaagaagttgggtagaatactgggtaacacctttactgatacagtggggaatattcttaaagctatgaagagtgcagagtctcaaggccgatatgagattatgctaagtctgcaaaatatattgaatggactaggagctgccgctgcaccttgtcacagggatgtttataaagctgctagatcctgcttgacagatagatccatggctgttcgttgtgctgctgcaaagtgtctccttgaacttcagaatgaagccatctttatgtggagtacggacctggacagtgtggccacactgtgttttaagtcctttgaaggttccaattatgatgtgcggatttctgtttcaaagttactaggcataatattagctaaagctgtaatttctaaacatccaggaacagcagcctcacgtcaaagcattcgcagagtatctttggaggaagttctggaattactaggaacagggtttctacgtgggagttcaggattccttcgagccagtggagatatgctgaaaggaaccagttcagtcagtagggatgttcgagttggagttactcaggcttatgtggtatttgtttcaacactaggaggagcttggctagagaaaaattttgctgcctttttttctcatatcctaagccttgcgtcaccgtcacaccctaaagccacccaaactcagatcgatgccgtctgctgtcgccgttgtgtttcatttattcttcgaactactataggtggtcttcttggagaaaaggctcagcttgctgctgtaaaggatatttgccaggccatctggaagctaaagaaagttatggatgccgtaatgagtgatggtaatttggaaacccggcttggttccacagatgtagccgctagccaacatatgctggtttgtgctttacaagaacttggaaatctcatacacaatcttggcaccacagcggcacctttgctacaggattcaagtacaggtctccttgacagtatcttgtcagttattcttcatcctagcatttctgttcgactagcagcagcttggtgtttacactgcattgccgtggcattaccctcctacctaacaccactcttggatcgttgccttgaacggcttactggacataagtcttcacctgaagcagtgactggcttcagttttgctgtagcagctttgttgggagcagtaaaacattgtcctttaggaattcctcatggaaaaggcaagattattatgacattagcagaggatttgctgtgttctgctgctcaaaacagtcgcctttcagctcagcgcacacaagctggatggttgctgatttctgctctgatgacattaggtcctgcagttgttagccatcaccttgctcgagttctgctgttgtggaagtgtgtctttccagcatctcctaaagatctagaaacagaaaagagccgaggagattcgtttacatggcaggtgaccctggaaggacgagctggtgcactgtgtgctatcaagagctttgtttcccactgtggtgatcttcttactgaggaagtaactcagcgtcttcttccaccacttccttgtgctgtggatttgctaactcagctttcttcaatactaaaaatgtatggaagtcctttgaaaacaccgtcagtggtttatagacaaagactttatgaactgttgattttattacctcctgagacctatgaaggaaacctctgtgctatcctcagagagctggctgctgacttgactgcccctgatattcaggtggcagcatctacatttttacttccacccctctgtcatcaggatgatcttttgatactaagtcctttcctacaagagactgaccatagatttattgaagaacagctcctgcttggtaatggtgttgcttgcggaagtcttgaatatgacccttattcgatttatgagaaagatgtagagggagattcagtgcctaagcccttacctccagcactatcagttattagttctgcatccaagctctttggggttgtatgcgctcatgtgggagaaactcaaaggcttcttatattggaacagcttttggacagtataaagcacacaaaaggagctcgtcagcaagtggttcagttacatgttgtttcttcagtttctagtttcttgaagtacgtggctggctccaagggatgtttaggtccagaagaaatgaaaagatttgccttaacattagttatgggagccctagaaagccccaaccccttgctgagatgtgcagctgcagagtcatgggctagattagcccaagtggtagatgatggagcttttactgctggattagctcaagttagctttgacaaattgaaatcagcaagggatgtggttaccagaacaggacactcattggccttggggtccctacataggtatttaggaggaataagttcttctcaacacctaaattcttgtattggaatcctttatactttggcgcaggacagcacttctcctgatgtgcagacctgggcattacattctctatcattgatcattgattctgctggcccactctattatgtgcatgtggaacctaccctttctcttattataatgttgttgttaaatgtgcctcctactcatgctgaagttcaccaaagccttggtcgctgtttgaatgcccttattaccacgttaggtccagagctacaaggtaacagtacttcaatttctaccttaaggacttcctgtctactgggttgtgcagtaatgcaagataacccagactgccttgttcaagctcaggccatctcttgccttcagcagcttcatatgtttgctccacgacatgtcaacttgtctagcctggttagctgcctctgtgtgaatctttgtagcccctacttgttactgagaagagcagtactggcttgcttacgtcagcttgtacaaagagaagcagctgaagtttcagaacatgctgttatgcttgctaaggatagcagagaagagttgactccagtgttcacagcatcttcaccaggagtagattccatctgcagaaaccatctagaatga

SEQ ID NO: 4153 - DNA, 7415 bp, Homo sapiens
atggaattagctcatagcttactgctgaatgaagaagcatacaatcaactaggtgaagttcagaaggcagagtttatttttgagtggttgagatacttggagaagctcttgttggcaaccagcaggaatgatgtaagggagaaacagaagactcttgttgaacagctcctgtctttgttgaacagctccccagggcctcctacccgcaaactgcttgctaagaatctagccatactttatagtattggagacacattctccgttcatgaagcaatcgataaatgtaatgatcttattcgtagcaaagatgattctccaagttatcttcccactaagcttgctgctgtggtatgtttgggttccttgtacaagaagttgggtagaatactgggtaacacctttactgatacagtggggaatattcttaaagctatgaagagtgcagagtctcaaggccgatatgagattatgctaagtctgcaaaatatattgaatggactaggagctgccgctgcaccttgtcacagggatgtttataaagctgctagatcctgcttgacagatagatccatggctgttcgttgtgctgctgcaaagaatgaagccatctttatgtggagtacggacctggacagtgtggccacactgtgttttaagtcctttgaaggttccaattatgatgtgcggatttctgtttcaaagttactaggcataatattagctaaagctgtaatttctaaacatccaggaacagcagcctcacgtcaaagcattcgcagagtatctttggaggaagttctggaattactaggaacagggtttctacgtgggagttcaggattccttcgagccagtggagatatgctgaaaggaaccagttcagtcagtagggatgttcgagttggagttactcaggcttatgtggtatttgtttcaacactaggaggagcttggctagagaaaaattttgctgcctttttttctcatatcctaagccttgcgtcaccgtcacaccctaaagccacccaaactcagatcgatgccgtctgctgtcgccgttgtgtttcatttattcttcgaactactataggtggtcttcttggagaaaaggctcagcttgctgctgtaaaggatatttgccaggccatctggaagctaaagaaagttatggatgccgtaatgagtgatggtaatttggaaacccggcttggttccacagatgtagccgctagccaacatatgctggtttgtgctttacaagaacttggaaatctcatacacaatcttggcaccacagcggcacctttgctacaggattcaagtacaggtctccttgacagtatcttgtcagttattcttcatcctagcatttctgttcgactagcagcagcttggtgtttacactgcattgccgtggcattaccctcctacctaacaccactcttggatcgttgccttgaacggcttactggacataagtcttcacctgaagcagtgactggcttcagttttgctgtagcagctttgttgggagcagtaaaacattgtcctttaggaattcctcatggaaaaggcaagattattatgacattagcagaggatttgctgtgttctgctgctcaaaacagtcgcctttcagctcagcgcacacaagctggatggttgctgatttctgctctgatgacattaggtcctgcagttgttagccatcaccttgctcgagttctgctgttgtggaagtgtgtctttccagcatctcctaaagatctagaaacagaaaagagccgaggagattcgtttacatggcaggtgaccctggaaggacgagctggtgcactgtgtgctatcaagagctttgtttcccactgtggtgatcttcttactgaggaagtaactcagcgtcttcttccaccacttccttgtgctgtggatttgctaactcagctttcttcaatactaaaaatgtatggaagtcctttgaaaacaccgtcagtggtttatagacaaagactttatgaactgttgattttattacctcctgagacctatgaaggaaacctctgtgctatcctcagagagctggctgctgacttgactgcccctgatattcaggtggcagcatctacatttttacttccacccctctgtcatcaggatgatcttttgatactaagtcctttcctacaagagactgaccatagatttattgaagaacagctcctgcttggtaatggtgttgcttgcggaagtcttgaatatgacccttattcgatttatgagaaagatgtagagggagattcagtgcctaagcccttacctccagcactatcagttattagttctgcatccaagctctttggggttgtatgcgctcatgtgggagaaactcaaaggcttcttatattggaacagcttttggacagtataaagcacacaaaaggagctcgtcagcaagtggttcagttacatgttgtttcttcagtttctagtttcttgaagtacgtggctggctccaagggatgtttaggtccagaagaaatgaaaagatttgccttaacattagttatgggagccctagaaagccccaaccccttgctgagatgtgcagctgcagagtcatgggctagattagcccaagtggtagatgatggagcttttactgctggattagctcaagttagctttgacaaattgaaatcagcaagggatgtggttaccagaacaggacactcattggccttggggtccctacataggtatttaggaggaataagttcttctcaacacctaaattcttgtattggaatcctttatactttggcgcaggacagcacttctcctgatgtgcagacctgggcattacattctctatcattgatcattgattctgctggcccactctattatgtgcatgtggaacctaccctttctcttattataatgttgttgttaaatgtgcctcctactcatgctgaagttcaccaaagccttggtcgctgtttgaatgcccttattaccacgttaggtccagagctacaaggtaacagtacttcaatttctaccttaaggacttcctgtctactgggttgtgcagtaatgcaagataacccagactgccttgttcaagctcaggccatctcttgccttcagcagcttcatatgtttgctccacgacatgtcaacttgtctagcctggttagctgcctctgtgtgaatctttgtagcccctacttgttactgagaagagcagtactggcttgcttacgtcagcttgtacaaagagaagcagctgaagtttcagaacatgctgttatgcttgctaaggatagcagagaagagttgactccagatgctaacatcagagaagttggccttgagggggcattgttgatcttactagacaaggagacagatgagagattatgccatgatatcaaagagactttaaattatatgcttacatctatggcagtggaaaaactctccctgtggttaaagctttgtaaagatgtacttgctgcatcagctgattttacagctgtaacttgtgtggatacaatgcaagaagaagaaggagataaaggggatgatgcctcagtcctgaccaccagacgtgatgaaaaatcccatccttttaccaatccccgatgggctactagagtctttgctgctgaatgtgtctgtaggataattaaccaatgtgagaatgctaacagtgcacattttgacattgctttagcacaagaaatgaaaaaaagagattcaagaaatgactttttggtactgcatcttgctgacttaattcgcatggcttttatggctgccacagatcacagtgaccagctccgtctttctggccttgaaatgctgttagttgttattcggcgatttgcaactgttccagaaccagagtttccaggtcatgtgattctggaacagtatcaagccaatgtaggagcagcgcttagaccagccttcacttcagagacaccacctgatgtcactgccaaagcatgtcaggtttgcagtgcctggatagcaagtggagttgtaagtgaccttaatgatctccgaagagttcatcagttgcttgtttcatcgttaactaaaatacaggctggaaaagaagctctaagtcacttatataatgaaagtgcttctaccatggagatcttagctgtgcttaaagcctgggcagaggtctacataattgctgtgcaaagacataaaaaccacagacaacctttgaagactaccacctgtttagaagacggtatcagaaatggatcatgttcatcagatggactgcttgacttagtctatgcagatcttggcacactaagcagactctggcttgctgcacttcaggattttgctcttttaactttgccttcagaatttgcctcccaacttcctgctgaaggtggtgctttctacacagcagagactagtgaaaatgcaaaattgcattattacaactcctgggcacttatcctccatgctacagcattgtggcttacaagcacgggttttgttgttgctgacccagatgaaggagcatctaatctctccaggcctgtaacaccaacttccatgtgtcagggttcatcatctggggctaccataaagtcccctgaggatgtctacactgatagattccatcttattttaggaatcagcgtggaatttctatgttccttacgttcagatgcaaccatggaaagcataactgcttgtttacatgcattgcaagcacttctagatgtaccttggcccagatcaaaaattggcagtgatcaggacttgggtatagaattgctgaatgttctacatcgagtaattttaaccagagaatcaccttccattcagttggcttcacttgaagtggtaaggcagattatctgtgctgctcaagaacatgtgaaggaaaaaagacgaagtgcagaagttgatgatggggctgctgaaaaggaaactctgccagagtttggagagggaaaggacaccggaggacttgtgcctggaaagtctttggtctttgcaacactggaattgtgtgtatgcattctagttagacagctcccagaattaaaccctaaattgacaggtagcccaggagtaaaagctacgaagccacagatactattagaagatggaagtagattggtttcagctgcattggttatcctttccgaacttcctgcagtgtgctctcctgaagttgatgaaacacaccaagaacttgatgaagtcagtctacttactgctatcacagtgtttattttgtctaccagtccagaagtaactaccatcccatgccttcagaagcgctgtattgataaatttaaagctactcttgagataaaagatcctgtggtacaaatcaagacctaccagctcctacattccatctttcagtatccaaatccagctgtttcctacccatacatttactctttagcatcctgtatcatggaaaaactgcaggaaatagacaagagaaaacctgaaaacactgctgagcttgagatcttccaagaaggcataaaggtcttagaaacactggttactgttgctgaagaacaccatcgcgctcagctggtggcctgtcttttgcccatcctcatttccttccttttggatgaaaattctctgggatcagcaacttccataatgagaaatttacatgactttgctctacaaaatctcatgcaaattggacctcagtattcatctgtttttaaaagtttagtggcttcttctccagccctaaaagcccgccttgaggctgctataaagggcaatcaggaaagtgtcaaagtcaagataccaacatctaaatatactaagagtcctggaaaaaactcaagcatccaattaaagaccagtttcctctgattttttttttggaatagtaagcaccttaatataataaatacttgatcattgcctttggtgacaaaagggacattgtagacacaagtgcccttagaggtctagttgattgttttaccttaaatagctgtgactcttcaaagtaacagcatacttaacatttttgtgtgtgtgcgtggggtttgtgttttgttttgttttgtttttctatttaaaaagacaatggagctaacttgccaggaattttaagaaagtgctaaagaactaaacttactaaacaatccactgctttaaaaatgaaatgaatttcttctaacagtccatacatatgtggtatacttaatactgtgacagatataaatatgactctagtgtaaattatctgcactaatattgtatcccaattgctgatttaaaattctgctttggcccggcacagtggctcatccctgtaattccagcactttggaaggccaaggcgggcggatcacgaagtcgggagtttgagaccagcctgaccaacatggtgaaaccccgtctctactaaaaatacaaaaattagccgggtgtggtggcacacacctgtaatcccagctactcaggaggccgaggcaggaaaatcgcttgaacctggcaggcagaggttgcagtgagccaagattgtgccactgcactccagcctgggcgacagagtgagactccatctaaaaaaaaaaaaaaaaaattctgccttattcagtaattgtattaaactttctctgatttctccaagaagataaaatgattggagagctatttaggaaacctggtctaggattatccagtatacaatagtacaaattacttacagccttacagtgcaacataagatttggtgtctatatcatggttttccaccatcttttggtttagtttatattgggttcagaaattgagtcttactcattttaaatagaataagccatttccactatttttcaaatggatttttctgtttacctctgttcttaccaattttgttcattttcatttgtggcaaacatttgtatcaatgagttttaacctaggttcatatctacattgtatttagatcaactatgggtttatataaatgccaaatttagtacaacaaatttaggtcatcaggtgaatacaagtattttttttaacaggaaacattttattatagaaaaaagattaatgataaagtcatattggttgaaaaatattttttaactgtgttcatgattgttgattctccttctacttcagtgttatactgtgtgaatcaagcactgtgtcaaaacagagcatttccctcttaaaaattacaaaccgaagtgatagaagcatgtcagaattgagaagacattttgaagcaagaacaatgtgatgtacctattttattatgtttgtatataaatactattgtaaattgttcagagtgaaaacatttgacaaactctaacactacaatcattttttctaaattacataaataaagctaattttcattatca

SEQ ID NO: 4154 - DNA, 6856 bp, Homo sapiens
ctttggaggaagttctggaattactaggaacagggtttctacgtgggagttcaggattccttcgagccagtggagatatgctgaaaggaaccagttcagtcagtagggatgttcgagttggagttactcaggcttatgtggtatttgtttcaacactaggaggagcttggctagagaaaaattttgctgcctttttttctcatatcctaagccttgcgtcaccgtcacaccctaaagccacccaaactcagatcgatgccgtctgctgtcgccgttgtgtttcatttattcttcgaactactataggtggtcttcttggagaaaaggctcagcttgctgctgtaaaggatatttgccaggccatctggaagctaaagaaagttatggatgccgtaatgagtgatggtaatttggaaacccggcttggttccacagatgtagccgctagccaacatatgctggtttgtgctttacaagaacttggaaatctcatacacaatcttggcaccacagcggcacctttgctacaggattcaagtacaggtctccttgacagtatcttgtcagttattcttcatcctagcatttctgttcgactagcagcagcttggtgtttacactgcattgccgtggcattaccctcctacctaacaccactcttggatcgttgccttgaacggcttactggacataagtcttcacctgaagcagtgactggcttcagttttgctgtagcagctttgttgggagcagtaaaacattgtcctttaggaattcctcatggaaaaggcaagattattatgacattagcagaggatttgctgtgttctgctgctcaaaacagtcgcctttcagctcagcgcacacaagctggatggttgctgatttctgctctgatgacattaggtcctgcagttgttagccatcaccttgctcgagttctgctgttgtggaagtgtgtctttccagcatctcctaaagatctagaaacagaaaagagccgaggagattcgtttacatggcaggtgaccctggaaggacgagctggtgcactgtgtgctatcaagagctttgtttcccactgtggtgatcttcttactgaggaagtaactcagcgtcttcttccaccacttccttgtgctgtggatttgctaactcagctttcttcaatactaaaaatgtatggaagtcctttgaaaacaccgtcagtggtttatagacaaagactttatgaactgttgattttattacctcctgagacctatgaaggaaacctctgtgctatcctcagagagctggctgctgacttgactgcccctgatattcaggtggcagcatctacatttttacttccacccctctgtcatcaggatgatcttttgatactaagtcctttcctacaagagactgaccatagatttattgaagaacagctcctgcttggtaatggtgttgcttgcggaagtcttgaatatgacccttattcgatttatgagaaagatgtagagggagattcagtgcctaagcccttacctccagcactatcagttattagttctgcatccaagctctttggggttgtatgcgctcatgtgggagaaactcaaaggcttcttatattggaacagcttttggacagtataaagcacacaaaaggagctcgtcagcaagtggttcagttacatgttgtttcttcagtttctagtttcttgaagtacgtggctggctccaagggatgtttaggtccagaagaaatgaaaagatttgccttaacattagttatgggagccctagaaagccccaaccccttgctgagatgtgcagctgcagagtcatgggctagattagcccaagtggtagatgatggagcttttactgctggattagctcaagttagctttgacaaattgaaatcagcaagggatgtggttaccagaacaggacactcattggccttggggtccctacataggtatttaggaggaataagttcttctcaacacctaaattcttgtattggaatcctttatactttggcgcaggacagcacttctcctgatgtgcagacctgggcattacattctctatcattgatcattgattctgctggcccactctattatgtgcatgtggaacctaccctttctcttattataatgttgttgttaaatgtgcctcctactcatgctgaagttcaccaaagccttggtcgctgtttgaatgcccttattaccacgttaggtccagagctacaaggtaacagtacttcaatttctaccttaaggacttcctgtctactgggttgtgcagtaatgcaagataacccagactgccttgttcaagctcaggccatctcttgccttcagcagcttcatatgtttgctccacgacatgtcaacttgtctagcctggttagctgcctctgtgtgaatctttgtagcccctacttgttactgagaagagcagtactggcttgcttacgtcagcttgtacaaagagaagcagctgaagtttcagaacatgctgttatgcttgctaaggatagcagagaagagttgactccagatgctaacatcagagaagttggccttgagggggcattgttgatcttactagacaaggagacagatgagagattatgccatgatatcaaagagactttaaattatatgcttacatctatggcagtggaaaaactctccctgtggttaaagctttgtaaagatgtacttgctgcatcagctgattttacagctgtaacttgtgtggatacaatgcaagaagaagaaggagataaaggggatgatgcctcagtcctgaccaccagacgtgatgaaaaatcccatccttttaccaatccccgatgggctactagagtctttgctgctgaatgtgtctgtaggataattaaccaatgtgagaatgctaacagtgcacattttgacattgctttagcacaagaaatgaaaaaaagagattcaagaaatgactttttggtactgcatcttgctgacttaattcgcatggcttttatggctgccacagatcacagtgaccagctccgtctttctggccttgaaatgctgttagttgttattcggcgatttgcaactgttccagaaccagagtttccaggtcatgtgattctggaacagtatcaagccaatgtaggagcagcgcttagaccagccttcacttcagagacaccacctgatgtcactgccaaagcatgtcaggtttgcagtgcctggatagcaagtggagttgtaagtgaccttaatgatctccgaagagttcatcagttgcttgtttcatcgttaactaaaatacaggctggaaaagaagctctaagtcacttatataatgaaagtgcttctaccatggagatcttagctgtgcttaaagcctgggcagaggtctacataattgctgtgcaaagacataaaaaccacagacaacctttgaagactaccacctgtttagaagacggtatcagaaatggatcatgttcatcagatggactgcttgacttagtctatgcagatcttggcacactaagcagactctggcttgctgcacttcaggattttgctcttttaactttgccttcagaatttgcctcccaacttcctgctgaaggtggtgctttctacacagcagagactagtgaaaatgcaaaattgcattattacaactcctgggcacttatcctccatgctacagcattgtggcttacaagcacgggttttgttgttgctgacccagatgaaggagcatctaatctctccaggcctgtaacaccaacttccatgtgtcagggttcatcatctggggctaccataaagtcccctgaggatgtctacactgatagattccatcttattttaggaatcagcgtggaatttctatgttccttacgttcagatgcaaccatggaaagcataactgcttgtttacatgcattgcaagcacttctagatgtaccttggcccagatcaaaaattggcagtgatcaggacttgggtatagaattgctgaatgttctacatcgagtaattttaaccagagaatcaccttccattcagttggcttcacttgaagtggtaaggcagattatctgtgctgctcaagaacatgtgaaggaaaaaagacgaagtgcagaagttgatgatggggctgctgaaaaggaaactctgccagagtttggagagggaaaggacaccggaggacttgtgcctggaaagtctttggtctttgcaacactggaattgtgtgtatgcattctagttagacagctcccagaattaaaccctaaattgacaggtagcccaggagtaaaagctacgaagccacagatactattagaagatggaagtagattggtttcagctgcattggttatcctttccgaacttcctgcagtgtgctctcctgaaggaagcatctcaattctccctactatattgtacctcacaatcggggtcctcagagagactgctgtgaagttacctgggggccagttatcttcgacagttgcagcttccctacaggctctaaaaggaatattatcttctcccatggcccgggcagaaaagagccgtactgcttggactgaccttctccgaagtgccttaacaacaattcttgactgttgggatccagttgatgaaacacaccaagaacttgatgaagtcagtctacttactgctatcacagtgtttattttgtctaccagtccagaagtaactaccatcccatgccttcagaagcgctgtattgataaatttaaagctactcttgagataaaagatcctgtggtacaaatcaagacctaccagctcctacattccatctttcagtatccaaatccagctgtttcctacccatacatttactctttagcatcctgtatcatggaaaaactgcaggaaatagacaagagaaaacctgaaaacactgctgagcttgagatcttccaagaaggcataaaggtcttagaaacactggttactgttgctgaagaacaccatcgcgctcagctggtggcctgtcttttgcccatcctcatttccttccttttggatgaaaattctctgggatcagcaacttccataatgagaaatttacatgactttgctctacaaaatctcatgcaaattggacctcagtattcatctgtttttaaaagtttagtggcttcttctccagccctaaaagcccgccttgaggctgctataaagggcaatcaggaaagtgtcaaagtcaagataccaacatctaaatatactaagagtcctggaaaaaactcaagcatccaattaaagaccagtttcctctgattttttttttggaatagtaagcaccttaatataataaatacttgatcattgcctttggtgacaaaagggacattgtagacacaagtgcccttagaggtctagttgattgttttaccttaaatagctgtgactcttcaaagtaacagcatacttaacatttttgtgtgtgtgcgtggggtttgtgttttgttttgttttgtttttctatttaaaaagacaatggagctaacttgccaggaattttaagaaagtgctaaagaactaaacttactaaacaatccactgctttaaaaatgaaatgaatttcttctaacagtccatacatatgtggtatacttaatactgtgacagatataaatatgactctagtgtaaattatctgcactaatattgtatcccaattgctgatttaaaattctgctttggcccggcacagtggctcatccctgtaattccagcactttggaaggccaaggcgggcggatcacgaagtcgggagtttgagaccagcctgaccaacatggtgaaaccccgtctctactaaaaatacaaaaattagccgggtgtggtggcacacacctgtaatcccagctactcaggaggccgaggcaggaaaatcgcttgaacctggcaggcagaggttgcagtgagccaagattgtgccactgcactccagcctgggcgacagagtgagactccatctaaaaaaaaaaaaaaaaaattctgccttattcagtaattgtattaaactttctctgatttctccaagaagataaaatgattggagagctatttaggaaacctggtctaggattatccagtatacaatagtacaaattacttacagccttacagtgcaacataagatttggtgtctatatcatggttttccaccatcttttggtttagtttatattgggttcagaaattgagtcttactcattttaaatagaataagccatttccactatttttcaaatggatttttctgtttacctctgttcttaccaattttgttcattttcatttgtggcaaacatttgtatcaatgagttttaacctaggttcatatctacattgtatttagatcaactatgggtttatataaatgccaaatttagtacaacaaatttaggtcatcaggtgaatacaagtattttttttaacaggaaacattttattatagaaaaaagattaatgataaagtcatattggttgaaaaatattttttaactgtgttcatgattgttgattctccttctacttcagtgttatactgtgtgaatcaagcactgtgtcaaaacagagcatttccctcttaaaaattacaaaccgaagtgatagaagcatgtcagaattgagaagacattttgaagcaagaacaatgtgatgtacctattttattatgtttgtatataaatactattgtaaattgttcagagtgaaaacatttgacaaactctaacactacaatcattttttctaaattacataaataaagctaattttcattatca

SEQ ID NO: 4155 - DNA, 7840 bp, Homo sapiens
aatgcctcgctgtcgccgccgccggcaattccagactctgctagggttagcagagcagccggtaacgttgctggaccgggacgcacgctcagctgaggaggacccccaaagatttttattgttaggtatattgaccaaagtttaacgagaagaactgtgatcagctgggaggattgctgcaaggaatggaattagctcatagcttactgctgaatgaagaagcatacaatcaactaggtgaagttcagaaggcagagtttatttttgagtggttgagatacttggagaagctcttgttggcaaccagcaggaatgatgtaagggagaaacagaagactcttgttgaacagctcctgtctttgttgaacagctccccagggcctcctacccgcaaactgcttgctaagaatctagccatactttatagtattggagacacattctccgttcatgaagcaatcgataaatgtaatgatcttattcgtagcaaagatgattctccaagttatcttcccactaagcttgctgctgtggtatgtttgggttccttgtacaagaagttgggtagaatactgggtaacacctttactgatacagtggggaatattcttaaagctatgaagagtgcagagtctcaaggccgatatgagattatgctaagtctgcaaaatatattgaatggactaggagctgccgctgcaccttgtcacagggatgtttataaagctgctagatcctgcttgacagatagatccatggctgttcgttgtgctgctgcaaagtgtctccttgaacttcagaatgaagccatctttatgtggagtacggacctggacagtgtggccacactgtgttttaagtcctttgaaggttccaattatgatgtgcggatttctgtttcaaagttactaggcataatattagctaaagctgtaatttctaaacatccaggaacagcagcctcacgtcaaagcattcgcagagtatctttggaggaagttctggaattactaggaacagggtttctacgtgggagttcaggattccttcgagccagtggagatatgctgaaaggaaccagttcagtcagtagggatgttcgagttggagttactcaggcttatgtggtatttgtttcaacactaggaggagcttggctagagaaaaattttgctgcctttttttctcatatcctaagccttgcgtcaccgtcacaccctaaagccacccaaactcagatcgatgccgtctgctgtcgccgttgtgtttcatttattcttcgaactactataggtggtcttcttggagaaaaggctcagcttgctgctgtaaaggatatttgccaggccatctggaagctaaagaaagttatggatgccgtaatgagtgatggtaatttggaaacccggcttggttccacagatgtagccgctagccaacatatgctggtttgtgctttacaagaacttggaaatctcatacacaatcttggcaccacagcggcacctttgctacaggattcaagtacaggtctccttgacagtatcttgtcagttattcttcatcctagcatttctgttcgactagcagcagcttggtgtttacactgcattgccgtggcattaccctcctacctaacaccactcttggatcgttgccttgaacggcttactggacataagtcttcacctgaagcagtgactggcttcagttttgctgtagcagctttgttgggagcagtaaaacattgtcctttaggaattcctcatggaaaaggcaagattattatgacattagcagaggatttgctgtgttctgctgctcaaaacagtcgcctttcagctcagcgcacacaagctggatggttgctgatttctgctctgatgacattaggtcctgcagttgttagccatcaccttgctcgagttctgctgttgtggaagtgtgtctttccagcatctcctaaagatctagaaacagaaaagagccgaggagattcgtttacatggcaggtgaccctggaaggacgagctggtgcactgtgtgctatcaagagctttgtttcccactgtggtgatcttcttactgaggaagtaactcagcgtcttcttccaccacttccttgtgctgtggatttgctaactcagctttcttcaatactaaaaatgtatggaagtcctttgaaaacaccgtcagtggtttatagacaaagactttatgaactgttgattttattacctcctgagacctatgaaggaaacctctgtgctatcctcagagagctggctgctgacttgactgcccctgatattcaggtggcagcatctacatttttacttccacccctctgtcatcaggatgatcttttgatactaagtcctttcctacaagagactgaccatagatttattgaagaacagctcctgcttggtaatggtgttgcttgcggaagtcttgaatatgacccttattcgatttatgagaaagatgtagagggagattcagtgcctaagcccttacctccagcactatcagttattagttctgcatccaagctctttggggttgtatgcgctcatgtgggagaaactcaaaggcttcttatattggaacagcttttggacagtataaagcacacaaaaggagctcgtcagcaagtggttcagttacatgttgtttcttcagtttctagtttcttgaagtacgtggctggctccaagggatgtttaggtccagaagaaatgaaaagatttgccttaacattagttatgggagccctagaaagccccaaccccttgctgagatgtgcagctgcagagtcatgggctagattagcccaagtggtagatgatggagcttttactgctggattagctcaagttagctttgacaaattgaaatcagcaagggatgtggttaccagaacaggacactcattggccttggggtccctacataggtatttaggaggaataagttcttctcaacacctaaattcttgtattggaatcctttatactttggcgcaggacagcacttctcctgatgtgcagacctgggcattacattctctatcattgatcattgattctgctggcccactctattatgtgcatgtggaacctaccctttctcttattataatgttgttgttaaatgtgcctcctactcatgctgaagttcaccaaagccttggtcgctgtttgaatgcccttattaccacgttaggtccagagctacaaggtaacagtacttcaatttctaccttaaggacttcctgtctactgggttgtgcagtaatgcaagataacccagactgccttgttcaagctcaggccatctcttgccttcagcagcttcatatgtttgctccacgacatgtcaacttgtctagcctggttagctgcctctgtgtgaatctttgtagcccctacttgttactgagaagagcagtactggcttgcttacgtcagcttgtacaaagagaagcagctgaagtttcagaacatgctgttatgcttgctaaggatagcagagaagagttgactccagatgctaacatcagagaagttggccttgagggggcattgttgatcttactagacaaggagacagatgagagattatgccatgatatcaaagagactttaaattatatgcttacatctatggcagtggaaaaactctccctgtggttaaagctttgtaaagatgtacttgctgcatcagctgattttacagctgtaacttgtgtggatacaatgcaagaagaagaaggagataaaggggatgatgcctcagtcctgaccaccagacgtgatgaaaaatcccatccttttaccaatccccgatgggctactagagtctttgctgctgaatgtgtctgtaggataattaaccaatgtgagaatgctaacagtgcacattttgacattgctttagcacaagaaatgaaaaaaagagattcaagaaatgactttttggtactgcatcttgctgacttaattcgcatggcttttatggctgccacagatcacagtgaccagctccgtctttctggccttgaaatgctgttagttgttattcggcgatttgcaactgttccagaaccagagtttccaggtcatgtgattctggaacagtatcaagccaatgtaggagcagcgcttagaccagccttcacttcagagacaccacctgatgtcactgccaaagcatgtcaggtttgcagtgcctggatagcaagtggagttgtaagtgaccttaatgatctccgaagagttcatcagttgcttgtttcatcgttaactaaaatacaggctggaaaagaagctctaagtcacttatataatgaaagtgcttctaccatggagatcttagctgtgcttaaagcctgggcagaggtctacataattgctgtgcaaagacataaaaaccacagacaacctttgaagactaccacctgtttagaagacggtatcagaaatggatcatgttcatcagatggactgcttgacttagtctatgcagatcttggcacactaagcagactctggcttgctgcacttcaggattttgctcttttaactttgccttcagaatttgcctcccaacttcctgctgaaggtggtgctttctacacagcagagactagtgaaaatgcaaaattgcattattacaactcctgggcacttatcctccatgctacagcattgtggcttacaagcacgggttttgttgttgctgacccagatgaaggagcatctaatctctccaggcctgtaacaccaacttccatgtgtcagggttcatcatctggggctaccataaagtcccctgaggatgtctacactgatagattccatcttattttaggaatcagcgtggaatttctatgttccttacgttcagatgcaaccatggaaagcataactgcttgtttacatgcattgcaagcacttctagatgtaccttggcccagatcaaaaattggcagtgatcaggacttgggtatagaattgctgaatgttctacatcgagtaattttaaccagagaatcaccttccattcagttggcttcacttgaagtggtaaggcagattatctgtgctgctcaagaacatgtgaaggaaaaaagacgaagtgcagaagttgatgatggggctgctgaaaaggaaactctgccagagtttggagagggaaaggacaccggaggacttgtgcctggaaagtctttggtctttgcaacactggaattgtgtgtatgcattctagttagacagctcccagaattaaaccctaaattgacaggtagcccaggagtaaaagctacgaagccacagatactattagaagatggaagtagattggtttcagctgcattggttatcctttccgaacttcctgcagtgtgctctcctgaaggaagcatctcaattctccctactatattgtacctcacaatcggggtcctcagagagactgctgtgaagttacctgggggccagttatcttcgacagttgcagcttccctacaggctctaaaaggaatattatcttctcccatggcccgggcagaaaagagccgtactgcttggactgaccttctccgaagtgccttaacaacaattcttgactgttgggatccagttgatgaaacacaccaagaacttgatgaagtcagtctacttactgctatcacagtgtttattttgtctaccagtccagaagtaactaccatcccatgccttcagaagcgctgtattgataaatttaaagctactcttgagataaaagatcctgtggtacaaatcaagacctaccagctcctacattccatctttcagtatccaaatccagctgtttcctacccatacatttactctttagcatcctgtatcatggaaaaactgcaggaaatagacaagagaaaacctgaaaacactgctgagcttgagatcttccaagaaggcataaaggtcttagaaacactggttactgttgctgaagaacaccatcgcgctcagctggtggcctgtcttttgcccatcctcatttccttccttttggatgaaaattctctgggatcagcaacttccataatgagaaatttacatgactttgctctacaaaatctcatgcaaattggacctcagtattcatctgtttttaaaagtttagtggcttcttctccagccctaaaagcccgccttgaggctgctataaagggcaatcaggaaagtgtcaaagtcaagataccaacatctaaatatactaagagtcctggaaaaaactcaagcatccaattaaagaccagtttcctctgattttttttttggaatagtaagcaccttaatataataaatacttgatcattgcctttggtgacaaaagggacattgtagacacaagtgcccttagaggtctagttgattgttttaccttaaatagctgtgactcttcaaagtaacagcatacttaacatttttgtgtgtgtgcgtggggtttgtgttttgttttgttttgtttttctatttaaaaagacaatggagctaacttgccaggaattttaagaaagtgctaaagaactaaacttactaaacaatccactgctttaaaaatgaaatgaatttcttctaacagtccatacatatgtggtatacttaatactgtgacagatataaatatgactctagtgtaaattatctgcactaatattgtatcccaattgctgatttaaaattctgctttggcccggcacagtggctcatccctgtaattccagcactttggaaggccaaggcgggcggatcacgaagtcgggagtttgagaccagcctgaccaacatggtgaaaccccgtctctactaaaaatacaaaaattagccgggtgtggtggcacacacctgtaatcccagctactcaggaggccgaggcaggaaaatcgcttgaacctggcaggcagaggttgcagtgagccaagattgtgccactgcactccagcctgggcgacagagtgagactccatctaaaaaaaaaaaaaaaaaattctgccttattcagtaattgtattaaactttctctgatttctccaagaagataaaatgattggagagctatttaggaaacctggtctaggattatccagtatacaatagtacaaattacttacagccttacagtgcaacataagatttggtgtctatatcatggttttccaccatcttttggtttagtttatattgggttcagaaattgagtcttactcattttaaatagaataagccatttccactatttttcaaatggatttttctgtttacctctgttcttaccaattttgttcattttcatttgtggcaaacatttgtatcaatgagttttaacctaggttcatatctacattgtatttagatcaactatgggtttatataaatgccaaatttagtacaacaaatttaggtcatcaggtgaatacaagtattttttttaacaggaaacattttattatagaaaaaagattaatgataaagtcatattggttgaaaaatattttttaactgtgttcatgattgttgattctccttctacttcagtgttatactgtgtgaatcaagcactgtgtcaaaacagagcatttccctcttaaaaattacaaaccgaagtgatagaagcatgtcagaattgagaagacattttgaagcaagaacaatgtgatgtacctattttattatgtttgtatataaatactattgtaaattgttcagagtgaaaacatttgacaaactctaacactacaatcattttttctaaattacataaataaagctaattttcatta

SEQ ID NO: 4156 - DNA, 6905 bp, Homo sapiens
ggtggggcatccgggtctcttggtggctgcttctacccccggagctcagctgatcttcccttccagactacgaggtgtgaatttcaaacttccgtaatggagttagcccacagtttattgctaaatgaagaagctttggctcaaatcaccgaagcaaaaagaccagttttcatctttgaatggttgcgatttcttgataaagtcttggttgctgccaacaagaccgatgtaaaggaaaaacagaaaaaacttgttgaacaattaactggattaataagtagttcacctggaccacctacacgaaaattattagctaaaaatctcgcagccctttatagcattggggatactttcacagtttttcagacacttgataaatgcaatgacattatcagaaataaagatgacactgcggcctacttaccaacaaaattggctgcggtggcttgtgtcggagcattttatgaaaaaatggggagaatgttgggcagcgcatttccagaaacggtaaataatctattgaaatctctgaaaagtgcagagtctcaagggcgaagtgaaatcttaatgagtctacagaaagttctaagtggactgggtggtgcagcagcttcctcccatcgtgatatttacaagaatgccaggtctctcttgactgataggtcaatggctgttcgatgtgcagtggccaagtgtctactagaactacagaatgaagctgtatttatgtggactgctgaactagaaaatatagccactctctgctttaaggctttggaaaactcaaattatggggtacgagtggcagtgtctaaacttttaggaacagtcatggccacagcattaatgccaaaacaggcaacagtaatgcgtcagaatgtgaagcgagcaacatttgatgaagtcttagaactcatggccacaggatttctgcgtggagggtcaggtttcttaaagagcggtggagaaatgttaaaagttggagggtccgttaatcgtgaagtgagagttggagttacgcaggcgtatgttgtttttgtgacaacattgggtggtcagtggttggagcgcagctttgccacgttcctgtcccatgtacttgatctggtttcccatcctcgggcaacacaaacacatgtggaggctgtgtactccagacgatgtgtttcctttatcctaagagctactgtgggcagtttgctaggtgaaaaagcccagattgcagctgccaaagaaatctgccaagctattggaaaacaaatgaaagccgtagaagcagtagtgaatgacacaagtggagaaaacaaatctggcgcagcagacattgcagcaagccagcatgtgatggtctgtgccctccaggaactcgggagcctggtgcagagcttgaatgccaccgcatcccctcttattcaagaagcatctatagggcttttggagattgtgacttcagtgctgcttcatccaagcatggctgcccgacttgctgctgcatggtgtttgcgctgtgtggctgtggcattacctttccagctgacaccatttctagacaggtgtgcagaacggctcaacaacttgaagacctcaccagaagctgtcagtggatatagttttgcaatggctgctttgttaggtggagtacatcagtgtcctttgggcattcctcatgccaaaggaaagatggtagttagtattgctgaagatcttttacgaactgctgcccaaaatagcaggctatctttacagcgcacccaagctggctggcttttacttggagcacttatgactttaggaccatctgtcgttcgttaccatctgcccaagatgttgttattgtggcgaaatgttttcccacgttccttaaaggaattggaagctgagaaggcccgaggcgattcttttacctggcaggtaactttggaaggtcgtgctggagctctatgtgccatgaggagcttcgttgcacattgtcctgagctactaactgaagatgtgattcgaaaattgatgacccctattgaatgtgccatgactatgatgtcacacattccatctgtaatgaaagcccatggagctcatctgaaagctagtgctgcaatggtccgtttaagactttatgatatcttggctttgttacctccaaaaacttatgaaggatcttttaatgcacttcttagagaactggtagcggaattcactttgactgacaactcagccaacacaactacttccctcctcagatccctctgccattatgatgatagtgttcttcttggttcttggcttcaggaaactgatcataaatcaattgaagaccagctccagccaaacagtgcctctggaagtggggctctggagcatgatccttcctctatttatttacgcatacctgctggagaagcagtacctggtcccctccctctcggagtctcagtcattgatgcttctgtggccctttttggtgtagtgtttcctcatgtttcttataaacaccgattacaaatgttggatcactttgctgaatgtgttaaacaagctaaaggtgtccgccagcaggctgtgcagcttaacatatttactgctgttcttagtgcactaaagggcttagctgaaaacaaaagtactttaggacctgaggaagttcgtaaatctgccctgacactggttatgggtcctctggacaacccaaaccccatcttacgttgtgcagcgggggaagctcttggaagaatggctcaggtggttggagaagcaacttttattgctagaatggcccaatatagctttgacaagttgaaatcggctcgagatgttgtatctaggactggtcattcattggctcttggttgtttgcatcgttatgttggtggaataggctcaggacaacatctgaagaccagtgtcagcattttattggctctagcacaagatgggacatcccctgaagtccagacttggtctcttcattcacttgctttgatagtggattctagtggtccgatgtatcgtggctatgtggaaccaacattatctctagttcttaccttgctgttgacagttccgccttcacatacagaagttcatcagtgtttgggtcgatgcttgggtgctataataactactgttggccctgaactacaagggaatggagcaacaacttctacaattcgttcctcttgtttggtgggttgtgcaataacacaagaccattcagattctcttgttcaggcagctgccatatcttgccttcagcagcttcacatgtttgcaccacgacatgtcaatctatctagccttgttcctagcctttgtgttcacttatgtagttcccatttgttacttcgacgagcagctgtggcatgtcttcggcaacttgcacaaagagaagcagcggaagtatgtgaatatgccatgagcctggcaaaaaatacaggggacaaagagagcagtagtgccaatgtcagtccttttgcccctggggttagttctcgaactgatatccattgccggcaccaaggtgttaatataacagaaactggtcttgagggacttctttttggaatgctagaccgggagacagatcgaaaattatgttctgatattcatgacactttgggacatatgctttcttcgctggcagtagaaaaactttctcattggctaatgctttgtaaagatgtcctggcagcttctagtgatatgagtactgcaactctcttaagtagtggaaaagatgaagaagctgaaaagaaagatgagatggatgatgataccatgtttaccacgttaggtgaagaagataaatcaaagccctttgtggcccctcgctgggccactcgagtatttgctgccgattgcctgtgtcgaatcatcaatttgtgtgagaatgcagaccaggctcactttgatcttgccttggcacgttctgctaaacttcgaaaccctacaaatgacctcttggtacttcatctctctgacctcattcgcatggcattcatggctgcaactgatcatagcaaccagctgcgaatggctgggctccaggcgcttgaagacattatcaagaagtttgcgtctgtgcctgagccagaatttccaggtcatgtgatactggagcagtatcaggctaatgtgggagctgctctaagaccagccttttcacaagatacaccatcagatataatagcgaaagcttgccaggtatgtagtacatggataggaagtggagttgtcagtgatctcaatgatctccgtcgagtacacaatcttcttgtttcttctctggacaaagttcaggctggaaaaggatcttccagccagctgtaccgagagagtgccacgaccatggaaaaactggctgttctcaaagcttgggcagaggtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtggagcattttatacccctgaaactattgatacagctagacttcactatcggaattcctgggccccaattctccatgcggtggcactttggttaaatagcacaggatttacgtgctcagagtctacagaagcagcagcaatatctggtttacaaaaacgttctacatctgtcaatttaaaccaggcatcaggagcagtgggtagtgctaaatctttgccagaaattaacaaagacagaatgcatctgattttaggtgtgagtatacagtttctttgttcccctagacctgaggagcccattgaacatgttacagcatgcctgcaggccttacataccttgctagactccccttatgctcgagtccatattgcagaagatcagctgataggtgttgagttgctgagtgttttgcaccgccttctattgacctggaatccatcatctgtccagctgttggttactggagttgtacaacagatagtaagagctgctcaggattatttgcaagagaaaagaaacactctaaatgaagatgatatggaaaaagaggcctgtaccgtattgggagaaggaggtgacagcggtggtctcattcctggaaaatctcttgtgtttgcaactatggagctgctgatgttcattttagtacggcatatgccacatctcagtaccaaggtgtcagactctccaagtcacatagccactaaaactcgactatcagaagaaagtgctcgtttggtggcagccacagttaccatactctctgatttaccatccctttgttcacccgctggatgtatgacaatcctgcccacaattctgttcttaattgcaagaatattgaaagacacagcaataaagtctgcagataatcaggttcctccaccagtcagtgcagctcttcaagggattaaaagtattgtgacactttcaatggccaaaactgaggctggcgttcaaaaacagtggacagctctgattcgtagcacgcttgcttgcatcctggaatattctcaaccagaagactctgtacctacacctgatgaagtaagcatgctaacagcaattgcactcttcctgtggtctgctagtaatgaaataataggagtccagtcattacagaatggctgcatgaacagatttaaaaatgcattaaattcatgcgacccatgggttcaagccaaatgttaccagcttctcctctcagtcttccagcattccaatcgtgccctttcaactccttatattcattcattagctccaatagtggttgaaaagctaaaagctgttgaaagaaacagaccagccagtaacatagagcttttagcggttcaagaaggaataaaagttcttgaaacactggttgctcttggtgaagaacaaaacagagtccagctacttgctcttttagttcccactttgatatcttacctgctggatgaaaattcttttgcctcagcaagttcagcttccaaagatcttcatgagtttgcactccagaatttaatgcatattggacctctgtatccacatgctttcaagacagtaatgggggctgctcctgagttgaaagtgcgtctagaaactgccgttcgagcaagccaagcgagcaaagctaaagcggctgccagacaaccagcccccgccatacattctgcaccaacaattaagctaaaaacaagttttttttaatttgtaatttcatttatttgtatttatgttgtcaactagcccctaattagtgatggccactgtatcattccaggctacctatgggttctgttttatttgtatattggtattatagtgcttccaagtaggttaagtgaaataatgctcacaccacttattgatttttaaggagtgattttttttatcatgtggtgaatatgttttcattttcctcctaataatgtttctcttttgttaacttatttatttttcaaacactgagccatagtcttaaatttaaatgctaaaaacaattgtatcatgtagtcgggcagcctattgatactgtcaggggaaaaaaatgggtcagaactcagcatctgtcatgaaaaaaatcaattgaaaaacaagcagattttaaattttgaagtaatcaaaataatggaaagtgtctgttttgtggtgtatatactatgaataaaatcacagcattttctaagcatttcccaaaatgtccttatctttctgatggatcttttagctttcatatcaaattactaaattatgctatgtatattttagttggtaacaattaaaattctcatttaaaggtt

SEQ ID NO: 4157 - DNA, 6525 bp, Homo sapiens
ggtggggcatccgggtctcttggtggctgcttctacccccggagctcagctgatcttcccttccagactacgaggtgtgaatttcaaacttccgtaatggagttagcccacagtttattgctaaatgaagaagctttggctcaaatcaccgaagcaaaaagaccagttttcatctttgaatggttgcgatttcttgataaagtcttggttgctgccaacaagaccgatgtaaaggaaaaacagaaaaaacttgttgaacaattaactggattaataagtagttcacctggaccacctacacgaaaattattagctaaaaatctcgcagccctttatagcattggggatactttcacagtttttcagacacttgataaatgcaatgacattatcagaaataaagatgacactgcggcctacttaccaacaaaattggctgcggtggcttgtgtcggagcattttatgaaaaaatggggagaatgttgggcagcgcatttccagaaacggtaaataatctattgaaatctctgaaaagtgcagagtctcaagggcgaagtgaaatcttaatgagtctacagaaagttctaagtggactgggtggtgcagcagcttcctcccatcgtgatatttacaagaatgccaggtctctcttgactgataggtcaatggctgttcgatgtgcagtggccaagtgtctactagaactacagaatgaagctgtatttatgtggactgctgaactagaaaatatagccactctctgctttaaggctttggaaaactcaaattatggggtacgagtggcagtgtctaaacttttaggaacagtcatggccacagcattaatgccaaaacaggcaacagtaatgcgtcagaatgtgaagcgagcaacatttgatgaagtcttagaactcatggccacaggatttctgcgtggagggtcaggtttcttaaagagcggtggagaaatgttaaaagttggagggtccgttaatcgtgaagtgagagttggagttacgcaggcgtatgttgtttttgtgacaacattgggtggtcagtggttggagcgcagctttgccacgttcctgtcccatgtacttgatctggtttcccatcctcgggcaacacaaacacatgtggaggctgtgtactccagacgatgtgtttcctttatcctaagagctactgtgggcagtttgctaggtgaaaaagcccagattgcagctgccaaagaaatctgccaagctattggaaaacaaatgaaagccgtagaagcagtagtgaatgacacaagtggagaaaacaaatctggcgcagcagacattgcagcaagccagcatgtgatggtctgtgccctccaggaactcgggagcctggtgcagagcttgaatgccaccgcatcccctcttattcaagaagcatctatagggcttttggagattgtgacttcagtgctgcttcatccaagcatggctgcccgacttgctgctgcatggtgtttgcgctgtgtggctgtggcattacctttccagctgacaccatttctagacaggtgtgcagaacggctcaacaacttgaagacctcaccagaagctgtcagtggatatagttttgcaatggctgctttgttaggtggagtacatcagtgtcctttgggcattcctcatgccaaaggaaagatggtagttagtattgctgaagatcttttacgaactgctgcccaaaatagcaggctatctttacagcgcacccaagctggctggcttttacttggagcacttatgactttaggaccatctgtcgttcgttaccatctgcccaagatgttgttattgtggcgaaatgttttcccacgttccttaaaggaattggaagctgagaaggcccgaggcgattcttttacctggcaggtaactttggaaggtcgtgctggagctctatgtgccatgaggagcttcgttgcacattgtcctgagctactaactgaagatgtgattcgaaaattgatgacccctattgaatgtgccatgactatgatgtcacacattccatctgtaatgaaagcccatggagctcatctgaaagctagtgctgcaatggtccgtttaagactttatgatatcttggctttgttacctccaaaaacttatgaaggatcttttaatgcacttcttagagaactggtagcggaattcactttgactgacaactcagccaacacaactacttccctcctcagatccctctgccattatgatgatagtgttcttcttggttcttggcttcaggaaactgatcataaatcaattgaagaccagctccagccaaacagtgcctctggaagtggggctctggagcatgatccttcctctatttatttacgcatacctgctggagaagcagtacctggtcccctccctctcggagtctcagtcattgatgcttctgtggccctttttggtgtagtgtttcctcatgtttcttataaacaccgattacaaatgttggatcactttgctgaatgtgttaaacaagctaaaggtgtccgccagcaggctgtgcagcttaacatatttactgctgttcttagtgcactaaagggcttagctgaaaacaaaagtactttaggacctgaggaagttcgtaaatctgccctgacactggttatgggtcctctggacaacccaaaccccatcttacgttgtgcagcgggggaagctcttggaagaatggctcaggtggttggagaagcaacttttattgctagaatggcccaatatagctttgacaagttgaaatcggctcgagatgttgtatctaggactggtcattcattggctcttggttgtttgcatcgttatgttggtggaataggctcaggacaacatctgaagaccagtgtcagcattttattggctctagcacaagatgggacatcccctgaagtccagacttggtctcttcattcacttgctttgatagtggattctagtggtccgatgtatcgtggctatgtggaaccaacattatctctagttcttaccttgctgttgacagttccgccttcacatacagaagttcatcagtgtttgggtcgatgcttgggtgctataataactactgttggccctgaactacaagggaatggagcaacaacttctacaattcgttcctcttgtttggtgggttgtgcaataacacaagaccattcagattctcttgttcaggcagctgccatatcttgccttcagcagcttcacatgtttgcaccacgacatgtcaatctatctagccttgttcctagcctttgtgttcacttatgtagttcccatttgttacttcgacgagcagctgtggcatgtcttcggcaacttgcacaaagagaagcagcggaagtatgtgaatatgccatgagcctggcaaaaaatacaggggacaaagagagcagtagtgccaatgtcagtccttttgcccctggggttagttctcgaactgatatccattgccggcaccaaggtgttaatataacagaaactggtcttgagggacttctttttggaatgctagaccgggagacagatcgaaaattatgttctgatattcatgacactttgggacatatgctttcttcgctggcagtagaaaaactttctcattggctaatgctttgtaaagatgtcctggcagcttctagtgatatgagtactgcaactctcttaagtagtggaaaagatgaagaagctgaaaagaaagatgagatggatgatgataccatgtttaccacgttaggtgaagaagataaatcaaagccctttgtggcccctcgctgggccactcgagtatttgctgccgattgcctgtgtcgaatcatcaatttgtgtgagaatgcagaccaggctcactttgatcttgccttggcacgttctgctaaacttcgaaaccctacaaatgacctcttggtacttcatctctctgacctcattcgcatggcattcatggctgcaactgatcatagcaaccagctgcgaatggctgggctccaggcgcttgaagacattatcaagaagtttgcgtctgtgcctgagccagaatttccaggtcatgtgatactggagcagtatcaggctaatgtgggagctgctctaagaccagccttttcacaagatacaccatcagatataatagcgaaagcttgccaggtatgtagtacatggataggaagtggagttgtcagtgatctcaatgatctccgtcgagtacacaatcttcttgtttcttctctggacaaagttcaggctggaaaaggatcttccagccagctgtaccgagagagtgccacgaccatggaaaaactggctgttctcaaagcttgggcagaggtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtggagcattttatacccctgaaactattgatacagctagacttcactatcggaattcctgggccccaattctccatgcggtggcactttggttaaatagcacaggatttacgtgctcagagtctacagaagcagcagcaatatctggtttacaaaaacgttctacatctgtcaatttaaaccaggcatcaggagcagtgggtagtgctaaatctttgccagaaattaacaaagacagaatgcatctgattttaggtgtgagtatacagtttctttgttcccctagacctgaggagcccattgaacatgttacagcatgcctgcaggccttacataccttgctagactccccttatgctcgagtccatattgcagaagatcagctgataggtgttgagttgctgagtgttttgcaccgccttctattgacctggaatccatcatctgtccagctgttggttactggagttgtacaacagatagtaagagctgctcaggattatttgcaagagaaaagaaacactctaagatgtatgacaatcctgcccacaattctgttcttaattgcaagaatattgaaagacacagcaataaagtctgcagataatcaggttcctccaccagtcagtgcagctcttcaagggattaaaagtattgtgacactttcaatggccaaaactgaggctggcgttcaaaaacagtggacagctctgattcgtagcacgcttgcttgcatcctggaatattctcaaccagaagactctgtacctacacctgatgaagtaagcatgctaacagcaattgcactcttcctgtggtctgctagtaatgaaataataggagtccagtcattacagaatggctgcatgaacagatttaaaaatgcattaaattcatgcgacccatgggttcaagccaaatgttaccagcttctcctctcagtcttccagcattccaatcgtgccctttcaactccttatattcattcattagctccaatagtggttgaaaagctaaaagctgttgaaagaaacagaccagccagtaacatagagcttttagcggttcaagaaggaataaaagttcttgaaacactggttgctcttggtgaagaacaaaacagagtccagctacttgctcttttagttcccactttgatatcttacctgctggatgaaaattcttttgcctcagcaagttcagcttccaaagatcttcatgagtttgcactccagaatttaatgcatattggacctctgtatccacatgctttcaagacagtaatgggggctgctcctgagttgaaagtgcgtctagaaactgccgttcgagcaagccaagcgagcaaagctaaagcggctgccagacaaccagcccccgccatacattctgcaccaacaattaagctaaaaacaagttttttttaatttgtaatttcatttatttgtatttatgttgtcaactagcccctaattagtgatggccactgtatcattccaggctacctatgggttctgttttatttgtatattggtattatagtgcttccaagtaggttaagtgaaataatgctcacaccacttattgatttttaaggagtgattttttttatcatgtggtgaatatgttttcattttcctcctaataatgtttctcttttgttaacttatttatttttcaaacactgagccatagtcttaaatttaaatgctaaaaacaattgtatcatgtagtcgggcagcctattgatactgtcaggggaaaaaaatgggtcagaactcagcatctgtcatgaaaaaaatcaattgaaaaacaagcagattttaaattttgaagtaatcaaaataatggaaagtgtctgttttgtggtgtatatactatgaataaaatcacagcattttctaagc

SEQ ID NO: 4158 - DNA, 2400 bp, Homo sapiens
ggtggggcatccgggtctcttggtggctgcttctacccccggagctcagctgatcttcccttccagactacgaggtgtgaatttcaaacttccgtaatggagttagcccacagtttattgctaaatgaagaagctttggctcaaatcaccgaagcaaaaagaccagttttcatctttgaatggttgcgatttcttgataaagtcttggttgctgccaacaagaccgatgtaaaggaaaaacagaaaaaacttgttgaacaattaactggattaataagtagttcacctggaccacctacacgaaaattattagctaaaaatctcgcagccctttatagcattggggatactttcacagtttttcagacacttgataaatgcaatgacattatcagaaataaagatgacactgcggcctacttaccaacaaaattggctgcggtggcttgtgtcggagcattttatgaaaaaatggggagaatgttgggcagcgcatttccagaaacggtaaataatctattgaaatctctgaaaagtgcagagtctcaagggcgaagtgaaatcttaatgagtctacagaaagttctaagtggactgggtggtgcagcagcttcctcccatcgtgatatttacaagaatgccaggtctctcttgactgataggtcaatggctgttcgatgtgcagtggccaagtgtctactagaactacagaatgaagctgtatttatgtggactgctgaactagaaaatatagccactctctgctttaaggctttggaaaactcaaattatggggtacgagtggcagtgtctaaacttttaggaacagtcatggccacagcattaatgccaaaacaggcaacagtaatgcgtcagaatgtgaagcgagcaacatttgatgaagtcttagaactcatggccacaggatttctgcgtggagggtcaggtttcttaaagagcggtggagaaatgttaaaagttggagggtccgttaatcgtgaagtgagagttggagttacgcaggcgtatgttgtttttgtgacaacattgggtggtcagtggttggagcgcagctttgccacgttcctgtcccatgtacttgatctggtttcccatcctcgggcaacacaaacacatgtggaggctgtgtactccagacgatgtgtttcctttatcctaagagctactgtgggcagtttgctaggtgaaaaagcccagattgcagctgccaaagaaatctgccaagctattggaaaacaaatgaaagccgtagaagcagtagtgaatgacacaagtggagaaaacaaatctggcgcagcagacattgcagcaagccagcatgtgatggtctgtgccctccaggaactcgggagcctggtgcagagcttgaatgccaccgcatcccctcttattcaagaagcatctatagggcttttggagattgtgacttcagtgctgcttcatccaagcatggctgcccgacttgctgctgcatggtgtttgcgctgtgtggctgtggcattacctttccagctgacaccatttctagacaggtgtgcagaacggctcaacaacttgaagacctcaccagaagctgtcagtggatatagttttgcaatggctgctttgttaggtggagtacatcagtgtcctttgggcattcctcatgccaaaggaaagatggtagttagtattgctgaagatcttttacgaactgctgcccaaaatagcaggctatctttacagcgcacccaagctggctggcttttacttggagcacttatgactttaggaccatctgtcgttcgttaccatctgcccaagatgttgttattgtggcgaaatgttttcccacgttccttaaaggaattggaagctgagaaggcccgaggcgattcttttacctggcaggtaactttggaaggtcgtgctggagctctatgtgccatgaggagcttcgttgcacattgtcctgagctactaactgaagatgtgattcgaaaattgatgacccctattgaatgtgccatgactatgatgtcacacattccatctgtaatgaaagcccatggagctcatctgaaagctagtgctgcaatggtccgtttaagactttatgatatcttggctttgttacctccaaaaacttatgaaggatcttttaatgcacttcttagagaactggtagcggaattcactttgactgacaactcagccaacacaactacttccctcctcagatccctctgccattatgatgatagtgttcttcttggttcttggcttcaggaaactgatcataaatcaattgaagaccagctccagccaaacagtgcctctggaagtggggctctggagcatgatccttcctctatttatttactgctgttcttagtgcac

SEQ ID NO: 4159 - DNA, 3925 bp, Homo sapiens
ccccgcccgtagaaaagatggctgctgtgcaagttgtcggttcgtggccttccgtgcagccgcgggaggcaccgcgggaagcaatccctgagcgaggcaatgggtttcgcctcttgtctgccaggctctgcgccctgcgcccggatgacagcagctccgcccgcaccgagatccacctgctcttcgatcagctcatctccgagaactacagcgagggcagtggcgtggccccggaggacgttagtgctcttcttgtccaggcttgccgactggtacctcttaatcagaatcatcttgtcagcaaagtgagccagcttatccaccatttacttaacagattacaggtaattgttgatgaacagcacttggatttcctgttggcatatactatttcggctattcatcagtgtagttcctggacacacagggaaattcttcaagccctggcagctctggtgtactgcaatggctccaaatgtcaaaagtacctcccagagctgctaggcaacaccggactcttaatgaagttgagtgacttggctcagtctgatcctgaagtcaggagagctgcagtacattgtatggcaaacttatgtctcagtgtgccaggacagccgtatttggaggagccctaccaaaatgtctgtttccaagcttttctgactattttacagtctccaaaatcatctgatatggatgatatcacattttgcatgttattgcaaaatgcattaaaaggtatacagtcacttctaaatggtgggagaatgaaactaacacagactgatgaacttggagcacttttagctgtgctaaagaaattcatgtttcacggactccctggactaaacatagagatgcccacggtgttatacccaactccgcttcctcagtatgatgggcgaacacctatcaaaccacagcaatcagaatccagtgcttctcgaccaactttgaataaaaagaaaaaatccaaagtaaaaccaaagaaaatccagcaaggagaggaggaggaaaaggaatccagtggtgaaatagaggcagccccagtcactggcacaggcagagtgaacctgcatgaagggaacacttggtgtccctcctccctgggtgtccagagtttgcctttagatggaagtggagctgcagaaaaagatggagtctcctcatccttcagttcttccagttggaaaagggtcagcagtagtgagtcagacttttctgatgctgaaggaggcatgcagagtaaaatgaggtcttaccaagctaaagttcgccaaggagccttagtttgttttctttctactataaaatcgatagaaaaaaaagttctttatggctactggtcagcttttattcctgatacgcctgaacttggcagcccacagtcagtgtccttgatgactcttacattgaaagacccttctccaaagacacgtgcctgtgctctgcaagttttatctgccatcttggaaggctcaaagcagtttctttctgttgctgaagataccagtgaccacagaagggcttttacccccttctccgtaatgatcgcttgcagcattagagagttgcacagatgtcttttgttagctttggtggcggagtcatcctcacagaccgttactcagataattaagtgccttgcaaatttagtatcaaatgcaccttatgatcgtctaaaactcagcctgctgaccaaagtctggaaccagataaagccttatattcgccacaaagatgttaatgttcgtgtgtcaagtctcacactcttgggagctatagtgtccacccacgcacctttacctgaagtccaactacttctgcaacagccatgttcttctggactcggtaatagcaattcagcaacccctcacctcagccctcctgattggtggaagaaagcccctgcaggaccctctctggaagaaacgtcagttagctcacctaaggggtcttcagagccctgctggctcattcgactctgcatttccattgtcgtactgcccaaggaggattcctgttcaggtagcgatgctggctctgcagcaggaagcacctacgaaccatcccccatgcgactggaggccttacaggtattgactcttctggcaaggggctacttttcaatgactcaagcctacttgatggagcttggagaggtgatttgcaagtgcatgggggaagcagatccatccattcagcttcatggagcaaagcttctggaagaactgggcacaggcttaatacagcagtataaaccagactccactgcagcacctgatcagagagcaccagtcttcttggtggtgatgttctggactatgatgctgaacggtcctttacccagagccctgcagaattcagaacacccaactctccaggcgagcgcctgtgatgccctgtcttccatcttgccagaggccttcagcaatctgccgaatgacaggcagatgctgtgcatcacagtgctgctcgggctgaatgacagcaagaatcgcttagtgaaagctgcaacttcacgggccctgggagtctatgtgctttttccctgtctcagacaggatgtcatatttgttgcagacgcagcaaatgcaatattgatgtcacttgaagacaagtctctgaatgttcgagccaaagcagcctggtccctgggcaacctgacagacactctgattgtcaacatggaaacaccagacccaagtttccaggaagagttctctggtctcctgctcttgaaaatgttacgatcagctatagaagcatccaaggataaagacaaggtaaaaagcaatgcagtccgggcccttggaaatttgcttcattttctgcaaccctctcatatagaaaaacccacatttgcagaaatcattgaggagtctatccaggccctaatttctactgttctaacagaagctgccatgaaagtccgatggaatgcttgttatgcaatgggaaatgtatttaaaaatcctgcccttcctttagggacagccccatggacctcccaggcctacaatgccctgacatcggtcgtgacatcatgcaagaacttcaaagtgcgcatcagatctgcagctgccctttccgtcccggggaagagagagcagtacgggtctgttgaccagtatgctcggatctggaatgcattggtcaccgctttacagaagagtgaagacaccatagactttttggaattcaagtactgtgtcagcctacggacccaaatctgccaggcactgattcacctcttgagcttggccagtgcctcggacctcccttgtatgaaagaaacccttgaactgagtgggaatatggtccagtcctatattctacagtttttaaaatcaggagcagagggagatgacactggagcaccccacagcccacaggaaagagaccagatggtcagaatggcccttaaacacatgggcagcatccaggcaccaactggagacacagccagaagggccatcatgggctttttagaagagatcctggccgtttgttttgactcatctggatcacaaggggcactcccagggttaacaaatcagtgaagatcccaccatactttctagatgtcgaaggcggcagtaggaagacctgagcttgagcataagatctgtgggatttcatcttaggggcagaaacaatccgttcactatttatttagaatgacttagcagccatttaaattttcacagagggctcaaccacctttggagtgactccatagcactggccatggtcagggttgttggaacatctgacctgtgcatccaggagccgaggagtcaggttgtaatacaggccaagcagacgggctttgagggcatttagtctcagaaaaaaaaaatgtagaaggatttcggaattagaattttgtgtattgtatctgtagttttgtaataaactaacg

SEQ ID NO: 4160 - DNA, 3287 bp, Homo sapiens
agaaaagatggctgctgtgcaagttgtcggttcgtggccttccgtgcagccgcgggaggcaccgcgggaagcaatccctgagcgaggcaatgggtttcgcctcttgtctgccaggctctgcgccctgcgcccggatgacagcagctccgcccgcaccgagatccacctgctcttcgatcagctcatctccgagaactacagcgagggcagtggcgtggccccggaggacgttagtgctcttcttgtccaggcttgccgactggtacctcttaatcagaatcatcttgtcagcaaagtgagccagcttatccaccatttacttaacagattacaggtaattgttgatgaacagcacttggatttcctgttggcatatactatttcggctattcatcagtgtagttcctggacacacagggaaattcttcaagccctggcagctctggtgtactgcaatggctccaaatgtcaaagtacctcccagagctgctaggcaacaccggactcttaatgaagttgagtgacttggctcagtctgatcctgaagtcaggagagctgcagtacattgtatggcaaacttatgtctcagtgtgccaggacagccgtatttggaggagccctaccaaaatgtctgtttccaagcttttctgactattttacagtctccaaaatcatctgatatggatgatatcacattttgcatgttattgcaaaatgcattaaaaggtatacagtcacttctaaatggtgggagaatgaaactaacacagactgatgaacttggagcacttttagctgtgctaaagaaattcatgtttcacggactccctggactaaacatagagatgcccacggtgttatacccaactccgcttcctcagtatgatgggcgaacacctatcaaaccacagcaatcagaatccagtgcttctcgaccaactttgaataaaaagaaaaaatccaaagtaaaaccaaagaaaatccagcaaggagaggaggaggaaaaggaatccagtggtgaaatagaggcagccccagtcactggcacaggcagagtgaacctgcatgaagggaacacttggtgtccctcctccctgggtgtccagagtttgcctttagatggaagtggagctgcagaaaaagatggagtctcctcatccttcagttcttccagttggaaaagggtcagcagtagtgagtcagacttttctgatgctgaaggaggcatgcagagtaaaatgaggtcttaccaagctaaagttcgccaaggagccttagtttgttttctttctactataaaatcgatagaaaaaaaagttctttatggctactggtcagcttttattcctgatacgcctgaacttggcagcccacagtcagtgtccttgatgactcttacattgaaagacccttctccaaagacacgtgcctgtgctctgcaagttttatctgccatcttggaaggctcaaagcagtttctttctgttgctgaagataccagtgaccacagaagggcttttacccccttctccgtaatgatcgcttgcagcattagagagttgcacagatgtcttttgttagctttggtggcggagtcatcctcacagaccgttactcagataattaagtgccttgcaaatttagtatcaaatgcaccttatgatcgtctaaaactcagcctgctgaccaaagtctggaaccagataaagccttatattcgccacaaagatgttaatgttcgtgtgtcaagtctcacactcttgggagctatagtgtccacccacgcacctttacctgaagtccaactacttctgcaacagccatgttcttctggactcggtaatagcaattcagcaacccctcacctcagccctcctgattggtggaagaaagcccctgcaggaccctctctggaagaaacgtcagttagctcacctaaggggtcttcagagccctgctggctcattcgactctgcatttccattgtcgtactgcccaaggaggattcctgttcaggtagcgatgctggctctgcagcaggaagcacctacgaaccatcccccatgcgactggaggccttcagcaatctgccgaatgacaggcagatgctgtgcatcacagtgctgctcgggctgaatgacagcaagaatcgcttagtgaaagctgcaacttcacgggccctgggagtctatgtgctttttccctgtctcagacaggatgtcatatttgttgcagacgcagcaaatgcaatattgatgtcacttgaagacaagtctctgaatgttcgagccaaagcagcctggtccctgggcaacctgacagacactctgattgtcaacatggaaacaccagacccaagtttccaggaagagttctctggtctcctgctcttgaaaatgttacgatcagctatagaagcatccaaggataaagacaaggtaaaaagcaatgcagtccgggcccttggaaatttgcttcattttctgcaaccctctcatatagaaaaacccacatttgcagaaatcattgaggagtctatccaggccctaatttctactgttctaacagaagctgccatgaaagtccgatggaatgcttgttatgcaatgggaaatgtatttaaaaatcctgcccttcctttagggacagccccatggacctcccaggcctacaatgccctgacatcggtcgtgacatcatgcaagaacttcaaagtgcgcatcagatctgcagctgccctttccgtcccggggaagagagagcagtacgggtctgttgaccagtatgctcggatctggaatgcattggtcaccgctttacagaagagtgaagacaccatagactttttggaattcaagtactgtgtcagcctacggacccaaatctgccaggcactgattcacctcttgagcttggccagtgcctcggacctcccttgtatgaaagaaacccttgaactgagtgggaatatggtccagtcctatattctacagtttttaaaatcaggagcagagggagatgacactggagcaccccacagcccacaggaaagagaccagatggtcagaatggcccttaaacacatgggcagcatccaggcaccaactggagacacagccagaagggccatcatgggctttttagaagagatcctggccgtttgttttgactcatctggatcacaaggggcactcccagggttaacaaatcagtgaagatcccaccatactttctagatgtcgaaggcggcagtaggaagacctgagcttgagcataagatctgtgg

SEQ ID NO: 4161 - DNA, 5183 bp, Homo sapiens
gatgggagaagaagttgtccatgttcacactgggtgaaggaagctgaaaccacagacatgactgagtcctccatgaagaagctggcctccaccctgctggacgccatcaccgataaggaccccctggtgcaggagcaggtctgcagtgccctgtgctccctcggggaggcgcggccggtggagacgctccgtgcctgcgaggagtatctgcggcagcatgacaagctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctgctgctcagatggaagataaaaagccctttatcctgtcttccatgaggcttcctctcctggacaccaacagcaaggtgaagcgggcagtggtgcaggtgattagcgccatggcccaccacggctacctggagcagcctggaggtgaggcgatgatcgagtacatcgtgcagcagtgcgcgctgccccccgagcaggagcctgagaagccaggccccggcagcaaggaccccaaggccgacagcgtgcgggccatcagcgtgcgcaccctctacctggtcagcaccaccgtggacaggatgagtcacgtcctctggccatacctgctccagttcctcacccctgtgcgcttcactggggccctgactccgctctgcaggagcctcgtgcatctggcgcagaagaggcaggaggccggggccgacgccttcctcatccagtacgacgcccatgcgagcctcccgtctccctatgctgtaaccggaagactgttggttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatgagcacacagaagagaccctgccacaggaggagtgggaggagaagctgttgatgttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggttctaggaataaaggtagaaaccaaggacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagcgccctggtgcccttccacaacctgggccttctcatcggcctcttctccccacggtgtgcggacctgtggcctgccacccgccaggaggccgtggactgtgtctactccctgctgtacctccagctcggctatgagggcttctcccgggactaccgcgatgacgtggcggagcggctcctcagcctcaaggacggcctcgtgcaccctgaccccgccattctcttccacacctgccacagtgtaggccagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggcccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgctcaggacctcggcggggcatgaggagggggccaccaggttggccagggccatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccaccgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctcccagcgagtgactgaca

SEQ ID NO: 4162 - DNA, 1602 bp, Homo sapiens
ctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctggtgagtgcctccatgctagcctggccgccacccctggccatgtccaggatggagcaggtcctggcagattgtgtccctctaagtgaaagcaccatcctgctttgaattctctagaaagatttccctacttactattttgcaaaattctaaactttttgaaaagttgcaagggtggtacctttctacccttcgccatatgatggtggctcacacttgctttgacagctggctgcagacaccatgcgtggccacactccccaggtgaccatgcctctgagggttcccagagcctaagacagccatccctgagcccactgctctagctcattctgggatctattcaaagacacactttggtttagtttggttgtctcttagacttgtttgcccaagaggagcctttttactctttttaagagatgaggagaccaattgtttcgtagaatgtccctcaatttacatatgtgtgacggtttcttcgcaattagactaaaaaaattcacgtttccttgttttaaggctaattttttttttttttagtggtcttgctctgtcgccaggctggagtgcagtgagctgagatggctaaaccgcactcaagcctggacaacagagtgagactccgtctc

SEQ ID NO: 4163 - DNA, 5023 bp, Homo sapiens
gggaaggcggcgccccggccgaggtggcggcggctcctcagatgggagaagaagttgtccatgttcacactgggtgaaggaagctgaaaccacagacatgactgagtcctccatgaagaagctggcctccaccctgctggacgccatcaccgataaggaccccctggtgcaggagcaggtctgcagtgccctgtgctccctcggggaggcgcggccggtggagacgctccgtgcctgcgaggagtatctgcggcagcatgacaagctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctgctgctcagatggaagataaaaagccctttatcctgtcttccatgaggcttcctctcctggacaccaacagcaaggtgaagcgggcagtggtgcaggtgattagcgccatggcccaccacggctacctggagcagcctggaggtgaggcgatgatcgagtacatcgtgcagcagtgcgcgctgccccccgagcaggagcctgagaagccaggccccggcagcaaggaccccaaggccgacagcgtgcgggccatcagcgtgcgcaccctctacctggtcagcaccaccgtggacaggatgagtcacgtcctctggccatacctgctccagttcctcacccctgtgcgcttcactggggccctgactccgctctgcaggagcctcgtgcatctggcgcagaagaggcaggaggccggggccgacgccttcctcatccagtacgacgcccatgcgagcctcccgtctccctatgctgtaaccggaagactgttggttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatgagcacacagaagagaccctgccacaggaggagtgggaggagaagctgttgatgttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggttctaggaataaaggtagaaaccaaggacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagcgccctggtgcccttccacaacctgggccttctcatcggcctcttctccccacggtgtgcggacctgtggcctgccacccgccaggaggccgtggactgtgtctactccctgctgtacctccagctcggctatgagggcttctcccgggactaccgcgatgacgtggcggagcggctcctcagcctcaaggacggcctcgtgcaccctgaccccgccattctcttccacacctgccacagtgtaggccagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggcccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgctcaggacctcggcggggcatgaggagggggccaccaggttggccagggccatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccaccgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaa

SEQ ID NO: 4164 - DNA, 4975 bp, Homo sapiens
tgactggtcatagcgtgccgggcatagcgctggcagggccgccgggagccagccctcactcagccaagatgggagaagaagttgtccatgttcacactgggtgaaggaagctgaaaccacagacatgactgagtcctccatgaagaagctggcctccaccctgctggacgccatcaccgataaggaccccctggtgcaggagcaggtctgcagtgccctgtgctccctcggggaggcgcggccggtggagacgctccgtgcctgcgaggagtatctgcggcagcatgacaagctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctgctgctcagatggaagataaaaagccctttatcctgtcttccatgaggcttcctctcctggacaccaacagcaaggtgaagcgggcagtggtgcaggtgattagcgccatggcccaccacggctacctggagcagcctggaggtgaggcgatgatcgagtacatcgtgcagcagtgcgcgctgccccccgagcaggagcctgagaagccaggccccggcagcaaggaccccaaggccgacagcgtgcgggccatcagcgtgcgcaccctctacctggtcagcaccaccgtggacaggatgagtcacgtcctctggccatacctgctccagttcctcacccctgtgcgcttcactggggccctgactccgctctgcaggagcctcgtgcatctggcgcagaagaggcaggaggccggggccgacgccttcctcatccagtacgacgcccatgcgagcctcccgtctccctatgctgtaaccggaagactgttggttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatgagcacacagaagagaccctgccacaggaggagtgggaggagaagctgttgatgttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagcgccctggtgcccttccacaacctgggccttctcatcggcctcttctccccacggtgtgcggacctgtggcctgccacccgccaggaggccgtggactgtgtctactccctgctgtacctccagctcggctatgagggcttctcccgggactaccgcgatgacgtggcggagcggctcctcagcctcaaggacggcctcgtgcaccctgaccccgccattctcttccacacctgccacagtgtaggccagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggcccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgctcaggacctcggcggggcatgaggagggggccaccaggttggccagggccatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccaccgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcccccctcctctacccccagcgctccagatcctgctga

SEQ ID NO: 4165 - DNA, 1712 bp, Homo sapiens
gggaaggcggcgccccggccgaggtggcggcggctcctcagatgggagaagaagttgtccatgttcacactgggtgaaggaagctgaaaccacagacatgactgagtcctccatgaagaagctggcctccaccctgctggacgccatcaccgataaggaccccctggtgcaggagcaggtctgcagtgccctgtgctccctcggggaggcgcggccggtggagacgctccgtgcctgcgaggagtatctgcggcagcatgacaagctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctggcagcactaacaccagaataacactgatgttgccatcagcagtcacacgactgaaacatgaggactgccctgcacgtgctgctccgcagcctgctgatctaacggccgcgcccgcgtctgttgcttgagtcaccacggctgttacatcccgtgctctcccttctctgccttcttggtgttggttctgcgggcgactgcccatgtggccctcagccccatcctctgttcatggctctctgccactcttgttgtccaaagctctttctctgtaggttccgtgggaagagctcatgggaacatgatcttcgacctcatgcttgctgatcatagtttattgtgccttttatcgttgatggttttgctggttacaggattcttggctgacatttccttgagtgtcttaagttattccatattcttctggcagagagttgccagatttagcaaaaacaaataaacaggatgccccgaata

SEQ ID NO: 4166 - DNA, 5234 bp, Homo sapiens
ccaggccacctgcattccttgtctcagagcctccctcctgcatcctccaagccagcagttgtgggatgggagaagaagttgtccatgttcacactgggtgaaggaagctgaaaccacagacatgactgagtcctccatgaagaagctggcctccaccctgctggacgccatcaccgataaggaccccctggtgcaggagcaggtctgcagtgccctgtgctccctcggggaggcgcggccggtggagacgctccgtgcctgcgaggagtatctgcggcagcatgacaagctggcacacccataccgagcagcggtcctgagggccatggagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccagatctgtgtgcctgtggagtcctcaagccccctggtgatgagtaaccagaaggaggtgctgcgctgcttcactgtgctggcctgcagctcgcctgaccgcctactggccttcctgctgcccaggctggacaccagcaatgagaggacccgcgtgggcaccctgcaggtggtcagacatgtcatcaactcagctgctgctcagatggaagataaaaagccctttatcctgtcttccatgaggcttcctctcctggacaccaacagcaaggtgaagcgggcagtggtgcaggtgattagcgccatggcccaccacggctacctggagcagcctggaggtgaggcgatgatcgagtacatcgtgcagcagtgcgcgctgccccccgagcaggagcctgagaagccaggccccggcagcaaggaccccaaggccgacagcgtgcgggccatcagcgtgcgcaccctctacctggtcagcaccaccgtggacaggatgagtcacgtcctctggccatacctgctccagttcctcacccctgtgcgcttcactggggccctgactccgctctgcaggagcctcgtgcatctggcgcagaagaggcaggaggccggggccgacgccttcctcatccagtacgacgcccatgcgagcctcccgtctccctatgctgtaaccggaagactgttggttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatgagcacacagaagagaccctgccacaggaggagtgggaggagaagctgttgatgttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggttctaggaataaaggtagaaaccaaggacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagcgccctggtgcccttccacaacctgggccttctcatcggcctcttctccccacggtgtgcggacctgtggcctgccacccgccaggaggccgtggactgtgtctactccctgctgtacctccagctcggctatgagggcttctcccgggactaccgcgatgacgtggcggagcggctcctcagcctcaaggacggcctcgtgcaccctgaccccgccattctcttccacacctgccacagtgtaggccagattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggcccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgctcaggacctcggcggggcatgaggagggggccaccaggttggccagggccatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccaccgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccgggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctcccag

SEQ ID NO: 4167 - DNA, 3673 bp, Homo sapiens
cgtgcatctggcgcagaagaggcaggaggccggggccgacgccttcctcatccagtacgacgcccatgcgagcctcccgtctccctatgctgtaaccggaagactgttggttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatgagcacacagaagagaccctgccacaggaggagtgggaggagaagctgttgatgttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaagattcaggtggtgccgtgcacggctgggtcacacctctgctgtcactgactggctctggcccttcttctgggaggatttcaggagtttctgagccgaggattcccgtcggggagtgtaattgtgtaactgaagtcccgctggttcctctggcctctcaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggacccagccctgaagctgtgccttgtccagagtgtgtgcatggtcagccgcgccatctgcagcagcacccaggctggctccttccacttcacccggaaagcagagctggtggcacagatgatggagttcatcagggcagagcccccggactccttgaggacacctattcggaagaaagccatgctcacctgcacttacttggtctccgtggagccagcgctggacgagcaggcccgggcggatgtgatccatggctgcctgcacagcatcatggccctgctgcctgagcccaaggaggaggacggaggctgccagaagtccctgtatctggagacactgcacgcccttgaggatctgctgacgagcctcctgcagcggaacatgaccccccaaggcctgcagatcatgattgagcacctgagcccatggatcaagtccccaagaggtcacgagcgggcgcgggccctgggcctgagcgccctcctgctgcgctacttcctggagcacctgcgtgtcagcgccctggtgcccttccacaacctgggccttctcatcggcctcttctccccacggtgtgcggacctgtggcctgccacccgccaggaggccgtggactgtgtctactccctgctgtacctccagctcggctatgaggattattgccaagcgcctccccccagaccagctcatcagcctcttgctaaccatgtttgaggccctgggagaccccgaaaagaactgctcccgagcagctaccgtcatgatcaactgcctgctgcaggagcggggcggtgtgctccaggagaaggtgcccgagatcgtgagcgtcctgcgctccaagcttcaggaggcccagggagagcacgtcctgccggccgcccagcacagcgtgtacctcctggccacccagcactgcgcagccgtggtgtccagcctcctgggcagccccttgcccttggacagccacacctgcatgctgtggcgggcgctggcggtggagcctcgcctagctgcccaggtcctggggctgctgctggagaagatgagtagggacgtccctttcaaggagagccgggccttcctgctgggccgcaccccagaccgcgtggccacgctgctgcctctctcggctacctgtgcactgtttgaggtcatgtccacgcctgcagcggggcccgcggtgctcgagctctacccccagctgtttgtggtgcttctgctgcgcgtcagctgcaccgtgggtgtccagctgccccggaacctgcaggcccaggaaaggaggggtgccagtccagccctagccaccaggaacctggaaccctgcagctctgcagtggacaccctgcggtccatgctactccgcagcggcagcgaggatgtggtacagcgcatggacctggagggaggctgggaactgctcaggacctcggcggggcatgaggagggggccaccaggttggccagggccatggctgagcacgcagggccccgactccccctggtgctgaagacgctggcatgcacacacagcagtgcgtatgagaaccagagggtgaccaccaccgccttcctggccgagctgctgaacagcaacgtggccaacgacctcatgctcttggactcgctgctggagagcctggcggctcgccagaaggacacatgcgccagcgtgcggaggctggtgctccgcggcctggccaacctggcctccggctgccctgacaaggtgcgaacccacggcccccagctcctcacagccatgattggcgggctggacgacggggacaaccctcacagcccagtggccctggaggccatgctgggccttgcgaggctggtgcacctggtggagtcctgggacctgcgctcagggctgctgcacgtggccatccgcatccggcctttcttcgacagtgagaagatggagttccggacggcatctatccgcctctttgggcaccttaacaaggtctgccacggagactgtgaggacgtcttcctggaccaggtggtgggcgggctggcgcccctgctgctgcacctgcaggaccctcaggccaccgtggccagcgcctgcaggtttgccctgcgcatgtgtggccccaatctggcatgtgaggagctctcagctgctttccagaaacacctgcaggagggccgagccctgcacttcggggagttcctcaacaccacctgcaagcacctgatgcaccatttcccagacctgctgggccgtctcctgaccacctgcctgttctacttcaagagcagctgggagaacgtccgagctgctgcacccctgttcaccggtaagcaccaccccctgccccacccccacgccgcccggcagccccgcctgatgcccccacttcacagggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctccc

SEQ ID NO: 4168 - DNA, 5234 bp, Homo sapiens; identical to SEQ ID NO: 4166

SEQ ID NO: 4169 - DNA, 5282 bp, Homo sapiens
agttcatatgactgattttcactaagtgtaacaatcaacgagttcaccataaagcctttcccaacatcaggacagtaaagcaactactgaaaaccattcctgaatttgtgatcaatggactcaagtttagggagaggagcacctttggtctgcaacaatggtttgaatcccagtctctaattacttctttcccaaatactctggtcaccaaagggacaatatttggtgagatgcagccattttgttggttagcaggagttcagacgcaagacaatgtcatagtggtagaatacagtatcaacttcaacagcaagcccatctctggaagctcccagaccattgtgccaatcaagtggaggaggcactttcatttagagaggcttatgtgaaccttatatgagaaacttgccaacctgcctctttgattttttagccttactatttctaatacttaggtgctatcttttagagaccctgaaacagccaagacatgacacttagtacagaggaatccatagagatgtttggggatattaacctcactcttggcatgctgaacaaggaagatattgttaacaaggaagacatttacagtcatctcacttctgttattcagaatactgacatcttggatgatgcaattgtccaacgattgatttattatgcttctaaggatatgagagacaacaatatgctcagagaaatcagaatgctagctggtgaggttttggtgtctcttgctgcacatgatttcaactctgtgatgtatgaagtacaaagtaacttcaggatcttagagctaccagatgaattcgttgtgcttgccctggctgaattggcaaccagctatgtgtcccagagtattcctttcatgatgatgaccctgctcaccatgcaaaccatgctcaggctggccgaggatgaaaggatgaaggggactttctgtattgcccttgagaaattcagcaaagccatttacaaatatgtcaaccactggagagattttccctaccccagactggatgccaaccgactgtctgacaagatcttcatgctgttctggtatataatggagaagtgggcccctttggcctcacccatgcagactttgagcatcgttaaggcccacgggcccacggtgagcttgctgctgcatcgggaagacttccgtggatacgccctgggccaggtgccctggctcctgaaccagtataaagacaaagagattgatttccatgtcactcagagcctaaaacaaatactgactgcagcagttctttatgacattggccttccaaggagcttgagaagatccatctttatcaatttactccagcagatctgcagagctccagagcctccagtaaaggaaaatgaaatgaaagcttcaagctgttttctcattctagcccattccaatcctggagagctgatggaattttttgatgaacaagtaagaagtaataatgaagccattcgagtgggaatcttgactttgttaagattggctgtcaatgctgatgagcccaggttgagggatcacatcatttcaatagaaagaacagtcaaaatcgtcatgggtgatctcagtacaaaagtaagaaattctgttcttctcctcatccaaaccatgtgtgaaaagtcctatattgaagctcgggaaggatggccattgattgattatgtcttctcccagtttgcaacgttgaacaggaatctggagaaaccagtgaaaactaactttcatgagaatgaaaaggaagaggaatctgtccgagaaacaagccttgaggtcttaaaaaccctggacccactggtcattggaatgcctcaggtgctatggccaaggatcctgacttttgtggtacctgcagaatacacagaagctctggagcccctgtttagtatcatcagaattctgattatggcagaggagaagaagcagcacagtgccaaggagtcgacagcacttgtcgtctctacaggagctgtgaaacttccttcaccacagcagctactggccagacttctggtaatatctatgcctgccagtttaggggagttacgtggggctggtgcaatagggcttttgaagatactgcctgagataattcacccaaaattggtagacctatggaaaacacgtttacctgagcttctgcagcctctggaaggaaagaacatcagtaccgttctatgggaaaccatgctgcttcagcagttgctcaaagaatccttatggaagatcagtgatgtggcctggaccattcagctgactcaggatttcaaacagcaaatgggcagttacagcaataactccactgagaagaaattcctttggaaagccttgggaaccaccttagcatgctgccaagattcagactttgtaaactcacagattaaggagtttctgactgctcccaaccaactgggggatcaaagacagggaataacatctattttaggatactgtgccgagaaccatttggatattgttttaaaagttcttaaaacattccaaaatcaggaaaagtttttcatgaatcgatgtaagagccttttttctgggaaaaagagcctgaccaagacagatgtcatggtcatctatggagcagtggccctccatgctcccaagaagcaacttctctccagacttaatcaagatatcatatcccaagtcctgtctcttcatggccagtgctctcaggttctgggcatgtctgtgatgaacaaggacatggatctgcaaatgagtttcacaagaagcatcactgagattggcattgctgtccaagatgctgaggatcaggggttccagttttcctacaaggagatgctgattggttacatgctggacttcattagagacgagcccctggattccttagctagccctattcggtggaaagccttaatcgccattaggtatctcagtaaactgaaacctcagctctcactacaagaccaccttaacattcttgaggagaatattcggaggctgctgccccttccacctctggaaaatctgaaaagtgaaggccagacagacaaggacaaggagcacattcaatttctctatgaacgatccatggacgccctaggaaaacttctgaagaccatgatgtgggataatgtgaatgcagaggactgtcaagaaatgtttaatcttctccaaatgtggcttgtttcacaaaaagagtgggaaagagaaagagccttccagatcactgcgaaagtgctgacaaatgatattgaggcaccagagaactttaaaattggttcactgcttggacttctggctcctcactcctgtgataccctgcccaccatccgtcaggcggctgctagctcaactattggtctgttctatataaaaggcattcacttggaagtggaaagactgcagggtttgcaggaagggctggaaagtgatgacgtgcaggttcagatcaagatttcttctaaaatagctaagattgtcagtaagttcatcccaaatgaagaaattctgatgttcctagaggaaatgctggacggtctggagagcctcaaccccacttgtacaaaggcctgtggcatatggatgatcactgtcctgaagcagcagggagctgctctggaagatcagctattggagatcttaggcacaatctaccatcacatgccagtcctcagacaaaaagaagaaagttttcagttcattctagaagccatctcccagatagccagctttcacatggatacagttgttgtcaaccttttacagaagcctctgccttttgacagggacacaaagacattgtggaaggcgctggctgaaaagccagcctccagtgggaaactcttgcaagccttaatagacaaactggagactgagttagaagatgacatcgccagggttgaggcaatttcagtggcctgtgctatgtatgaagtgatctcaatgggcacctctgtcaccggcttgtatccagagctgttcactctcctcctgaagctggttagctgcacactgggccagaagatgctcacttgtccctggagccataggcggcatgtgatgcagcagggagaacagcagcagatcccagacccctgcaggctttcaactgctactttaaaatgtttgcaagcccaagccatgagagaaggccttgcaaaggaatctgatgagggggacaacttatggactctactcagcagtcctagtacccaccacataggcgtatgttcactggccaggagcatggcagtgtggcaacacggagtcatactggacatcatggaacagctgctctcatctcttacctcctcctcggagaactaccggataaccggcgcagctttcttctctgagctcatgaaggaaccaatcctttggaagcatgggaatctgcgaaatgtgctgatcttgatggatcaaagtgcctgggactccaacgccactctgaggcagatggccatccgagggctcggcaacacagcatccggggctcctcacaaggtgaagaaacataagcagttaatgctagaatctatcatcagaggcctgtatcacctagctcgcactgaagtcgtctgtgaaagcttgaaggctctaaaaaaaatcctggagctgctgacagaccgagacgtgagcttctacttcaaggaaatagtgctgcaaacaaggaccttctttgaagatgagcaggatgatgtgagattgactgccatcttcttatttgaggacctggcacccctaacaggaagaaggtggaagattttttttgctgaagaaataaaaaagagcctgatttcattccttctgcacctttgggatcccaaccccaagattggagttgcttgccgtgatgtcttgatggtctgcattccctttttgggcctccaggagctctatggggtattagaccgtctccttgatcaggatctaccaagggccagggatttctacaggcaattctgtgtgaaactggccaagaaaaaccaggaaattctgtggatcctccacacacactccttcaccttcttcaccagcacctgggaggtgatcaggagtgcagctgtcaaactcacagatgccgttgttctcaatttgaccagccaatatgtggagttactagacagagaacaactgaccacacgactccaagcacttcgtcaagatccgtgtattagtgtccagagagcagctgaggctgctttgcaaaccctcctgagaaggtgtaaagagacaagcattcctctgtaagccatcaagaaataaactgctggcttttcct

SEQ ID NO: 4170 - DNA, 5239 bp, Homo sapiens
gagttcaccataaagcctttcccaacatcaggacagtaaagcaactactgaaaaccattcctgaatttgtgatcaatggactcaagtttagggagaggagcacctttggtctgcaacaatggtttgaatcccagtctctaattacttctttcccaaatactctggtcaccaaagggacaatatttggtgagatgcagccattttgttggttagcaggagttcagacgcaagacaatgtcatagtggtagaatacagtatcaacttcaacagcaagcccatctctggaagctcccagaccattgtgccaatcaagtggaggaggcactttcatttagagaggcttatgtgaaccttatatgagaaacttgccaacctgcctctttgattttttagccttactatttctaatacttaggtgctatcttttagagaccctgaaacagccaagacatgacacttagtacagaggaatccatagagatgtttggggatattaacctcactcttggcatgctgaacaaggaagatattgttaacaaggaagacatttacagtcatctcacttctgttattcagaatactgacatcttggatgatgcaattgtccaacgattgatttattatgcttctaaggatatgagagacaacaatatgctcagagaaatcagaatgctagctggtgaggttttggtgtctcttgctgcacatgatttcaactctgtgatgtatgaagtacaaagtaacttcaggatcttagagctaccagatgaattcgttgtgcttgccctggctgaattggcaaccagctatgtgtcccagagtattcctttcatgatgatgaccctgctcaccatgcaaaccatgctcaggctggccgaggatgaaaggatgaaggggactttctgtattgcccttgagaaattcagcaaagccatttacaaatatgtcaaccactggagagattttccctaccccagactggatgccaaccgactgtctgacaagatcttcatgctgttctggtatataatggagaagtgggcccctttggcctcacccatgcagactttgagcatcgttaaggcccacgggcccacggtgagcttgctgctgcatcgggaagacttccgtggatacgccctgggccaggtgccctggctcctgaaccagtataaagacaaagagattgatttccatgtcactcagagcctaaaacaaatactgactgcagcagttctttatgacattggccttccaaggagcttgagaagatccatctttatcaatttactccagcagatctgcagagctccagagcctccagtaaaggaaaatgaaatgaaagcttcaagctgttttctcattctagcccattccaatcctggagagctgatggaattttttgatgaacaagtaagaagtaataatgaagccattcgagtgggaatcttgactttgttaagattggctgtcaatgctgatgagcccaggttgagggatcacatcatttcaatagaaagaacagtcaaaatcgtcatgggtgatctcagtacaaaagtaagaaattctgttcttctcctcatccaaaccatgtgtgaaaagtcctatattgaagctcgggaaggatggccattgattgattatgtcttctcccagtttgcaacgttgaacaggaatctggagaaaccagtgaaaactaactttcatgagaatgaaaaggaagaggaatctgtccgagaaacaagccttgaggtcttaaaaaccctggacccactggtcattggaatgcctcaggtgctatggccaaggatcctgacttttgtggtacctgcagaatacacagaagctctggagcccctgtttagtatcatcagaattctgattatggcagaggagaagaagcagcacagtgccaaggagtcgacagcacttgtcgtctctacaggagctgtgaaacttccttcaccacagcagctactggccagacttctggtaatatctatgcctgccagtttaggggagttacgtggggctggtgcaatagggcttttgaagatactgcctgagataattcacccaaaattggtagacctatggaaaacacgtttacctgagcttctgcagcctctggaaggaaagaacatcagtaccgttctatgggaaaccatgctgcttcagttgctcaaagaatccttatggaagatcagtgatgtggcctggaccattcagctgactcaggatttcaaacagcaaatgggcagttacagcaataactccactgagaagaaattcctttggaaagccttgggaaccaccttagcatgctgccaagattcagactttgtaaactcacagattaaggagtttctgactgctcccaaccaactgggggatcaaagacagggaataacatctattttaggatactgtgccgagaaccatttggatattgttttaaaagttcttaaaacattccaaaatcaggaaaagtttttcatgaatcgatgtaagagccttttttctgggaaaaagagcctgaccaagacagatgtcatggtcatctatggagcagtggccctccatgctcccaagaagcaacttctctccagacttaatcaagatatcatatcccaagtcctgtctcttcatggccagtgctctcaggttctgggcatgtctgtgatgaacaaggacatggatctgcaaatgagtttcacaagaagcatcactgagattggcattgctgtccaagatgctgaggatcaggggttccagttttcctacaaggagatgctgattggttacatgctggacttcattagagacgagcccctggattccttagctagccctattcggtggaaagccttaatcgccattaggtatctcagtaaactgaaacctcagctctcactacaagaccaccttaacattcttgaggagaatattcggaggctgctgccccttccacctctggaaaatctgaaaagtgaaggccagacagacaaggacaaggagcacattcaatttctctatgaacgatccatggacgccctaggaaaacttctgaagaccatgatgtgggataatgtgaatgcagaggactgtcaagaaatgtttaatcttctccaaatgtggcttgtttcacaaaaagagtgggaaagagaaagagccttccagatcactgcgaaagtgctgacaaatgatattgaggcaccagagaactttaaaattggttcactgcttggacttctggctcctcactcctgtgataccctgcccaccatccgtcaggcggctgctagctcaactattggtctgttctatataaaaggcattcacttggaagtggaaagactgcagggtttgcaggaagggctggaaagtgatgacgtgcaggttcagatcaagatttcttctaaaatagctaagattgtcagtaagttcatcccaaatgaagaaattctgatgttcctagaggaaatgctggacggtctggagagcctcaaccccacttgtacaaaggcctgtggcatatggatgatcactgtcctgaagcagcagggagctgctctggaagatcagctattggagatcttaggcacaatctaccatcacatgccagtcctcagacaaaaagaagaaagttttcagttcattctagaagccatctcccagatagccagctttcacatggatacagttgttgtcaaccttttacagaagcctctgccttttgacagggacacaaagacattgtggaaggcgctggctgaaaagccagcctccagtgggaaactcttgcaagccttaatagacaaactggagactgagttagaagatgacatcgccagggttgaggcaatttcagtggcctgtgctatgtatgaagtgatctcaatgggcacctctgtcaccggcttgtatccagagctgttcactctcctcctgaagctggttagctgcacactgggccagaagatgctcacttgtccctggagccataggcggcatgtgatgcagcagggagaacagcagcagatcccagacccctgcaggctttcaactgctactttaaaatgtttgcaagcccaagccatgagagaaggccttgcaaaggaatctgatgagggggacaacttatggactctactcagcagtcctagtacccaccacataggcgtatgttcactggccaggagcatggcagtgtggcaacacggagtcatactggacatcatggaacagctgctctcatctcttacctcctcctcggagaactaccggataaccggcgcagctttcttctctgagctcatgaaggaaccaatcctttggaagcatgggaatctgcgaaatgtgctgatcttgatggatcaaagtgcctgggactccaacgccactctgaggcagatggccatccgagggctcggcaacacagcatccggggctcctcacaaggtgaagaaacataagcagttaatgctagaatctatcatcagaggcctgtatcacctagctcgcactgaagtcgtctgtgaaagcttgaaggctctaaaaaaaatcctggagctgctgacagaccgagacgtgagcttctacttcaaggaaatagtgctgcaaacaaggaccttctttgaagatgagcaggatgatgtgagattgactgccatcttcttatttgaggacctggcacccctaacaggaagaaggtggaagattttttttgctgaagaaataaaaaagagcctgatttcattccttctgcacctttgggatcccaaccccaagattggagttgcttgccgtgatgtcttgatggtctgcattccctttttgggcctccaggagctctatggggtattagaccgtctccttgatcaggatctaccaagggccagggatttctacaggcaattctgtgtgaaactggccaagaaaaaccaggaaattctgtggatcctccacacacactccttcaccttcttcaccagcacctgggaggtgatcaggagtgcagctgtcaaactcacagatgccgttgttctcaatttgaccagccaatatgtggagttactagacagagaacaactgaccacacgactccaagcacttcgtcaagatccgtgtattagtgtccagagagcagctgaggctgctttgcaaaccctcctgagaaggtgtaaagagacaagcattcctctgtaagccatcaagaaataaactgctggcttttcc

SEQ ID NO: 4171 - DNA, 748 bp, Homo sapiens
gctccggccccgcctccgccctggaacgcagcgcgctccgcccgaggcctcccggcggcccatacgggaatcgcggagcttagctgtcgccacctcgcgccgggtccgcgcggcccacgggaccccccactgacgcccccggccagcggtccacatggacgtgcggggccctgaagcccccggcgggcgcgcgctgcgggacgcggcagaaaatctatttcaggaacttcaggaacattttcaagctctgacggcaacattaaacctcagaatggaagaaatgggaaatcgcattgaggacttacagaagaatgtcaaggacttaatggtgcaagctggcattgaaaattctattaaagaacaaatgctgaagacctaactgcagcatgtctgtatttggagatggggcctctacagaagtcattaaggttacatcggtcctgagggtggggccctcatccaacaggattcgtctttctgagaagagacgcaaggggctcgcctgctctcccctccgtgcctgcaccagagaaggaggccatcggcaagccaaggagagccctccccagaaatcacacggaccagcaccttgatctgggacttccagaaaacagaactgtgaaaagacaagtttctgttgtttaaaccacccaatctgaagtattttgttatggcagtcctgggcagactaatacaatatgcaacacatttacaataaatatacaataaacttacaaatgtggaatgt

SEQ ID NO: 4172 - DNA, 1335 bp, Homo sapiens
tgatggtcaacatgtcagcaccagccatctgcctcgtgccctgggttgacctgggtttaggagaggatcccacatctgggcagaaagaccccaccccctgaaaaaagagcaaacagatttcttgcatctttcgttctatgtggctctcagaacattaaatccaggagtgctttaggaattgggtgcacagtgcctgccaccgaagaggagaaaatgaggtgtggaaacgtgcaaaccgtttgtgagggtctcagcgaggcctcttcatgccccaggcaccaccagctccccctccccagctcgttcccagccaggaccctcagctgtcctctcaggccccctgcgacagctgaagagtgtgcgggggaggggactaggggtccgggcggcgctggtcacaccctcgttgctctcactcagggcccccactcccagcccctccccccccaagaggctcggcactattttgggtggtgtcgaccccgcccccacctcctatcgagccctggctctccgggcagctggaggggtcgcgctgcgcctgttggggctgcacctcggaccagggcttctgctgcatctgcagccatgtcgggccgctcagtgccacatgcccacccggccaccgccgagtacgaatttgccaacccgagccgcctgggtgagcagcgcttcggagaaggcctcctgccagaagagatcctgacccccacactctaccatggctactatgtccggcctcgggccgccccagctggggagggcagcagggcaggggcctccgagcttaggctcagtgagggcaagttccaggcatttctggatgtgagccactttaccccagacgaggtgactgtgaggactgtggataacctgctggaggtgtctgcccggcacccccagcgcctggaccgccacggcttcgtgtcccgagagttctgccgcacctatgtcctgcctgctgatgtcgacccctggcgagtccgagctgctctctcccatgatggcatcttaaacctggaagcacctcggggtggccgacatttggacacagaggtcaatgaggtctacatctccctgctccctgcgcctcctgatccagaggaagaggaggaggcagccatagttgagccctgattgccacagacccagcacccagcaaatccctctctacctcccaaggtgatatgggcagctgcccaccactccagaggtagcagcatccttgggggaagggaaaggtgcatggtccacaatgtatggtttggtcccatgggacatgtcatagccttggtttagttttgggtggagctgaataaacccaaatctcagggc

SEQ ID NO: 4173 - DNA, 915 bp, Homo sapiens
gggtaggagcgagcgcgcccgggaactcggtggagcgagcgcgcccgggaactcggtggaggccgcggtggcggggtggggcggggctgagggcagggcggggcctgtgggagtcgtggcgcaaagagctcggggtaggagcgcgcgcccggaaactcagcggtggccgcggcgaaggggcggggctgagggtgggacggggcttgtgggaggcgtggcgcgaagatttcagagttggagcgcgcgcgaccccggactccacggaggccgcggcgagcaggcggagctgcgggtcgggacgctctgcgtggggcggggcgcaagggaggtttcgagcccggaaggtccggcgcccagagctaacgggagtcccaggttaaacactttaagatgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttgtacagaccttgaagattgaaaaaagcacgtctaaagagccagttgattttgagcaatggattgaaaaagatttggtacacacagaggggcagcttcaaaatgaagaaattgtggcacatgatggctccgctacttacttgagattcattattgtatcagcctttgatcattttgcatctgtgcatagcgtttctgcagaaggaacagtagtctcaaatctttcctcataatgataacaaaatgctcttgcatgattttttaacaatatatttaaacaggaagttgtcactgatatactttattaaaaggatttttatcaa

SEQ ID NO: 4174 - DNA, 765 bp, Homo sapiens
caggttaaacactttaagatgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttggtaagcaaatcttacattaattttttttttttttttttggtgctccaggtaaggctaatattttagttttcattatcctttcattttttccacaggcagaaggcatatatgtaaacttttggcaaaacactagtttttctttatagcatggaatccagttttattgctggggtgaaaggatggggattatgaggtaaatgccttgagctcagttggcctctctcaaactgcaaattcgaaacccttccaaagcacataataatttccatgcaatttactatgtaaaagtctttggcaaaaggccctattaggaacataagactccagcttgctagaacactattccatgacatctttattctagattcatttgtcctggagttatttgtcaaattcttgttgaaaatctgataactctgattatttacattggatagttgagattcttctattactagtggcattttctcaggaatttagggggataatctcccttgggacatcattctaatcctatttatttaaagataaaatgtatcaga

SEQ ID NO: 4175 - DNA, 760 bp, Homo sapiens
gcaagggaggtttcgagcccggaaggtccggcgcccagagctaacgggagtcccaggttaaacactttaagatgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttgtacagaccttgaagattgaaaaaagcacgtctaaagagccagttgattttgagcaatggattgaaaaagatttggtacacacagaggggcagcttcaaaatgaagaaattgtggtaagtgaatatactttatagaattaaaaattaacctgcacaatgtatttagactttaacctatctccatagtcatagttaataaatttcctcatgatattataggtttgtacctaaatcaaccggtagagaaagttattctcaataataatataagctaaatgtacattcataaattaggttcttacctttcatagagagtgacggcaagataaaacaattcatttattttttgttttatttttctcattcatttactttgaagtatttatttggtttgctttctttcatttgattctgtaggcattttagaataggaatgaaaaaagggtcgcgatgccaaaattgaatgttaatttaagcatgaaagg

SEQ ID NO: 4176 - DNA, 604 bp, Homo sapiens
ggacctggaggcggggccaggcccagggcaggcgacccgagggccgagggtttggaactcgcagaggttaaacactttaagatgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttgtacagaccttgaagattgaaaaaagcacgtctaaagagccagttgattttgagcaatggattgaaaaagatttggtacacacagaggggcagcttcaaaatgaagaaattgtggcacatgatggctccgctacttacttgagattcattattgtatcagcctttgatcattttgcatctgtgcatagcgtttctgcagaaggaacagtagtctcaaatctttcctcataatgataacaaaatgctcttgcatgattttttaacaatatatttaaacaggaagttgtcactgatatactttattaaaaggatttttatc

SEQ ID NO: 4177 - DNA, 1216 bp, Homo sapiens
gggtagcgagaggcgtcgggatcgcgggcgccggctgagccagcggctgctgggaggctgtgtgcgcacgcctgcggggcgaggaggccgggccctgcgcctcaggcctgagaactgggaggaagctggagaaaagatgccctctgaatatttgtgtttggctgcccaggctcgccttgactccaaatggttgaaaacagatatacagatggagtcttgctctgttgcccaggctagagtgcagtggtgccatctcggcttaccgcaagctccgcctcccgggttcacgccattgtcctgcctcagcgtcccgagtacctggaactataggtgtccaccatcatacctggccaattttttgtattttcagtagagacggggtttcactgtgtcagccaagatggtctccatcttctgacctcgtgatccaccggccttggcctcttagagtgctgggattacaggcataagccaccactcccggccgatatattggtttgtttatgaaaattatactggatctgttacagatgatagtgtcaaaccaagtggaacaaagaaagaagatctggatgacaaagagaaaaaagatgaaactcctgcacctgtatatagggccaagtcaattctggagagctgggtatgggagtaagcaaccagggatgttcacggaacgccaggcaccaaaaggccagaagcatgcccctgcaggaccagcacttggctctggccatcctgctggagctggctgtgcagagaggcacgctgagccaaatgttgtctgccatcctgttgttgcttcagctgtgggacagcagggcacaggaaactgacaatgagcgttctgcccagggcaccagcaccttgcttttgtccttgctgcaaacgttccagagcatcatttgcggtaaggatacgcccccctccgagggcaacatgcaccttttgtctggccctctgagccccagtgagagtttcctgaggtacctcaccctccacaagacaacgagcttgccattgatctgcaacaaacggcagttgttgtcatggcccatttagaagatctggctacaccctgtagatgcctctgccgtgtagctgtccgacgtctcataagagagtcatttttttacaggtcagaactgtagaaataatgaggaagtgacacttatatgcaaagctgatttggagaaccataataaagatggaggcttct

SEQ ID NO: 4178 - DNA, 9140 bp, Homo sapiens
ggcttcttgggaactctagggccgcggccgggcctggctctgccggcggcctgttgggagctggatcggagcggtttggaacgacaagcccgagtaagagcctgcgggaaggggaggcgggagcgcctcggaccgtcggaagggccctgcgtgggggcgcggatcccggacgcccggcgagtggcggaaagcgagaccccggcgccgagtgaggtcggccaggctgctgccgacttccccgctggcccctttgttcccctcccggggccctgccggcggcggggcccggttgcccgcgccagagcctcaggccggctccttttgcccttgagaagggttcgctgccaggccttcgagttccgggcgcagctcccgggagagccggcgccctgcctggcccggcggcctcctctcgggcacgaaggcttgctgctgcttctccagaacttcccttcctcgtagacacagcaaagagacttttaaaaaaccatggcagatgtggacccagatacattgctggaatggctacagatgggacagggagatgaaagggacatgcaactaatagcccttgaacagctatgcatgctgcttttgatgtctgacaacgtggatcgttgttttgaaacatgtcctcctcgcactttcttaccagccctttgcaaaatttttcttgatgaaagtgctccagacaatgtattagaggtgacagcccgtgccataacatactacctggatgtatctgcggaatgtacccgaaggattgttggggtagatggagctataaaagcactttgtaatcgtttggttgtagttgaacttaacaacaggactagcagagacttagccgaacagtgtgtaaaggtattagaactgatatgtactcgtgagtcaggagcagtctttgaggctggtggtttgaattgtgtgcttaccttcattcgtgacagtggacatctagttcataaagacaccttgcactctgctatggctgtggtatcaagactctgtggcaaaatggagcctcaagattcttctttagaaatttgtgtagaatctctgtctagtttattaaagcatgaagatcatcaggtttcagatggagctctgcgatgctttgcatcactggctgaccgatttacccgtcgtggtgttgacccagctccattagccaagcatggattaactgaggagctgttatctcgaatggctgctgctggtggtactgtttcaggaccatcatcagcatgcaaaccaggtcgcagcaccacaggagctccatccaccactgcagattccaaattgagtaatcaggtgtcaacaattgtaagtctgctctcaacactttgcagaggctctccggtagtaacacatgatcttctgaggtcggagcttccagattcaattgaaagtgcattgcagggtgatgaaagatgtgtgcttgatactatgcgtttggttgaccttctcttggtgctattatttgaaggacgaaaagctttgccaaagtctagtgctggatctacaggcagaatcccaggactccggagattagatagttctggggagcgctcacatcggcagcttatagattgtattcgaagtaaagataccgatgcacttatagatgcaattgacacaggagcctttgaagtaaattttatggatgatgtaggtcagactctattaaactgggcctctgcttttggaactcaggaaatggtagaatttctttgtgagagaggtgcagatgttaatagaggtcaaaggtcatcatcattacattatgctgcatgttttggaagacctcaagtagcaaagactctgttacggcatggtgcaaatccagatctgagagatgaagatgggaaaactccattagataaagctcgagaaaggggccatagtgaagtggtagctattcttcagtctccaggtgattggatgtgtccagttaataaaggagatgataagaaaaagaaagatacaaacaaagatgaagaagaatgtaatgagcccaaaggagatccggaaatggcacccatatacttgaaaaggttattgccagtgtttgcacaaacatttcagcaaactatgctgccttcaataaggaaagcaagtcttgctctaattcgaaaaatgattcatttttgctctgaagcactgttaaaagaagtttgtgattctgatgttggtcacaatttgcctacaatactagtggaaatcactgcaactgtcctggatcaagaggatgatgatgatggccacttgctggctttgcagatcataagggatttagtagataaaggtggtgatatatttttggatcagctagccagacttggtgtaattagcaaagtgtcaacgttggcaggtccttcctctgatgatgagaatgaagaggaatcaaaaccagaaaaagaagatgaaccacaggaagatgctaaagaattgcaacaaggtaaaccatatcattggagagactggtcaatcattaggggaagggactgcttatatatttggagtgatgcagcagccttggaattatctaatggcagtaatggatggttcagatttatcttggatggaaaacttgccaccatgtattcaagtggtagtccggaaggtggatctgacagttcagaaagccgaagtgaattcttagagaagttacaaagagctcgaggccaagtaaagccatctacttcaagtcaacctatactgtcagcaccaggacccactaaacttactgtaggaaattggtcactgacatgtttgaaagaaggagaaattgctattcataattcagatggtcagcaagctacaatattgaaagaagatttacctggttttgtatttgaatctaatagaggaaccaaacattcatttactgcagaaacttccctgggttcagaatttgtgactggctggactggcaaaagaggcagaaaactgaaatctaagttagaaaaaacaaagcaaaaggtacgaactatggctcgagatttatacgatgaccattttaaagctgttgaaagcatgcctcgtggagtagtggtaacactcagaaacatagcaactcagttagagtcatcttgggaacttcatacaaatagacaatgtattgagagtgagaacacttggagagatttaatgaagacagctttagaaaacctaattgtacttttgaaggatgaaaacacaatttcaccatatgaaatgtgtagcagtggcttggtacaagcacttcttactgtgttaaacaatgtaagtttatcaagtagtaaagaacaaaaatacagttttactccttcggtagaaataaatgtttttaaaactgcctttagtgaaaatgaagatgatgaaagtcgaccagcagttgcgttaattcgaaagttaatagctgtactagaatctattgaacgtctacctctccatttgtatgatacaccaggatccacatataacctccagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggctggattgatgtcacctgggatgctggtggctcaaactcttaccgtatgggcgcagaaggaaaatttgacctcaagcttgcaccagggtacgaccctgatacagtggcatcacccaaacctgtttcatccactgtttcaggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctatatatagttgcaagtgacccttattcaagaatatcccaggaagatggtgatgaacagcttcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgt

SEQ ID NO: 4179 - DNA, 1328 bp, Homo sapiens
aaggtctttctgaaggctgtagcaggtaattatcatatcttcaggcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgt

SEQ ID NO: 4180 - DNA, 9134 bp, Homo sapiens
ggcttcttgggaactctagggccgcggccgggcctggctctgccggcggcctgttgggagctggatcggagcggtttggaacgacaagcccgagtaagagcctgcgggaaggggaggcgggagcgcctcggaccgtcggaagggccctgcgtgggggcgcggatcccggacgcccggcgagtggcggaaagcgagaccccggcgccgagtgaggtcggccaggctgctgccgacttccccgctggcccctttgttcccctcccggggccctgccggcggcggggcccggttgcccgcgccagagcctcaggccggctccttttgcccttgagaagggttcgctgccaggccttcgagttccgggcgcagctcccgggagagccggcgccctgcctggcccggcggcctcctctcgggcacgaaggcttgctgctgcttctccagaacttcccttcctcgtagacacagcaaagagacttttaaaaaaccatggcagatgtggacccagatacattgctggaatggctacagatgggacagggagatgaaagggacatgcaactaatagcccttgaacagctatgcatgctgcttttgatgtctgacaacgtggatcgttgttttgaaacatgtcctcctcgcactttcttaccagccctttgcaaaatttttcttgatgaaagtgctccagacaatgtattagaggtgacagcccgtgccataacatactacctggatgtatctgcggaatgtacccgaaggattgttggggtagatggagctataaaagcactttgtaatcgtttggttgtagttgaacttaacaacaggactagcagagacttagccgaacagtgtgtaaaggtattagaactgatatgtactcgtgagtcaggagcagtctttgaggctggtggtttgaattgtgtgcttaccttcattcgtgacagtggacatctagttcataaagacaccttgcactctgctatggctgtggtatcaagactctgtggcaaaatggagcctcaagattcttctttagaaatttgtgtagaatctctgtctagtttattaaagcatgaagatcatcaggtttcagatggagctctgcgatgctttgcatcactggctgaccgatttacccgtcgtggtgttgacccagctccattagccaagcatggattaactgaggagctgttatctcgaatggctgctgctggtggtactgtttcaggaccatcatcagcatgcaaaccaggtcgcagcaccacaggagctccatccaccactgcagattccaaattgagtaatcaggtgtcaacaattgtaagtctgctctcaacactttgcagaggctctccggtagtaacacatgatcttctgaggtcggagcttccagattcaattgaaagtgcattgcagggtgatgaaagatgtgtgcttgatactatgcgtttggttgaccttctcttggtgctattatttgaaggacgaaaagctttgccaaagtctagtgctggatctacaggcagaatcccaggactccggagattagatagttctggggagcgctcacatcggcagcttatagattgtattcgaagtaaagataccgatgcacttatagatgcaattgacacaggagcctttgaagtaaattttatggatgatgtaggtcagactctattaaactgggcctctgcttttggaactcaggaaatggtagaatttctttgtgagagaggtgcagatgttaatagaggtcaaaggtcatcatcattacattatgctgcatgttttggaagacctcaagtagcaaagactctgttacggcatggtgcaaatccagatctgagagatgaagatgggaaaactccattagataaagctcgagaaaggggccatagtgaagtggtagctattcttcagtctccaggtgattggatgtgtccagttaataaaggagatgataagaaaaagaaagatacaaacaaagatgaagaagaatgtaatgagcccaaaggagatccggaaatggcacccatatacttgaaaaggttattgccagtgtttgcacaaacatttcagcaaactatgctgccttcaataaggaaagcaagtcttgctctaattcgaaaaatgattcatttttgctctgaagcactgttaaaagaagtttgtgattctgatgttggtcacaatttgcctacaatactagtggaaatcactgcaactgtcctggatcaagaggatgatgatgatggccacttgctggctttgcagatcataagggatttagtagataaaggtggtgatatatttttggatcagctagccagacttggtgtaattagcaaagtgtcaacgttggcaggtccttcctctgatgatgagaatgaagaggaatcaaaaccagaaaaagaagatgaaccacaggaagatgctaaagaattgcaacaaggtaaaccatatcattggagagactggtcaatcattaggggaagggactgcttatatatttggagtgatgcagcagccttggaattatctaatggcagtaatggatggttcagatttatcttggatggaaaacttgccaccatgtattcaagtggtagtccggaaggtggatctgacagttcagaaagccgaagtgaattcttagagaagttacaaagagctcgaggccaagtaaagccatctacttcaagtcaacctatactgtcagcaccaggacccactaaacttactgtaggaaattggtcactgacatgtttgaaagaaggagaaattgctattcataattcagatggtcagcaagctacaatattgaaagaagatttacctggttttgtatttgaatctaatagaggaaccaaacattcatttactgcagaaacttccctgggttcagaatttgtgactggctggactggcaaaagaggcagaaaactgaaatctaagttagaaaaaacaaagcaaaaggtacgaactatggctcgagatttatacgatgaccattttaaagctgttgaaagcatgcctcgtggagtagtggtaacactcagaaacatagcaactcagttagagtcatcttgggaacttcatacaaatagacaatgtattgagagtgagaacacttggagagatttaatgaagacagctttagaaaacctaattgtacttttgaaggatgaaaacacaatttcaccatatgaaatgtgtagcagtggcttggtacaagcacttcttactgtgttaaacaatagcatggatttggatatgaaacaagattgtagtcaactggtagaaagaataaatgtttttaaaactgcctttagtgaaaatgaagatgatgaaagtcgaccagcagttgcgttaattcgaaagttaatagctgtactagaatctattgaacgtctacctctccatttgtatgatacaccaggatccacatataacctccagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggctggattgatgtcacctgggatgctggtggctcaaactcttaccgtatgggcgcagaaggaaaatttgacctcaagcttgcaccagggtacgaccctgatacagtggcatcacccaaacctgtttcatccactgtttcaggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctatatatagttgcaagtgacccttattcaagaatatcccaggaagatggtgatgaacagcttcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgt

SEQ ID NO: 4181 - DNA, 9080 bp, Homo sapiens
ggatttgctccgcctccgccgggctcggctgccctcggcagcttccccgcctggctctccctcgaccctcctcccctccccctcccggttcgcgatggactgggcctccccgccgcgccgccgccgccgtcgcccgcagcaccgcgcgggcctctgagttgcagggcctgaggagccgcgtgctggggactggacgtccgctggctgctgccgcacgcgagaacctctcgcttccctgtcaccaggtcctcgcggaggaaggggagggacgaggcgcggcttttcctgtgccgcctgcccggttcgacctgcgcggcctgcggcttcttgggaactctagggccgcggccgggcctggctctgccggcggcctgttgggagctggatcggagcggtttggaacgacaagcccgacaaagagacttttaaaaaaccatggcagatgtggacccagatacattgctggaatggctacagatgggacagggagatgaaagggacatgcaactaatagcccttgaacagctatgcatgctgcttttgatgtctgacaacgtggatcgttgttttgaaacatgtcctcctcgcactttcttaccagccctttgcaaaatttttcttgatgaaagtgctccagacaatgtattagaggtgacagcccgtgccataacatactacctggatgtatctgcggaatgtacccgaaggattgttggggtagatggagctataaaagcactttgtaatcgtttggttgtagttgaacttaacaacaggactagcagagacttagccgaacagtgtgtaaaggtattagaactgatatgtactcgtgagtcaggagcagtctttgaggctggtggtttgaattgtgtgcttaccttcattcgtgacagtggacatctagttcataaagacaccttgcactctgctatggctgtggtatcaagactctgtggcaaaatggagcctcaagattcttctttagaaatttgtgtagaatctctgtctagtttattaaagcatgaagatcatcaggtttcagatggagctctgcgatgctttgcatcactggctgaccgatttacccgtcgtggtgttgacccagctccattagccaagcatggattaactgaggagctgttatctcgaatggctgctgctggtggtactgtttcaggaccatcatcagcatgcaaaccaggtcgcagcaccacaggagctccatccaccactgcagattccaaattgagtaatcaggtgtcaacaattgtaagtctgctctcaacactttgcagaggctctccggtagtaacacatgatcttctgaggtcggagcttccagattcaattgaaagtgcattgcagggtgatgaaagatgtgtgcttgatactatgcgtttggttgaccttctcttggtgctattatttgaaggacgaaaagctttgccaaagtctagtgctggatctacaggcagaatcccaggactccggagattagatagttctggggagcgctcacatcggcagcttatagattgtattcgaagtaaagataccgatgcacttatagatgcaattgacacaggagcctttgaagtaaattttatggatgatgtaggtcagactctattaaactgggcctctgcttttggaactcaggaaatggtagaatttctttgtgagagaggtgcagatgttaatagaggtcaaaggtcatcatcattacattatgctgcatgttttggaagacctcaagtagcaaagactctgttacggcatggtgcaaatccagatctgagagatgaagatgggaaaactccattagataaagctcgagaaaggggccatagtgaagtggtagctattcttcagtctccaggtgattggatgtgtccagttaataaaggagatgataagaaaaagaaagatacaaacaaagatgaagaagaatgtaatgagcccaaaggagatccggaaatggcacccatatacttgaaaaggttattgccagtgtttgcacaaacatttcagcaaactatgctgccttcaataaggaaagcaagtcttgctctaattcgaaaaatgattcatttttgctctgaagcactgttaaaagaagtttgtgattctgatgttggtcacaatttgcctacaatactagtggaaatcactgcaactgtcctggatcaagaggatgatgatgatggccacttgctggctttgcagatcataagggatttagtagataaaggtggtgatatatttttggatcagctagccagacttggtgtaattagcaaagtgtcaacgttggcaggtccttcctctgatgatgagaatgaagaggaatcaaaaccagaaaaagaagatgaaccacaggaagatgctaaagaattgcaacaaggtaaaccatatcattggagagactggtcaatcattaggggaagggactgcttatatatttggagtgatgcagcagccttggaattatctaatggcagtaatggatggttcagatttatcttggatggaaaacttgccaccatgtattcaagtggtagtccggaaggtggatctgacagttcagaaagccgaagtgaattcttagagaagttacaaagagctcgaggccaagtaaagccatctacttcaagtcaacctatactgtcagcaccaggacccactaaacttactgtaggaaattggtcactgacatgtttgaaagaaggagaaattgctattcataattcagatggtcagcaagctacaatattgaaagaagatttacctggttttgtatttgaatctaatagaggaaccaaacattcatttactgcagaaacttccctgggttcagaatttgtgactggctggactggcaaaagaggcagaaaactgaaatctaagttagaaaaaacaaagcaaaaggtacgaactatggctcgagatttatacgatgaccattttaaagctgttgaaagcatgcctcgtggagtagtggtaacactcagaaacatagcaactcagttagagtcatcttgggaacttcatacaaatagacaatgtattgagagtgagaacacttggagagatttaatgaagacagctttagaaaacctaattgtacttttgaaggatgaaaacacaatttcaccatatgaaatgtgtagcagtggcttggtacaagcacttcttactgtgttaaacaatagcatggatttggatatgaaacaagattgtagtcaactggtagaaagaataaatgtttttaaaactgcctttagtgaaaatgaagatgatgaaagtcgaccagcagttgcgttaattcgaaagttaatagctgtactagaatctattgaacgtctacctctccatttgtatgatacaccaggatccacatataacctccagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggctggattgatgtcacctgggatgctggtggctcaaactcttaccgtatgggcgcagaaggaaaatttgacctcaagcttgcaccagggtacgaccctgatacagtggcatcacccaaacctgtttcatccactgtttcaggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctatatatagttgcaagtgacccttattcaagaatatcccaggaagatggtgatgaacagcttcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgt

SEQ ID NO: 4182 - DNA, 3267 bp, Homo sapiens
ggcttcttgggaactctagggccgcggccgggcctggctctgccggcggcctgttgggagctggatcggagcggtttggaacgacaagcccgagtaagagcctgcgggaaggggaggcgggagcgcctcggaccgtcggaagggccctgcgtgggggcgcggatcccggacgcccggcgagtggcggaaagcgagaccccggcgccgagtgaggtcggccaggctgctgccgacttccccgctggcccctttgttcccctcccggggccctgccggcggcggggcccggttgcccgcgccagagcctcaggccggctccttttgcccttgagaagggttcgctgccaggccttcgagttccgggcgcagctcccgggagagccggcgccctgcctggcccggcggcctcctctcgggcacgaaggcttgctgctgcttctccagaacttcccttcctcgtagacacagcaaagagacttttaaaaaaccatggcagatgtggacccagatacattgctggaatggctacagatgggacagggagatgaaagggacatgcaactaatagcccttgaacagctatgcatgctgcttttgatgtctgacaacgtggatcgttgttttgaaacatgtcctcctcgcactttcttaccagccctttgcaaaatttttcttgatgaaagtgctccagacaatgtattagaggtgacagcccgtgccataacatactacctggatgtatctgcggaatgtacccgaaggattgttggggtagatggagctataaaagcactttgtaatcgtttggttgtagttgaacttaacaacaggactagcagagacttagccgaacagtgtgtaaaggtattagaactgatatgtactcgtgagtcaggagcagtctttgaggctggtggtttgaattgtgtgcttaccttcattcgtgacagtggacatctagttcataaagacaccttgcactctgctatggctgtggtatcaagactctgtggcaaaatggagcctcaagattcttctttagaaatttgtgtagaatctctgtctagtttattaaagcatgaagatcatcaggtttcagatggagctctgcgatgctttgcatcactggctgaccgatttacccgtcgtggtgttgacccagctccattagccaagcatggattaactgaggagctgttatctcgaatggctgctgctggtggtactgtttcaggaccatcatcagcatgcaaaccaggtcgcagcaccacaggagctccatccaccactgcagattccaaattgagtaatcaggtgtcaacaattgtaagtctgctctcaacactttgcagaggctctccggtagtaacacatgatcttctgaggtcggagcttccagattcaattgaaagtgcattgcagggtgatgaaagatgtgtgcttgatactatgcgtttggttgaccttctcttggtgctattatttgaaggacgaaaagctttgccaaagtctagtgctggatctacaggcagaatcccaggactccggagattagatagttctggggagcgctcacatcggcagcttatagattgtattcgaagtaaagataccgatgcacttatagatgcaattgacacaggagcctttgaagtaaattttatggatgatgtaggtcagactctattaaactgggcctctgcttttggaactcaggaaatggtagaatttctttgtgagagaggtgcagatgttaatagaggtcaaaggtcatcatcattacattatgctgcatgttttggaagacctcaagtagcaaagactctgttacggcatggtgcaaatccagatctgagagatgaagatgggaaaactccattagataaagctcgagaaaggggccatagtgaagtggtagctattcttcagtctccaggtgattggatgtgtccagttaataaaggagatgataagaaaaagaaagatacaaacaaagatgaagaagaatgtaatgagcccaaaggagatccggaaatggcacccatatacttgaaaaggttattgccagtgtttgcacaaacatttcagcaaactatgctgccttcaataaggaaagcaagtcttgctctaattcgaaaaatgattcatttttgctctgaagcactgttaaaagaagtttgtgattctgatgttggtcacaatttgcctacaatactagtggaaatcactgcaactgtcctggatcaagaggatgatgatgatggccacttgctggctttgcagatcataagggatttagtagataaaggtggtgatatatttttggatcagctagccagacttggtgtaattagcaaagtgtcaacgttggcaggtccttcctctgatgatgagaatgaagaggaatcaaaaccagaaaaagaagatgaaccacaggaagatgctaaagaattgcaacaaggtaaaccatatcattggagagactggtcaatcattaggggaagggactgcttatatatttggagtgatgcagcagccttggaattatctaatggcagtaatggatggttcagatttatcttggatggaaaacttgccaccatgtattcaagtggtagtccggaaggtggatctgacagttcagaaagccgaagtgaattcttagagaagttacaaagagctcgaggccaagtaaagccatctacttcaagtcaacctatactgtcagcaccaggacccactaaacttactgtaggaaattggtcactgacatgtttgaaagaaggagaaattgctattcataattcagatggtcagcaagctacaatattgaaagaagatttacctggttttgtatttgaatctaatagaggaaccaaacattcatttactgcagaaacttccctgggttcagaatttgtgactggctggactggcaaaagaggcagaaaactgaaatctaagttagaaaaaacaaagcaaaaggtacgaactatggctcgagatttatacgatgaccattttaaagctgttgaaagcatgcctcgtggagtagtggtaacactcagaaacatagcaactcagttagagtcatcttgggaacttcatacaaatagacaatgtattgagagtgagaacacttggagagatttaatgaagacagctttagaaaacctaattgtacttttgaaggatgaaaacacaatttcaccatatgaaatgtgtagcagtggcttggtacaagcacttcttactgtgttaaacaat

SEQ ID NO: 4183 - DNA, 4802 bp, Homo sapiens
gagccctctcgcggccgcggcggcagcagcagcgccagccccagcaacactgaggccgccgccgccgcctggcgctcccgccgcccggcccgacatgagtgaggcggttcgggtaccctcgcccgccactccgctggtggtggcggcgcccgcgcctgaggagaggaaagggaaggagtcagagcgcgagaagctgccgcccatcgtatcggcgggcgccggcgcgaccgcgggtttggacagaggagccaaaggccaaatttccactttcagcagttttatttcagctgttagcccgaagaaagaagctgctgaaaacagaagttcacctgcacatcttgttttccctaacatcaagaatgtgagagaaccaccaccaatttgccttgatgttagacaaaaacagcgtacatctatggatgcatcatcatccgaaatgaaggccccagtccttccagaacctattcttcctatccagcccaaaactgtgaaagactttcaggaagatgtagaaaaagttaagtcatcaggagattggaaagcagtacatgatttttatctaacaacgtttgattctttcccagaattaaatgctgcatttaagaaagatgccactgcctcatttaacaccattgaagactctgggattaatgctaaatttgtgaatgctgtgtatgataccttacttaatactcctcaagacgttcagaagacagtattaaagggaatcattaacagcctgttacgagaatggaaaggtccacgaacaaaagatgatcttagagcatattttatacttttacagaatcctcagtttaataacacatctacgtatgtcatctatgctcacttgctacgacagatagctaccttagtggaagctgaccatcatttcctagttcactggtttaaaaaattgtcccagaagaggttcaaacaattggtagagagattgctgcaatttatttctttacgcctgtttcctgcaaagcctgaagaatttccacctataacaaagtgttcctggtggattccatcagccgctaaagtgttggctttacttaatactgcaaacaatttagttcaccctccccttattccttatactgatttctataattctacattggatcacattgatctcatggaagaatatcatacttggcaaaactttggaaactctcacaggttttccttctgtcagtacccattcgttatttctgtagctgcaaaaaaaatcattattcagagagactcagagcaacagatgataaacatcgcaaggcaaagtctggtggataaagtatctcgaagacagagacctgatatgaatatattatttctaaatatgaaagtaagacggacacatctggttagcgattcacttgatgagctaacccggaaaagagccgatttgaaaaagaagttaaaagttacatttgtaggggaagctggtttggatatgggtggtttgactaaagaatggttccttcttctaattcgccaaatttttcatccagattatggcatgtttacatatcacaaggattcacactgccattggtttagcagctttaaatgtgataactattctgaattccgattggttggaattcttatgggactagctgtttataacagcatcaccttggatattcgtttccctccctgctgttacaagaaattattgagccctcccatcattcctagtgatcaaaatataccagtaggcatctgcaatgttaccgtggacgacttatgtcaaattatgcctgagttggcccatggattaagtgaactcttatcacatgaaggcaatgttgaagaagatttctattcaacatttcaggtttttcaagaagaatttggaataatcaagtcctataatttaaagcccggtggtgataaaatttcagttaccaatcaaaatagaaaagaatatgtacagctttatactgacttccttctgaacaaatccatctataagcagtttgctgcattttattatggatttcatagtgtgtgtgcttcaaatgccctaatgctgcttcgtccagaagaggttgaaattttggtctgtggaagtcctgacctggatatgcatgctctgcagagaagtactcagtatgatggctatgcaaaaacggacttaactataaaatacttttgggatgttgtgcttggatttcctcttgatcttcaaaagaagttgctacattttactacagggagtgacagagtacctgtaggagggatggctgatttgaactttaaaatctcaaagaatgaaacttctactaactgcttacctgtggcccatacctgcttcaatcaactttgccttcccccctacaagagcaaaaaggatctgaaacagaaattgatcattggaatttcaaattcagaaggttttggacttgagtaacctagaagacttgaaatataatcttttatatgtagcattcacttccctcttactgtgcctttagccttttcatgtttctgtctcaaaacactttgacaaagctcaccaactttaaaatattaagtttttaaaaaatcaaatatgaagtatgttcagcaaaggcataattttctaaaaacacacacagaaatcgcttgagtgaggaaaagtccacatggcagagacaggtatggtccagttcctcttttatatagcactttatcattctccacaagtagtttgtcacaggcattccactgggaaagcaaagtacagtgaagaatgaatttatggtatagttgaacccagtggcagattgtacactgctagcactgctagcacacagtagcaaagcaaacagctacattatctttaacataaggcatgtagccatattttcatatagtggtatacaacacagtatcattgcaaatgcagtttacagggatttttgatatactggcttgggacctataagattcttctcagcagttgctgaaaagcatgtaaataactacataatagcctgagaataatgggattttgatagtgccatttattgttaaagatttatttttacaaagtaaattcagggttttagatgtgtacacagcttttacaaatcaataaagatgattgtacaagagtattttcagactaattggattcaaggttatattcttttaagtgttgttagtctgcatgcacattggcagtaaactagttacttgtgtactctgtaatatttgtataatgatcatttcttcttaaggctcaagatattagaaaagaaatcagacctaaataatcattgatgaagtatgtcagttacaagcacaaaagaatataactgcttttataaatcttttgaatcatgtacaagacttatatctacattttttgatcaccagttgtaccaaaacactaatttttgaaaaagataggttaaagtatttgacaaaagtgaatacaataataacacttgtgtcaaaatgatatagcttagtataaaaataaaattcaacgttttggccaaaatgtttgtttttcactggattctgaatataataaattcaaagtaccctttttttagagtttctaataaagtagtatgtaaaaagaaactgcattttaagtcagacagtaaatgttttttttaatttacagcaaatgaagcagttttattagcatgttacaaatattgccaaaccaagacttctctaccatactttaacagctttccttcagaaaactctgaagttatatttgcaataataatgaaaccagcatttagtaccagcatatggttcatatgcaaataatactttccccaaaatctttctgggctaggctattttcttgctatgcttcctgcacccaaccagcagaattcttccagggtggaggaactaatcagcttgttctccaacagttctgaagccaacccacaaatctttgaggaaaaggggtcactttgtttactattctcttggagatggaagtgattctgctcttccatttgggtatattatttcaagggtatttcttcttaaaaatcttggaaagcctaagagagttaaaggcatcctggttttgtttcattttgctctgttttaaatccatatgcaaataaaactgcttctctcttacactgcttgaactagaaaatcagctttttaatgtaggttaccacttataagcacaaaagaaacatgtataagaaaccagatttaagtgttttaaataaaatgtaaacagtttttatttggtagagatgactcatggaaaaattgtgttggcttggtctgcatgtttaatgatgtgcttgtatatcgattagctgtgtcacttttaaataagaagtccacacaagcaagccaaatttttagatgacgaagtccataaataactagagaatttttgttatctgttgttaagttgaaatgtataatcatttatcactaaattgcacattgcctttatttatttgtgctctgtttttggtttacagtgtaataatacctcatttaaaaaataaaaaccactactgttacattttattaatttaaaaagctagaaaattcatgtagttactttttttacatatataatctgttaatgaattattgatttttgtatctgccacagtaaattaaagcattacacagtatttatcagtattttttaaacatcctgtccttttttaaaatctttgcttagtcagtcatatttttgtctgtatgattagaagtttttacgtccttccttttttgtacaaatctgtattgtattaatttctggatgcaatttttcaaatattaaaattatacagtcagtc

SEQ ID NO: 4184 - DNA, 4354 bp, Homo sapiens
gacctcagctggaaatgtgcatgtcaggagactaacatctttcacatgtccccaaatgaccatgaaaacacaagtattgatttggggattaacaattaaattttaccaagtaggcaaatttggaaatatagaatctgtgaataatgaagactgaatattgaaagtctttaaaatgtttgttactaactttatagtaattttggtgtttatttctcatttaacgaagacagtattcaaggtaagattttgtatcttttcaaatgtttggcaatttaagaaatagaatttgggggaatagtctaaaattttgtggcttaggatgtagtttaatatctaacagataattttggaaatagaaaatgtgaattttgattgcaattattttgaaatctttaccagattgtcccagaagaggttcaaacaattggtagagagattgctgcaatttatttctttacgcctgtttcctgcaaagcctgaagaatttccacctataacaaagtgttcctggtggattccatcagccgctaaagtgttggctttacttaatactgcaaacaatttagttcaccctccccttattccttatactgatttctataattctacattggatcacattgatctcatggaagaatatcatacttggcaaaactttggaaactctcacaggttttccttctgtcagtacccattcgttatttctgtagctgcaaaaaaaatcattattcagagagactcagagcaacagatgataaacatcgcaaggcaaagtctggtggataaagtatctcgaagacagagacctgatatgaatatattatttctaaatatgaaagtaagacggacacatctggttagcgattcacttgatgagctaacccggaaaagagccgatttgaaaaagaagttaaaagttacatttgtaggggaagctggtttggatatgggtggtttgactaaagaatggttccttcttctaattcgccaaatttttcatccagattatggcatgtttacatatcacaaggattcacactgccattggtttagcagctttaaatgtgataactattctgaattccgattggttggaattcttatgggactagctgtttataacagcatcaccttggatattcgtttccctccctgctgttacaagaaattattgagccctcccatcattcctagtgatcaaaatataccagtaggcatctgcaatgttaccgtggacgacttatgtcaaattatgcctgagttggcccatggattaagtgaactcttatcacatgaaggcaatgttgaagaagatttctattcaacatttcaggtttttcaagaagaatttggaataatcaagtcctataatttaaagcccggtggtgataaaatttcagttaccaatcaaaatagaaaagaatatgtacagctttatactgacttccttctgaacaaatccatctataagcagtttgctgcattttattatggatttcatagtgtgtgtgcttcaaatgccctaatgctgcttcgtccagaagaggttgaaattttggtctgtggaagtcctgacctggatatgcatgctctgcagagaagtactcagtatgatggctatgcaaaaacggacttaactataaaatacttttgggatgttgtgcttggatttcctcttgatcttcaaaagaagttgctacattttactacagggagtgacagagtacctgtaggagggatggctgatttgaactttaaaatctcaaagaatgaaacttctactaactgcttacctgtggcccatacctgcttcaatcaactttgccttcccccctacaagagcaaaaaggatctgaaacagaaattgatcattggaatttcaaattcagaaggttttggacttgagtaacctagaagacttgaaatataatcttttatatgtagcattcacttccctcttactgtgcctttagccttttcatgtttctgtctcaaaacactttgacaaagctcaccaactttaaaatattaagtttttaaaaaatcaaatatgaagtatgttcagcaaaggcataattttctaaaaacacacacagaaatcgcttgagtgaggaaaagtccacatggcagagacaggtatggtccagttcctcttttatatagcactttatcattctccacaagtagtttgtcacaggcattccactgggaaagcaaagtacagtgaagaatgaatttatggtatagttgaacccagtggcagattgtacactgctagcactgctagcacacagtagcaaagcaaacagctacattatctttaacataaggcatgtagccatattttcatatagtggtatacaacacagtatcattgcaaatgcagtttacagggatttttgatatactggcttgggacctataagattcttctcagcagttgctgaaaagcatgtaaataactacataatagcctgagaataatgggattttgatagtgccatttattgttaaagatttatttttacaaagtaaattcagggttttagatgtgtacacagcttttacaaatcaataaagatgattgtacaagagtattttcagactaattggattcaaggttatattcttttaagtgttgttagtctgcatgcacattggcagtaaactagttacttgtgtactctgtaatatttgtataatgatcatttcttcttaaggctcaagatattagaaaagaaatcagacctaaataatcattgatgaagtatgtcagttacaagcacaaaagaatataactgcttttataaatcttttgaatcatgtacaagacttatatctacattttttgatcaccagttgtaccaaaacactaatttttgaaaaagataggttaaagtatttgacaaaagtgaatacaataataacacttgtgtcaaaatgatatagcttagtataaaaataaaattcaacgttttggccaaaatgtttgtttttcactggattctgaatataataaattcaaagtaccctttttttagagtttctaataaagtagtatgtaaaaagaaactgcattttaagtcagacagtaaatgttttttttaatttacagcaaatgaagcagttttattagcatgttacaaatattgccaaaccaagacttctctaccatactttaacagctttccttcagaaaactctgaagttatatttgcaataataatgaaaccagcatttagtaccagcatatggttcatatgcaaataatactttccccaaaatctttctgggctaggctattttcttgctatgcttcctgcacccaaccagcagaattcttccagggtggaggaactaatcagcttgttctccaacagttctgaagccaacccacaaatctttgaggaaaaggggtcactttgtttactattctcttggagatggaagtgattctgctcttccatttgggtatattatttcaagggtatttcttcttaaaaatcttggaaagcctaagagagttaaaggcatcctggttttgtttcattttgctctgttttaaatccatatgcaaataaaactgcttctctcttacactgcttgaactagaaaatcagctttttaatgtaggttaccacttataagcacaaaagaaacatgtataagaaaccagatttaagtgttttaaataaaatgtaaacagtttttatttggtagagatgactcatggaaaaattgtgttggcttggtctgcatgtttaatgatgtgcttgtatatcgattagctgtgtcacttttaaataagaagtccacacaagcaagccaaatttttagatgacgaagtccataaataactagagaatttttgttatctgttgttaagttgaaatgtataatcatttatcactaaattgcacattgcctttatttatttgtgctctgtttttggtttacagtgtaataatacctcatttaaaaaataaaaaccactactgttacattttattaatttaaaaagctagaaaattcatgtagttactttttttacatatataatctgttaatgaattattgatttttgtatctgccacagtaaattaaagcattacacagtatttatcagtattttttaaacatcctgtccttttttaaaatctttgcttagtcagtcatatttttgtctgtatgattagaagtttttacgtccttccttttttgtacaaatctgtattgtattaatttctggatgcaatttttcaaatattaaaattatacagtcagtcaggcttcagtttattttttgaacacttgggcaattaattaaagccatatgtttaaaatattttataaa

SEQ ID NO: 4185 - DNA, 1372 bp, Homo sapiens
cagagccctctcgcggccgcggcggcagcagcagcgccagccccagcaacactgaggccgccgccgccgcctggcgctcccgccgcccggcccgacatgagtgaggcggttcgggtaccctcgcccgccactccgctggtggtggcggcgcccgcgcctgaggagaggaaagggaaggagtcagagcgcgagaagctgccgcccatcgtatcggcgggcgccggcgcgaccgcgggtttggacagaggagccaaaggccaaatttccactttcagcagttttatttcagctgttagcccgaagaaagaagctgctgaaaacagaagttcacctgcacatcttgttttccctaacatcaagaatgtgagagaaccaccaccaatttgccttgatgttagacaaaaacagcgtacatctatggatgcatcatcatccgaaatgaaggccccagtccttccagaacctattcttcctatccagcccaaaactgtgaaagactttcaggaagatgtagaaaaagttaagtcatcaggagattggaaagcagtacatgatttttatctaacaacgtttgattctttcccagaattaaatgctgcatttaagaaagatgccactgcctcatttaacaccattgaagactctgggattaatgctaaatttgtgaatgctgtgtatgataccttacttaatactcctcaagacgttcagaagacagtattaaagggaatcattaacagcctgttacgagaatggaaaggtccacgaacaaaagatgatcttagagcatattttatacttttacagaatcctcagtttaataacacatctacgtatgtcatctatgctcacttgctacgacagatagctaccttagtggaagctgaccatcatttcctagttcactggtttaaaaaaaatctttaccagattgtcccagaagaggttcaaacaattggtagagagattgctgcaatttatttctttacgcctgtttcctgcaaagcctgaagaatttccacctataacaaagtgttcctggtggattccatcagccgctaaagtgttggctttacttaatactgcaaacaatttagttcaccctccccttattccttatactgatttctataattctacattggatcacattgatctcatggaagaatatcatacttggcaaaactttggaaactctcacaggatggctgtgagaattaaaagaaattatacacatacaatcattttgtatatggtaaaacacaatccaaaagtaatgttttatattgctacaaggggtaccttagattcccttagtataattttgttaaaaatacaccattttgctttttctttttttcacttgttgagc

SEQ ID NO: 4186 - DNA, 2175 bp, Homo sapiens
agagccctctcgcggccgcggcggcagcagcagcgccagccccagcaacactgaggccgccgccgccgcctggcgctcccgccgcccggcccgacatgagtgaggcggttcgggtaccctcgcccgccactccgctggtggtggcggcgcccgcgcctgaggagaggaaagggaaggagtcagagcgcgagaagctgccgcccatcgtatcggcgggcgccggcgcgaccgcgggtttggacagaggagccaaaggccaaatttccactttcagcagttttatttcagctgttagcccgaagaaagaagctgctgaaaacagaagttcacctgcacatcttgttttccctaacatcaagaatgtgagagaaccaccaccaatttgccttgatgttagacaaaaacagcgtacatctatggatgcatcatcatccgaaatgaaggccccagtccttccagaacctattcttcctatccagcccaaaactgtgaaagactttcaggaagatgtagaaaaagttaagtcatcaggagattggaaagcagtacatgatttttatctaacaacgtttgattctttcccagaattaaatgctgcatttaagaaagatgccactgcctcatttaacaccattgaagactctgggattaatgctaaatttgtgaatgctgtgtatgataccttacttaatactgtaagtattatgacatgcaagtaatattattctgtgtctcttctgtatatcaaaagcagccatacaaatattgtaaaaatcaccttataattaccttagaaactctgatacaattttatagtaaatgtagctggaattctcataaagttagattattttattcttttattttttaattatgaattaagcagcaaatacttttatatccaatccttttttagaaagacttgctaaaatcatgctttacttactcagcaaaaggaggtaagttatttaattatattggaattacactgaatctgtagatcagtggttcttaaacattagcctgtatcagaatcacaagaagggcttgttaaaatacagaatttcagattcagtaggtcttgggtgaagcccaagaattttcatttgtaacaagttcccaggatatgttgatttatgagttcatttatgatgtgacacatactataaaaattatgtcaccattcaaaaaatccagatgcatatttgaaggactaagtgggaatgataaagacagaatgtaaacaaagtctccagaagtttagctatgaagtgaaagacatgttaagaatgaccacattttgagaaccatactgctatagatcaatttgtgaaaaattgacatcttttcaatccataagcatactgtatccttttaggtacctaggtcttctttaatttctcttggtaatgttttgtagttttctggatagaggtgttacacatttctcattacatgtatttctaggtacttcattttttttatcctattataattttattttccaattgtgactaatatatggaaatactttcatatatttatctttatctaaatacagttgacccttgaacaatgcgagggttaggggcgctaaccccctatgcagtaaaaaaaaaaatctgtgtataacttttgactccccagaagcttaactactaataacctattgttgaccagaagtcttactgataacataaacagtcaattaacgtatattttatgttatatgtattctatactatattgttacaataaagtaagctaaggaaaaggcaatgttattaagaaaaaataaggaagataaaatatatttactatatattaagtggaagtggactatcataaaggtcttcatccttattgagtaggctgaggaagaggaggggttggtcttgctgtctcaggtggcagaggtgaaagaaaataatgtatataagcagacttgcacaattcaagcctgtattcaagagtcaactgtactttgctatattcatccattaattctaatagtacatcagtaaattaacttggattttctgtgtacacaatcttgtcatttgtgaaaaaggagagttttatctccttctaatcctgtatcttatatggatatatgtatgtgtttgcattgactgggacctctttcacaattgtgaataaaagaagtaatagcag

SEQ ID NO: 4187 - DNA, 4820 bp, Homo sapiens
agcccagagccctctcgcggccgcggcggcagcagcagcgccagccccagcaacactgaggccgccgccgccgcctggcgctcccgccgcccggcccgacatgagtgaggcggttcgggtaccctcgcccgccactccgctggtggtggcggcgcccgcgcctgaggagaggaaagggaaggagtcagagcgcgagaagctgccgcccatcgtatcggcgggcgccggcgcgaccgcgggtttggacagaggagccaaaggccaaatttccactttcagcagttttatttcagctgttagcccgaagaaagaagctgctgaaaacagaagttcacctgcacatcttgttttccctaacatcaagaatgtgagagaaccaccaccaatttgccttgatgttagacaaaaacagcgtacatctatggatgcatcatcatccgaaatgaaggccccagtccttccagaacctattcttcctatccagcccaaaactgtgaaagactttcaggaagatgtagaaaaagttaagtcatcaggagattggaaagcagtacatgatttttatctaacaacgtttgattctttcccagaattaaatgctgcatttaagaaagatgccactgcctcatttaacaccattgaagactctgggattaatgctaaatttgtgaatgctgtgtatgataccttacttaatactcctcaagacgttcagaagacagtattaaagggaatcattaacagcctgttacgagaatggaaaggtccacgaacaaaagatgatcttagagcatattttatacttttacagaatcctcagtttaataacacatctacgtatgtcatctatgctcacttgctacgacagatagctaccttagtggaagctgaccatcatttcctagttcactggtttaaaaaacagtattcaagattgtcccagaagaggttcaaacaattggtagagagattgctgcaatttatttctttacgcctgtttcctgcaaagcctgaagaatttccacctataacaaagtgttcctggtggattccatcagccgctaaagtgttggctttacttaatactgcaaacaatttagttcaccctccccttattccttatactgatttctataattctacattggatcacattgatctcatggaagaatatcatacttggcaaaactttggaaactctcacaggttttccttctgtcagtacccattcgttatttctgtagctgcaaaaaaaatcattattcagagagactcagagcaacagatgataaacatcgcaaggcaaagtctggtggataaagtatctcgaagacagagacctgatatgaatatattatttctaaatatgaaagtaagacggacacatctggttagcgattcacttgatgagctaacccggaaaagagccgatttgaaaaagaagttaaaagttacatttgtaggggaagctggtttggatatgggtggtttgactaaagaatggttccttcttctaattcgccaaatttttcatccagattatggcatgtttacatatcacaaggattcacactgccattggtttagcagctttaaatgtgataactattctgaattccgattggttggaattcttatgggactagctgtttataacagcatcaccttggatattcgtttccctccctgctgttacaagaaattattgagccctcccatcattcctagtgatcaaaatataccagtaggcatctgcaatgttaccgtggacgacttatgtcaaattatgcctgagttggcccatggattaagtgaactcttatcacatgaaggcaatgttgaagaagatttctattcaacatttcaggtttttcaagaagaatttggaataatcaagtcctataatttaaagcccggtggtgataaaatttcagttaccaatcaaaatagaaaagaatatgtacagctttatactgacttccttctgaacaaatccatctataagcagtttgctgcattttattatggatttcatagtgtgtgtgcttcaaatgccctaatgctgcttcgtccagaagaggttgaaattttggtctgtggaagtcctgacctggatatgcatgctctgcagagaagtactcagtatgatggctatgcaaaaacggacttaactataaaatacttttgggatgttgtgcttggatttcctcttgatcttcaaaagaagttgctacattttactacagggagtgacagagtacctgtaggagggatggctgatttgaactttaaaatctcaaagaatgaaacttctactaactgcttacctgtggcccatacctgcttcaatcaactttgccttcccccctacaagagcaaaaaggatctgaaacagaaattgatcattggaatttcaaattcagaaggttttggacttgagtaacctagaagacttgaaatataatcttttatatgtagcattcacttccctcttactgtgcctttagccttttcatgtttctgtctcaaaacactttgacaaagctcaccaactttaaaatattaagtttttaaaaaatcaaatatgaagtatgttcagcaaaggcataattttctaaaaacacacacagaaatcgcttgagtgaggaaaagtccacatggcagagacaggtatggtccagttcctcttttatatagcactttatcattctccacaagtagtttgtcacaggcattccactgggaaagcaaagtacagtgaagaatgaatttatggtatagttgaacccagtggcagattgtacactgctagcactgctagcacacagtagcaaagcaaacagctacattatctttaacataaggcatgtagccatattttcatatagtggtatacaacacagtatcattgcaaatgcagtttacagggatttttgatatactggcttgggacctataagattcttctcagcagttgctgaaaagcatgtaaataactacataatagcctgagaataatgggattttgatagtgccatttattgttaaagatttatttttacaaagtaaattcagggttttagatgtgtacacagcttttacaaatcaataaagatgattgtacaagagtattttcagactaattggattcaaggttatattcttttaagtgttgttagtctgcatgcacattggcagtaaactagttacttgtgtactctgtaatatttgtataatgatcatttcttcttaaggctcaagatattagaaaagaaatcagacctaaataatcattgatgaagtatgtcagttacaagcacaaaagaatataactgcttttataaatcttttgaatcatgtacaagacttatatctacattttttgatcaccagttgtaccaaaacactaatttttgaaaaagataggttaaagtatttgacaaaagtgaatacaataataacacttgtgtcaaaatgatatagcttagtataaaaataaaattcaacgttttggccaaaatgtttgtttttcactggattctgaatataataaattcaaagtaccctttttttagagtttctaataaagtagtatgtaaaaagaaactgcattttaagtcagacagtaaatgttttttttaatttacagcaaatgaagcagttttattagcatgttacaaatattgccaaaccaagacttctctaccatactttaacagctttccttcagaaaactctgaagttatatttgcaataataatgaaaccagcatttagtaccagcatatggttcatatgcaaataatactttccccaaaatctttctgggctaggctattttcttgctatgcttcctgcacccaaccagcagaattcttccagggtggaggaactaatcagcttgttctccaacagttctgaagccaacccacaaatctttgaggaaaaggggtcactttgtttactattctcttggagatggaagtgattctgctcttccatttgggtatattatttcaagggtatttcttcttaaaaatcttggaaagcctaagagagttaaaggcatcctggttttgtttcattttgctctgttttaaatccatatgcaaataaaactgcttctctcttacactgcttgaactagaaaatcagctttttaatgtaggttaccacttataagcacaaaagaaacatgtataagaaaccagatttaagtgttttaaataaaatgtaaacagtttttatttggtagagatgactcatggaaaaattgtgttggcttggtctgcatgtttaatgatgtgcttgtatatcgattagctgtgtcacttttaaataagaagtccacacaagcaagccaaatttttagatgacgaagtccataaataactagagaatttttgttatctgttgttaagttgaaatgtataatcatttatcactaaattgcacattgcctttatttatttgtgctctgtttttggtttacagtgtaataatacctcatttaaaaaataaaaaccactactgttacattttattaatttaaaaagctagaaaattcatgtagttactttttttacatatataatctgttaatgaattattgatttttgtatctgccacagtaaattaaagcattacacagtatttatcagtattttttaaacatcctgtccttttttaaaatctttgcttagtcagtcatatttttgtctgtatgattagaagtttttacgtccttccttttttgtacaaatctgtattgtattaatttctggatgcaatttttcaaatattaaaattatacagtcagtc

SEQ ID NO: 4188 - DNA, 2377 bp, Homo sapiens
aatgctaaatttgtgaatgctgtgtatgataccttacttaatactcctcaagacgttcagaagacagtattaaagggaatcattaacagcctgttacgagaatggaaaggtccacgaacaaaagatgatcttagagcatattttatacttttacagaatcctcagtttaataacacatctacgtatgtcatctatgctcacttgctacgacagatagctaccttagtggaagctgaccatcatttcctagttcactggtttaaaaaattgtcccagaagaggttcaaacaattggtagagagattgctgcaatttatttctttacgcctgtttcctgcaaagcctgaagaatttccacctataacaaagtgttcctggtggattccatcagccgctaaagtgttggctttacttaatactgcaaacaatttagttcaccctccccttattccttatactgatttctataattctacattggatcacattgatctcatggaagaatatcatacttggcaaaactttggaaactctcacagcaaagtctggtggataaagtatctcgaagacagagacctgatatgaatatattatttctaaatatgaaagtaagacggacacatctggttagcgattcacttgatgagctaacccggaaaagagccgatttgaaaaagaagttaaaagttacatttgtaggggaagctggtttggatatgggtggtttgactaaagaatggttccttcttctaattcgccaaatttttcatccagattatggcatgtttacatatcacaaggattcacactgccattggtttagcagctttaaatgtgataactattctgaattccgattggttggaattcttatgggactagctgtttataacagcatcaccttggatattcgtttccctccctgctgttacaagaaattattgagccctcccatcattcctagtgatcaaaatataccagtaggcatctgcaatgttaccgtggacgacttatgtcaaattatgcctgagttggcccatggattaagtgaactcttatcacatgaaggcaatgttgaagaagatttctattcaacatttcaggtttttcaagaagaatttggaataatcaagtcctataatttaaagcccggtggtgataaaatttcagttaccaatcaaaatagaaaagaatatgtacagctttatactgacttccttctgaacaaatccatctataagcagtttgctgcattttattatggatttcatagtgtgtgtgcttcaaatgccctaatgctgcttcgtccagaagaggttgaaattttggtctgtggaagtcctgacctggatatgcatgctctgcagagaagtactcagtatgatggctatgcaaaaacggacttaactataaaatacttttgggatgttgtgcttggatttcctcttgatcttcaaaagaagttgctacattttactacagggagtgacagagtacctgtaggagggatggctgatttgaactttaaaatctcaaagaatgaaacttctactaactgcttacctgtggcccatacctgcttcaatcaactttgccttcccccctacaagagcaaaaaggatctgaaacagaaattgatcattggaatttcaaattcagaaggttttggacttgagtaacctagaagacttgaaatataatcttttatatgtagcattcacttccctcttactgtgcctttagccttttcatgtttctgtctcaaaacactttgacaaagctcaccaactttaaaatattaagtttttaaaaaatcaaatatgaagtatgttcagcaaaggcataattttctaaaaacacacacagaaatcgcttgagtgaggaaaagtccacatggcagagacaggtatggtccagttcctcttttatatagcactttatcattctccacaagtagtttgtcacaggcattccactgggaaagcaaagtacagtgaagaatgaatttatggtatagttgaacccagtggcagattgtacactgctagcactgctagcacacagtagcaaagcaaacagctacattatctttaacataaggcatgtagccatattttcatatagtggtatacaacacagtatcattgcaaatgcagtttacagggatttttgatatactggcttgggacctataagattcttctcagcagttgctgaaaagcatgtaaataactacataatagcctgagaataatgggattttgatagtgccatttattgttaaagatttatttttacaaagtaaattcagggttttagatgtgtacacagcttttacaaatcaataaagatgattgtacaagagtattttcagact

SEQ ID NO: 4189 - DNA, 3579 bp, Homo sapiens
gaagtttatgcgtgcttccggtccgcgagccctgagagctaacttggggtcttttcccaaggtggatgtagaagcgggctccggcgtcccactctcccttccatatgggcttagcgtctgggtcactgagaacgacgtctgaatagggccctgggtccttgccatggatgaatgtggttcccgcatccgccggcgggtgtctctccccaaaaggaaccgtccaagcttggggtgtatttttggcgctcccaccgcggccgagctcgtgcccggagatgaggggaaagaggaggaggaaatggtggctgagaacaggaggcggaaaaccgcgggcgtactgccggttgaggtacagccccttctactctcagattccccggaatgtctcgtccttggaggtggtgatacaaacccggacctcctacgtcacatgcccactgacagaggggtgggagaccagcctaatgacagtgaagtggacatgtttggtgactatgatagctttactgaaaactcctttatagctcaagttgacgacctggaacaaaaatatatgcaactccctgaacataagaaacatgctacagactttgccactgaaaatctttgctcggaaagtatcaaaaacaaactcagcattactaccataggcaaccttactgaattacaaactgataagcacacagagaaccagagtggatatgaaggtgtcactattgaacctggagctgatcttttgtatgatgtaccttcctcacaggctatatactttgaaaatttgcagaactcttcaaatgatttgggtgatcattctatgaaagaaagggattggaagtcatcctctcacaacactgtgaatgaggaactgccccataattgcatagagcaaccccagcaaaatgatgagtcctcttccaaagtcagaactagttcagatatgaacaggagaaaaagtattaaagatcatctaaaaaatgccatgactggaaatgcgaaggcccagacaccaatattttctagaagtaaacagctcaaagacactctcctatctgaggaaattaatgttgctaagaaaacagttgagtcatcatcaaatgaccttggtcctttttattcattacccagcaaagtgagagacctttatgcccaattcaagggaattgaaaaattatatgaatggcaacatacttgtttaacattgaattctgtgcaagaaagaaaaaatttaatatattccttgccaacaagtggtggaaaaaccctcgtggctgagattttaatgctgcaagaactgctttgctgtcggaaagatgttttaatgattcttccatatgtggcaattgtccaagaaaagatttcaggtttgtcaagttttggtatagaactcggtttctttgttgaagaatatgctggaagcaaaggaagatttcctccaactaaaagaagggaaaagaaatcactctatattgccactattgaaaaaggacatagcttggtgaactccttgattgaaactggaagaattgacagtctgggtctggttgttgtagacgagttgcacatgattggtgaaggaagccgtggagctacactggaaatgaccctagcaaaaatcctctacactagcaaaacgactcaaattattggtatgagtgcaacattaaacaatgttgaagacctacaaaagtttcttcaagcagaatattataccagtcaatttagaccagttgagttaaaagaatatctgaaaataaatgatacaatatatgaagttgacagcaaagctgagaatggcatgactttttcacgtcttcttaattataagtattctgataccctaaaaaagatggatcctgatcacttggtagcattggtgacagaagttattcccaattattcctgcttagttttttgtcctagtaagaagaactgtgaaaatgtagcagaaatgatatgcaaatttttaagcaaggaatatctgaaacataaggagaaagaaaaatgtgaggtgattaagaacttgaagaatattggcaatggcaacctgtgtcctgttttaaagcgcactatcccatttggagttgcctatcaccacagtggcttaacaagtgatgaaaggaaactcttggaggaggcctactccacaggagtgctctgtctttttacctgcacatctaccctagcggcaggtgtcaacctaccagctcgaagagttattttaagagctccctatgttgctaaggaatttttaaagaggaatcaatataaacagatgattggcagagctggtcgtgctggaatagatactattggggagagtatcctcatattgcaagaaaaagacaaacaacaggtattggagttaataactaaaccattggaaaactgttacagccatcttgttcaggaattcaccaagggaatccaaacattatttctctctttgattggtttgaagattgcaacgaatcttgatgacatctatcatttcatgaatggtacattttttggtgttcagcaaaaggttttattgaaagaaaaaagtctctgggaaataactgttgaatcacttagatacctgacagaaaaaggactcctacaaaaagacactatttataagtctgaagaagaggtccaatataattttcatattacaaagttgggacgtgcttcatttaagggaactatagatttagcttattgtgacattctgtacagagacttgaagaaaggtcttgaaggacttgtgcttgaaagccttcttcatctaatctacctaacaaccccctatgatctggtttcacagtgtaaccctgattggatgatatacttcaggcagtttagccaactcagtccagcagaacaaaatgtagctgccattcttggagtctctgaaagctttattgggaagaaagcatcaggccaagccatcggaaagaaggtggacaagaacgttgtcaacaggctatatctgtcttttgttctttataccttgctcaaagagaccaacatttggactgtatctgaaaaatttaatatgcctcgaggatatatacaaaatcttctcactggaactgcctcattctcatcttgtgtgttacatttctgtgaggagcttgaggagttttgggtttacagagcccttttggtagaacttaccaagaagctgacttactgtgtaaaggcagaattaatccctctcatggaagttactggagttttagagggtcgagcaaaacagttatacagtgcaggttacaaaagtctaatgcacttagctaatgcaaatcctgaagtgctcgtaaggacaattgatcatttatcaagacgccaagccaagcaaattgtttcatcagcaaagatgctgttgcatgaaaaagcagaagccctgcaagaagaggtagaagagttactaagattgccttctgatttccctggtgctgtggcttcttccactgacaaagcatgaagctatctgatgagaattttcatatatgaattatttattgtacatgtgtgttattaaagataacttatactttataaatgaaaaaatacatttcagttatacattaagaa

SEQ ID NO: 4190 - DNA, 1519 bp, Homo sapiens
aggctgagccgtggccgccacagcccatcgtaatgccgcatggtgcttggcactccagagagccaataggaatgaaagaattcatttgaatcggccaatgccggcgggttagggggcgggggttgaaaaccctataaaggcgtcgatcggccggacaggcggcagcggcggctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaat

SEQ ID NO: 4191 - DNA, 580 bp, Homo sapiens
agcggcggctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagacttctggaggtaaaatagaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttag

SEQ ID NO: 4192 - DNA, 1696 bp, Homo sapiens
gcttaggctgagccgtggccgccacagcccatcgtaatgccgcatggtgcttggcactccagagagccaataggaatgaaagaattcatttgaatcggccaatgccggcgggttagggggcgggggttgaaaaccctataaaggcgtcgatcggccggacaggcggcagcggcggctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagacacggggtcttgccatgttgcccaggctggtcttgaactcctaggctcaagtgatgatcctgccttggcctcctagggtgctgggattacagagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 4193 - DNA, 1605 bp, Homo sapiens
gcgggcttaggctgagccgtggccgccacagcccatcgtaatgccgcatggtgcttggcactccagagagccaataggaatgaaagaattcatttgaatcggccaatgccggcgggttagggggcgggggttgaaaaccctataaaggcgtcgatcggccggacaggcggcagcggcggctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 4194 - DNA, 2370 bp, Homo sapiens
gtccttcccaagaccacacccaggtccagtcattccctaggacttggcagagagctgtactcacagccaagatcacagcaaaatcagcaaagggaaaaggcatgcagagtgaagtccagaggcaaccagacagaagcatccagaatcctctcacagtggggtcacacaccccatgcttaactcccccaacaatgagttgtaacaacagtcaggtgtggtggtgtgtgcctgtagtcccagctacttgggagcctgaggcaggaggatcacttgagtccagcagttcaagactgcagtgagctatgatcataccactgcactccagcctgagtgacagagtgaaactctgtctctaaaatagggctcacctgcttgaggaaacaggaactgcctcggggcagccagccccgccccattgacgtgcagaccttgaatcgaaacccaggctcctgcaggcactggcacagctacagcgagggcctcggccatccaagggtctcccaggtgaccttccctccaccccaggaagctatgacagaggccgggaagctgcccctaccgctacccccacggctggactggtttgtgcacacccagatgggccagctggcccaagacggggtccccgagtggttccatggtgcaatctcaagagaggatgctgagaacttgctggagtcacagccactgggatcctttctcatcagggtcagtcacagccatgtgggctacacactctcctacaaagcccaaagcagctgctgccatttcatggtgaagctcttggatgatgggactttcatgatccccggggagaaggtggcccacacctcgctggacgccctggtcaccttccaccagcagaagccaattgagccgcgcagggagctgctgacacagccctgcaggcagaaggatcccgcaaacgtggattacgaggatctcttcctctactccaacgcagtggccgaggaagctgcctgcccggtgtctgcccctgaggaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagctaaaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctagagaacaggtccaccctggctctgggactcgctgccaggggctgccacactcctgaatgccttaacatttcttccatggccccacaccatggcatccgggggtcttcgggaacccgggaaatggaataaagatgtttttggggtctgttcctgcactcacccatggggtgagctggttattttagcaacaatcatcagagtgacgctgatggtttggggcaccagctatacatcagccccagtgccagaccttctattcattattttacgcctcagagcaaggccctcagggagggtcatcctccatgttttgaagaagagactgaggttcagagaggataagaggcgtgaccaaggccacagagctatgggtgtcagcaccaggatttgaagccaggtgaatccgagcccttttcccatatcatctgtttgttctgttgtctaaaagcacactgcaagccgggctcagtggctcatgcctgtagtcccagcactctgtggggccgaggcaggcagatcgcttgaggtcaggagttcgagaccagcctggccaacatggtgaaaccccgtctatactaaaaaattcaaaaattacccggacgtggtggcgcatgcctgtaatcccagctacttgggagcctgaggcgggagaattgcttgaacccgggaggcagaggttgcagtgagccgagatcgcatcactgcagtccagcctggatgacagagtgagactccatctcaaaaaataaataaataaataaaaatgaaattaaaaaataa

SEQ ID NO: 4195 - DNA, 1344 bp, Homo sapiens
agatgtcaatgagtgcctgcagctgcccaaggcctgcgcctaccagtgccacaacctccagggcagctaccgctgcctgtgccccccaggccagaccctccttcgcgacggcaaggcctgcacctcactggagcggaatggacaaaatgtgaccaccgtcagccaccgaggccctctattgccctggctgcggccctgggcctcgatccccggtacctcctaccacgcctgggtctctctccgtccgggtcccatggccctgagcagtgtgggccgggcctggtgccctcctggtttcatcaggcagaacggagtctgcacagaccttgacgagtgccgcgtgaggaacctgtgtcagcacgcctgccgcaacactgagggcagctaccagtgcctgtgccccgccggctaccgtctgctccccagcgggaagaactgccaggacatcaacgagtgcgaggaggagagcatcgagtgtggacccggccagatgtgcttcaacacccgtggcagctaccagtgtgtggacacaccctgtcctgccacctaccggcagggccccagccctgggacgtgcttccggcgctgctcgcaggactgcggcacgggcggcccctctacgctgcagtaccggctgctgccgctgcccctgggcgtgcgcgcccaccacgacgtggcccgcctcaccgccttctccgaggtcggcgtccccgccaaccgcaccgagctcagcatgctggagcccgacccccgcagccccttcgcgctgcgtccgctgcgcgcgggccttggcgcggtctacacccgtcgcgcgctcacccgcgccggcctctaccggctcaccgtgcgtgctgcggcaccgcgccaccaaagcgtcttcgtcttgctcatcgccgtgtccccctacccctactaaacgggagagggcattggcggccgccctggcgtgacccccgaggaaggggtcgaggagaagcttggtccacgccacctgctgtggcaagcggagcgtcatcgtctcccgccccgtgcgtcagcgagaccttgggtcaacacgaccctgcgcacagccttgacccccgacagcgaggacctgacctcacagagggaggcgtccagggcggcccttgggtggccagtcccgcaggcagggcccggggaagcccggatcagacctccaggtctgatccgcccctcagtgggagcgggacagggacacagggcacctggacgcgcgggagagggggcagaccccgcgttaggggtggcagcagctgtcgcccggccacacctggtggtgtcattctgaaccctgttgcaatataaagggatttttttttaacc

SEQ ID NO: 4196 - DNA, 2220 bp, Homo sapiens
gcccctggtggtctggtggaaggacggacagaagctggacttccgcctgcagcagggcgcctaccggctcctgccctccaacgccctgctcctcacggcccccggcccccaggactcagcccagtttgaatgcgtggtgagcaatgaggtgggcgaggcccacaggctctaccaggtgaccgtccatgtgcctcccaccattgccgatgaccagacagacttcaccgtgaccatgatggcacctgtggtcctcacatgtcacagcacgggtataccagctccgaccgtgtcctggagcaaggcaggcgcccagctaggagctcgggggagtggctatcgtgtctcaccatcgggcgccctggagatcgggcaggccctccccatccacgcaggccgctacacctgctcagcccgcaactctgccggcgtagcccacaagcacgtcttcctcactgtgcaagcctccccggtggtgaagccgctgcccagcgtggttcgggcagtggcagaggaggaggtgctgctgccctgcgaggcctcaggcatcccccggccgaccatcacctggcagaaggaagggctcaacgtcgctactggagtgagtacccaggtcctaccaggcggacagctgcggattgcccatgccagcccagaggatgctggaaactatctctgcatcgctaagaacagtgcgggcagtgccatggggaagacgcggctggtggtgcaagtcccaccagtgatcgagaatggcctcccagacctgtccaccaccgaaggctcccacgccttcttgccttgcaaggcgaggggcagtcctgagcccaacatcacctgggacaaagatggccagcctgtgtcgggcgccgaggggaagttcaccatccagccttctggggagttgctggtgaagaacttggagggccaggacgcaggcacctatacctgtaccgctgagaacgccgtgggccgggcccgccgccgcgtgcacctcaccatcctggtactgcctgtgttcaccaccctgcctggggaccgcagcctgcgccttggggacaggctgtggcttcgctgtgcagcccggggcagccccacccctcgcattggctggactgtcaacgaccggccagtcacaggtctgggtctgctgggcatgggtgggacagagagccaggacaccgggaggttaagaagggagggcaggtggggagacccaacctagtggaaaggaagaggttgtcagccagccctgttggttctgggtcttccaacgtggccctatgtagggggacagggcaaacccagctgtggccatatgtgacaagccatatatcagagctggcaagaggccacctgagaagactcaacccagagacctcagggccaggaaggggaggcctgtgttctagtccagagctgctgctcccattgtgggaccctcagcaaaccccttttgctgggggcccgtggggactctgtcctcctaccggaaacccaggtgatgtctagggagacacagggcctgtggagtacctgctgggtactcaatgtttgctgaattgataaattgctaagtcccctccactgcaaaatgatactttcctacattaggatatgacatcacacattcctaactctgagtccccaggtgtggaatacccgtgctcacctgtggtgaaggctttgctcggctccaccacttcctggggagggaccttgggcaggtataatagttcagcctgtctgagcgccgctctccatctgtcaaatggacataaccaggggtcctgaggacagaatgacaatggaggggccgtgctcggcacaggcctggcccggagtagatgcccaattgatggtactgcttgtctgtattcctctcctagaggtgatggcccaccccaaaggaaaagttcattattagaatccttctctcggctgggcgcggtggctcacgcctgtaatcccagcactttgggaggccaaggcaggtggatcacctgaggtcaggagttcgagaccagcctggccaacatggtgaaaccccatctctactaaaaatacacaattagctgagcgtggtggcacatgcctgtaatcccagctacatgggaggctaaggtaggagaatcggttgaacctgggaggtggaggttgcaatgagctgagattgcgtcattgcactccagcctgggcaacaagagtgaaactgtctcaaag

SEQ ID NO: 4197 - DNA, 2860 bp, Homo sapiens
attattctcgcttgctggggtcatggtgttttggcctctcctggcctggactctcaaaaactcatcatccttcataggtctgaaggcttctacattcccaccagcaggtggaccatatgaactcaaaactagttgtggcagagggaccctgaagagatctacccctggtgaatgcccccaggagtgggctgttctcacacctggtgcccagcctgtgccctcgcaggtcttggtgcctccactcagctcaattccagttttctggccatgccccgctgtgtccctttctctctccttagtgcctagctgtgcaatgtttgcctctccttaacatgtcctcagctgaccccatatcctcagtccttgcaaccctgttcctcagtgacacctgtgtattctctccagtggagacacaggtgggacacccccaagctcatggtacatgcctgtcatcagtacccctggactgtcatggtgggtcagtctgccctaggctggactgaccaacctgttcattcccccacaggattgccctttacagttcatgagttcccccaactggagtgcagacaagagcactgattgatggaccaggtagacttgaaaccaggaatagcacaaaagttatcaaagaggctcagccatggagattgcaagctggggatggaagtatccctggaattgagctgttctcacacctggtacctgagttatacccctggtgtctgggtaccaaggtcactagccttgccacttttctatgttcctgatcccctactaaacagtccaccttttcgcctacttcccctgactcctgtaccctgtcccctctttctgcctagtttgaagacactggtcatcccataacatgtcctgggctaatacatatcctcaaatcgttcttgaaaatctgttcctcttccctcctccccctccccctccccccccccccgctctttccacggtctccctctgatgccgagccgaagctggacggtactgctgccatctcggctcactgcaacctccctgcctgattctcttgcctcagcctgccgagtgcctgcgattgcaggcgcgtgccgccacgcctgactggttttcgtattttttttggtggagacggggtttcgctgtgttggccgggctggtctccagctcctaaccacgagtgatccgccagcctcggcctcccgaggtgccgggattgcagacggagtctcgttcattcagtgctcaatggtgtccaggctggagtgcagtggcgtgatctcggctcgctacaacctccacctcccagcaacccgccttggcctcccaaagtgccgagattgcagcctctgcccggcggccaccccgtctgggaagtgaggagcgtctccgcctggccgcccatcatctgggatgtgaggagcccctctgcctggctgcccagtctggaaagtgaggagcgtctctgcccggccgccatcccatctaggaagtgaggagcgcctcttcccggccgccatcacatctgggaagtgaggagcgtctctgcccggccgcccatcgtctgagatgtggggagcatctctgccctgccgccccgtccgggatgtgaggagcgtctctgcccggccgccccgtctgagaagtgaggagaccctctgcctggcaactgccccgtctgagaagtgaggagcccctccgcccggcagccgccccgtctgagaagtgaggagcccctccgcccagcagccaccccgtctgggaagtgaggagcatctccgcccggcagccgccccgtctgagaagtgaggagcctctccgcccagcagccacctcgtccgggagggaggtgggggggtcagccccccgcccggccagccgccccgtccgggagggaggtggggggatcagtcccccacccggccagccgccctgtccgggagatgaggggcgcctctgcccggccgcccctactgggaagtgaggagcccttctgcccggccagccgctccgtccgggagggaggtgggggggtcagccccccgcccggccagccgccctgtccggaagggaggtgggggggtcagccccccgcgcggccagccgacccgtccgggagggaggtgggggggtcagccccctgcccggccagccgccccgtccgggaggtgcggggcgcctctgcccggccgcccctactgggaagtgaggagcccctctgcccggccagccgccccatctgggagggaggtgggggggtcagccccccgccctgccagccgccctgtccgggagggaggggcgcctctgcccggccgcccctactgggaaatgaggagcccctctgcccggccaccaccccatctgggaggtgtacccaacagctcgttgagaacgggccatgatgacaatggcggttttgtggaatagaaaggggggaaagatggggaaaagattgagaaatcggatggttgccgtgtctgtgtagaaagaggtagacgtgggagacttttcattttgttctgtactaagaaaaattcttctgccttgggatcctgttgatctgtgaccttacccccaaccctgtgctctctgaaacatgtgctgtatccactcagggttgaatggattaagggcggtgcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctcccctattgtcctgtgaccctgccaaatccccctctacgagaaacacccaagaatgatc

SEQ ID NO: 4198 - DNA, 1073 bp, Homo sapiens
ttaggtggcgccggtcccctcgaacaggtcgctcaacaactcccgcccagcagccgcccttactgcgcgcgcgcagacttcggcgtctacttccggtgtggcccaggcggggtccgcagaaccagctatgtcggcctacggcatgcccatgtacaagagcggggacctggtgtttgccaagttaaagggctatgcccactggccggcgaggatagagcacatgacccagcccaaccgctaccaggtgtttttcttcgggacccacgagacggccttcctgagtcccaaacgcctgttcccgtacaaggagtgcaaggagaagttcggcaagcccaacaagaggcgcggcttcagcgcggggctgtgggaaatcgagaacaaccccacggtccaggcctccgactgcccattagcctcagagaagggcagcggagacgggccttggccggagcccgaggccgcagagggcgacgaggacaagccgacccacgctggtggcggcggcgacgaattggggaagccggacgacgacaagcccactgaggaggagaaggggccgctgaagaggagcgcgggggacccgccggaggacgcccccaaacgacccaaggaggcagcccccgaccaagaggaggaggcggaggcggagagggcggcggaagcggagagggcggcggcggcggcggcggcgacggccgtcgacgaggagagtccgttcctcgtggcggtggagaacggcagcgcccctagcgagccgggcctggtctgcgagccgcctcagccagaggaggaggagctccgggaggaagaagtcgcggacgaggaggcctcccaggagtggcatgccgaggcaccgggcggcggagatcgcgacagcctgtagttaccagcgtttccagaagagcccctgccccgttcctgctgcggcctggccgttcttggggaatctgaccacggcgtgcaaactgggactgcctttccctctcctcagcccgtcctcctccaacccgcgctcctttgccctgccgggccccaggatggcaggccacctgactctcacctctgtgccccca

SEQ ID NO: 4199 - DNA, 2034 bp, Homo sapiens
agaaccagctatgtcggcctacggcatgcccatgtacaagagcggggacctggtgtttgccaagttaaagggctatgcccactggccggcgaggatagagcacatgacccagcccaaccgctaccaggtgtttttcttcgggacccacgagacggccttcctgagtcccaaacgcctgttcccgtacaaggagtgcaaggagaagttcggcaagcccaacaagaggcgcggcttcagcgcggggctgtgggaaatcgagaacaaccccacggtccaggcctccgactgcccattagcctcagagaagggcagcggagacgggccttggccggagcccgaggccgcagagggcgacgaggacaagccgacccacgctggtggcggcggcgacgaattggggaagccggacgacgacaagcccactgaggaggagaaggggccgctgaagaggagcgcgggggacccgccggaggacgcccccaaacgacccaaggaggcagcccccgaccaagaggaggaggcggaggcggagagggcggcggaagcggagagggcggcggcggcggcggcggcgacggccgtcgacgaggagagtccgttcctcgtggcggtggagaacggcagcgcccctagcgagccgggcctggtctgcgagccgcctcagccagaggaggaggagctccgggaggaagaagtcgcggacgaggaggcctcccaggagtggcatgccgaggcaccgggcggcggagatcgcgacagcctgtagttaccagcgtttccagaagagcccctgccccgttcctgctgcggcctggccgttcttggggaatctgaccacggcgtgcaaactgggactgcctttccctctcctcagcccgtcctcctccaacccgcgctcctttgccctgccgggccccaggatggcaggccacctgactctcacctctgtgcccccaccttccggctccctcttctcccccctctacccgccaccccaccccaccccacccccgcccactcgttgcctgattccgtttccgacttggggttcaggcaggctgttttcacctctagacacccctctccacccctcctgcttccccaggcattatgaacctctgcttaggaatatgggtaggagtgaaaggcctggcagataaagagcagagggcacttgcagggcctgggatgagcagtcttcaagctgtggtagttagcgggcaggagagcgacatcttcctgagctcctgtccatgcctgccatacctgccagcttcagacatttagggaaaaggggcagcatgtggggaatgccccccgccttccacaaatccttttgctgacccaggaagttctgggagttgccgtttttcatcaaaacgtttgggggcttccaagttgtttgtgagatctgaaaacttaactttgcccaatatcctggttggggaccgtgagaaatatctgtcccatttagatctctggggccactgatgggatgccctgggaagatccttggctgccgctttctctccccacagcctcaaggccaccctaccgtcatatatatcactcaggcgtagaagaaaagacacatattttataaaatctttttaataaaaggaagttccaagaagaatttttaagaactacctctaggtgtgcctccacgctggccctagctttcccattgctgttccattgctgagacaaactggaaggctccctttctgtttgaagttttatgacttgtagtcaggctttgctgttcgtcacagtgtcattttccattcaggtaccatcacctggtcccatcaacaggtctagtatgtagctcactgataacagaggaagatgtgtctcctcccaccctcttcctaatggtcattatgcctttctccatctattgtctctttcaccccttcccctctcccttgggctctgatgaaaaattgttgactgcagtttcggaagtttgatctgagaaccaaccatagaatgtttcagttctaggaaataaaaccagttgattaaagc

SEQ ID NO: 4200 - DNA, 898 bp, Homo sapiens
gaatcactaggcgccggcgcctccgaggcagtgtgtttccgcccagagctggagtctcccagctgccagccgaccccgaacccgcactcccgccaaccgcgctttttgtgggcggtcggaaaccacagcctccgttggatatgttcggtgcatgttataaacaaccacttaaaccctccggatctgagcctcccgcagaggaatgcagaatgacgccacggcacgcaggatgtgatgtcaccgagatgcagaggatactcagtcaaccaacatttactgagcatctacttcgtgccgtatgtacgaagctagcaaatatgtacagcaccagtactgattgcagggagcactgtagaagaggaatgaaggccaaacaattaaaagcggaggcggggaggtcttgtcaacggaaaggggtccctatccagaccccaagagagcattcttggatctcttgcaagaaagaatttgaggcgaatccatagagtaagcttagtgatgtgtgtcagacctctgagcccaagcaaagccatcatatcccctgtgacctgcatgtatacatccagatggcctgaagcaagtgaagaatcacaaaagaagtgaaaagggccggttcctgccttaactgatgacattccaccattgtgatttgttcctgccccaccttaactgagcgattaacctgtgaacttccttctcctggctcagaagcttccccactgagcaccttgtgacccccgcccctgcctgccatagaacaaccccctttgattgtaattttcctttacctacccaaatcctataaaacggccccacccctatctcccttcgctgacactctctttggactcagcctgcctgcacctaggtgattaaaaagctttattgctcacgcaaa

SEQ ID NO: 4201 - DNA, 692 bp, Homo sapiens
attcccagaatcactaggcgccggcgcctccgaggcagtgtgtttccgcccagagctggagtctcccagctgccagccgaccccgaacccgcactcccgccaaccgcgctttttgtgggcggtcggaaaccacagcctccgttggatatgttcggtgcatgttataaacaaccacttaaaccctccggatctgagcctcccgcagaggaatgcagaatgacgccacggcacgcaggatgtgatgtcaccgagatgcagaggatactcagtcaaccaacatttactgagcatctacttcgtgccgtcttgtcaacggaaaggggtccctatccagaccccaagagagcattcttggatctcttgcaagaaagaatttgaggcgaatccatagagtaagcttagtgatgtgtgtcagacctctgagcccaagcaaagccatcatatcccctgtgacctgcatgtatacatccagatggcctgaagcaagtgaagaatcacaaaagaagtgaaaagggccggttcctgccttaactgatgacattccaccattgtgatttgttcctgccccaccttaactgagcgattaacctgtgaacttccttctcctggctcagaagcttccccactgagcaccttgtgacccccgcccctgcctgccatagaacaaccccctttgattgtaattttccttt

SEQ ID NO: 4202 - DNA, 775 bp, Homo sapiens
gaggcagtgtgtttccgcccagagctggagtctcccagctgccagccgaccccgaacccgcactcccgccaaccgcgctttttgtgggcggtcggaaaccacagcctccgttggatatgttcggtgcatgttataaacaaccacttaaaccctccggatctgagcctcccgcagaggaatgcagaatgacgccacggcacgcaggatgtgatgtcaccgagatgcagaggatactcagtcaaccaacatttactgagcatctacttcgtgccgtatgtcttgtcaacggaaaggggtccctatccagaccccaagagagcattcttggatctcttgcaagaaagaatttgaggcgaatccatagagtaagcttagtgatgtgtgtcagacctctgagcccaagcaaagccatcatatcccctgtgacctgcatgtatacatccagatggcctgaagcaagtgaagaatcacaaaagaagtgaaaagggccggttcctgccttaactgatgacattccaccattgtgatttgttcctgccccaccttaactgagcgattaacctgtgaacttccttctcctggctcagaagcttccccactgagcaccttgtgacccccgcccctgcctgccatagaacaaccccctttgattgtaattttcctttacctacccaaatcctataaaacggccccacccctatctcccttcgctgacactctctttggactcagcctgcctgcacctaggtgattaaaaagctttattgctcacgca

SEQ ID NO: 4203 - DNA, 757 bp, Homo sapiens
atgttcggtgcatgttataaacaaccacttaaaccctccggatctgagcctcccgcagaggaatgcagaatgacgccacggcacgcaggatgtgatgtcaccgagatgcagaggatactcagtcaaccaacatttactgagcatctacttcgtgccgtatgtacgaagctagcaaatatgtacagcaccagtactgattgcagggagcactgtagaagaggaatgaaggccaaacaattaaaagcggaggcggggaggggtcttgtcaacggaaaggggtccctatccagaccccaagagagcattcttggatctcttgcaagaaagaatttgaggcgaatccatagagtaagcttagtgatgtgtgtcagacctctgagcccaagcaaagccatcatatcccctgtgacctgcatgtatacatccagatggcctgaagcaagtgaagaatcacaaaagaagtgaaaagggccggttcctgccttaactgatgacattccaccattgtgatttgttcctgccccaccttaactgagcgattaacctgtgaacttccttctcctggctcagaagcttccccactgagcaccttgtgacccccgcccctgcctgccatagaacaaccccctttgattgtaattttcctttacctacccaaatcctataaaacggccccacccctatctcccttcgctgacactctctttggactcagcctgcctgcacctaggtgattaaaaagctttattgctcacgc

SEQ ID NO: 4204 - DNA, 541 bp, Homo sapiens
gtgtttccgcccagagctggagtctcccagctgccagccgaccccgaacccgcactcccgccaaccgcgctttttgtgggcggtcggaaaccacagcctccgttggatatgttcggtgcatgttataaacaaccacttaaaccctccggatctgagcctcccgcagaggaatgcagaatgacgccacggcacgcaggatgtgatgtcaccgagatgcagaggatactcagtcaaccaacatttactgagcatctacttcgtgccgtatgtacgaagctagcaaatatgtacagcaccagtactgattgcagggagcactgtagaagaggaatgaaggccaaacaattaaaagcggaggcggggaggtcttgtcaacggaaaggggtccctatccagaccccaagagagcattcttggatctcttgcaagaaagaatttgaggcgaatccatagagtaagatggagttttgctcttgttgcccaggttggagtgcagtggtgtgatcttgactcactgaaacctccgcctcctgagttcaag

SEQ ID NO: 4205 - DNA, 2223 bp, Homo sapiens
ggaaaattacccggtatcgttagagctacaccaaaattgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcaagatccaaaatggcacatcaggtattcgtttcatctacaccagagaaggcagaccaagtggtgaagcatttgttgaacttgaatctgaagaggaagtgaaattggctttgaagaaggacagagaaaccatgggacacagatacgttgaagtattcaagtctaacagtgttgaaatggattgggtgttgaagcatacaggtccgaatagccctgatactgccaacgatggcttcgtccggcttagaggactcccatttggctgtagcaaggaagagattgttcagttcttttcagggttggaaattgtgccaaatgggatgacactgccagtggactttcaggggcgaagcacaggggaagcctttgtgcagtttgcttcacaggagatagctgagaaggccttaaagaaacacaaggaaagaatagggcacaggtacattgagatcttcaagagtagccgagctgaagttcgaacccactatgatccccctcgaaagctcatggctatgcagcggccaggtccctatgataggccgggggctggcagagggtataatagcattggcagaggagctgggtttgaaaggatgaggcgtggtgcctatggtggagggtatggaggctatgatgactatggtggctataatgatggatatggctttgggtctgatagatttggaagagacctcaattactgtttttcaggaatgtctgatcatagatacggagatggtgggtccagtttccagagcaccacagggcactgtgtacacatgagggggttaccttacagagccactgagaatgatatttataatttcttctcacctcttaatcccatgagagtacatattgaaattggacccgatggcagagttaccggtgaggcagatgttgaatttgctactcatgaagatgctgtggcagctatggcaaaagacaaagctaatatgcaacacagatatgtggagctcttcttaaattctactgcaggaacaagtgggggtgcttacgatcacagctatgtagaactttttttgaattctacagcaggggcaagtggtggcgcttatggtagccaaatgatgggagggatgggcttatccaaccagtctagttatggaggtcctgctagccagcagctgagtggtggttatggaggtggttatggtggtcagagcagtatgagtggatatgaccaagttctgcaggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataattgattctgatcactcttggtcagcttctctttctttatctttctttctccttttttaagaaaacgagttaagtttaacagttttgcattacaggcttgtgattcatgcttactgtaaagtggaagttgagattattttaaaacttcaagctcagtaattttgaacactgaaacattcatctaggacataataacaaagttcagtattgaccataactgttaaaacaatttttagctttcctcaagttagttatgttgtaggagtgtacctaagcagtaagcgtatttaggttaatgcagtttcacttatgttaaatgttgctcttataccacaaatacattgaaaacttcggatgcatgttgagaaacatgcctttctgtaaaactcaaatataggagctgtgtctacgattcaaagtgaaaacatttggcatgtttgttaattctagctttttggtttaatatcctgtaaggcacgtgagtgtacactttttttttttttaaggatacgggacaattttaagatgtaataccaatactttagaagtttggtcgtgtcgtttgtatgaaaatctgaggctttggtttaaatctttccttgtattgtgatttccatttagatgtattgtactaagtgaaacttgttaaataaatcttccttttaaaaactggaaaaaa

SEQ ID NO: 4206 - DNA, 4839 bp, Homo sapiens
agccaggcttggcggtcctcagaggggctgataaatcggcgctcgactggcctaggagctgtccgcagggagatttatgacaaagtccagttttcaacaatgctgaaatcaaatgattgcctgttttctttggaaaatttgttttttgaaaaaccagatgaagttgaaaaccatccagacaatgaaaagtcattggattggtttctccctcctgctccattgatttcagaaattccagatactcaggagttagaggaagaattagaaagtcataaactgttaggtcaggaaaagaggccaaaaatgttaacatcaaatttaaagataactaatgaagatacaaattatatttcactaacacaaaaattccagtttgcctttccttctgataaatatgaacaggatgatctaaatttagaaggggtaggtaataatgacttatcacatattgctggcaagctgacatatgcttctcagaaatataaaaatcacattggcactgagatagcacctgagaagagtgttcctgatgatacaaaattagttaattttgcagaagataaaggagagagcacatcagtattccggaaaagattatttaaaatatctgacaatatacatgggagtgcttattctaatgacaatgaattggactctcacattggctcagtgaaaattgtacaaacagaaatgaacaaagggaaatcaaggaactatagcaatagtaagcaaaaatttcagtattctgcaaatgtgtttacagcaaataatgctttttctgcttctgaaatcggagaaggcatgttcaaagcaccatctttttcagttgctttccaacctcatgatattcaagaggtaacagaaaatggtttaggttccttgaaggctgtcacagaaattccggcaaaatttagaagtattttcaaagaatttccatatttcaactatatacagtccaaggcctttgatgatcttctttacacagataggaattttgtgatttgtgctccaactggttctggaaaaactgtagtgtttgaactagctataacaagattgttaatggaagtaccattgccatggttgaatattaaaattgtttacatggcaccaataaaagccttgtgcagtcagcgttttgatgactggaaagaaaaatttggaccaataggattgaattgtaaagaacttactggagatacagtaatggatgatctatttgagattcagcatgcccatattattatgacaactccagaaaaatgggatagcatgactaggaaatggagagacaactctttggttcagctggttcgactgtttctcattgatgaggtacatattgtaaaagatgaaaatcgtggtccaactcttgaagttgtagttagcagaatgaaaactgtacagtctgtttctcagactttaaaaaataccagcactgctattccaatgcgatttgtagctgtatctgcaacaattccaaatgctgaggatattgcagaatggctttcagatggtgaaagaccagctgtgtgtctgaaaatggatgagagccatagaccagtgaaacttcagaaagtggtccttggatttccctgcagtagtaaccaaactgagtttaagtttgatttaaccctcaactacaaaattgccagtgttatacaaatgtactctgatcagaaacccacacttgtgttttgtgcaacaaggaagggtgtgcaacaggctgcttctgttcttgtgaaagatgctaaatttattatgactgtggaacagaaacagaggttacagaagtatgcatattccgtaagagattcaaaactgagagatatcttaaaagatggtgctgcttatcatcatgctggtatggagctgtcagatagaaaagtagttgagggagcttttactgttggagatttaccagttctttttactaccagtactttagctatgggagtaaatttgcctgctcacctagtagttataaaatctacaatgcattatgctggaggactgtttgaagagtacagtgaaacagatattctacagatgattggtagagctggtcgacctcaatttgacactacagctactgcagttatcatgactcgattaagcacaagggacaagtacattcagatgttagcttgtagagacactgtagaaagcagtttgcacagacatcttattgaacatttaaatgcagagatagtactgcataccatcacggatgtgaatattgctgtggaatggatacgatcaactctgctttatatcagagccttgaaaaatccatctcattatggttttgcatctggattgaacaaagatggaattgaagcaaaattacaagaattatgtttgaagaatctgaatgatttatcatccctggacttaataaagatggatgaaggtgttaatttcaaaccaactgaagcaggaagattgatggcttggtattatattacatttgagacagtgaagaaattttatacaatcagtggaaaagaaaccttatcagatctggttacattgatagctggctgcaaggaatttctagatatacagttaaggataaatgaaaagaaaacactgaatactttgaacaaagatccaaatcggataactatcagatttccaatggaaggaagaattaaaacaagagaaatgaaagtaaattgtcttattcaggctcaactaggatgcattcccatacaagattttgctttgacacaagataccgcaaagattttcagacatggctcccgaattacaagatggttgtcagattttgtagctgctcaagaaaagaagtttgctgtactattgaatagtttgattttagctaaatgttttaggtgtaaactttgggaaaactctctgcatgtatccaaacaactggaaaaaattggtataacattgtcaaatgcaatcgtaaatgctggtttgacttcctttaaaaaaatagaagagacagatgcaagggaacttgaattgattttaaacagacatcccccctttggaacccagataaaagaaactgtgatgtatctaccaaaatatgaacttaaagtggaacagattacaagatatagtgatacgacggcagaaatattagtgactgttatattaagaaattttgaacagctacaaactaaaagaacagcatcggattctcactatgttaccttaatcataggtgacgcagataatcaagtagtttatctgcacaagattacggattctgttttgctaaaagctggaagttgggctaaaaagattgctgtgaaaagagctcttaaatctgaagatcttagcataaatctaataagttctgaatttgttgggcttgatattcagcagaaacttacagtcttttacttagaacccaagaggtttggaaatcaaatcactatgcaaagaaaatctgaaacacagatttcccattctaaacattcagacatatctacaatagcaggacctaataaaggaacgactgccagcaaaaaacctgggaaccgagaatgcaatcatctttgtaaaagtaaacatacatgtggacatgactgctgtaaaattggagttgcacagaagtcagaaattaaagagtcaacaatttcttcatatttatctgatttaagaaacaggaatgctgtttcatctgttcctccagttaaacgtctgaagatacagatgaataaatctcaaagtgtggaccttaaagagtttggttttactccaaaaccttcccttcctagtatatcaaggtcagaatatttaaacatatctgaattgcctataatggagcagtgggatcagcctgaaatctatggaaaagttagacaagaaccatctgaatatcaagacaaagaagttttgaatgtgaactttgaattgggaaatgaagtttgggatgattttgatgatgaaaacttagaagttactagcttttcaactgatactgagaagacaaaaatatcagttttgtttcatcacatgagatgtcggatatttctttatcaaattctgctatgcccaagttcagtgcatcctccatgacaaaattacctcaacaagccggaaatgcagttattgtccattttcaagaaagaaaaccacaaaatctgtcaccagagattgagaagcaatgctttactttctctgaaaaaaacccaaattcttcaaattataaaaaagtggatttttttattagaaacagtgaatgtaaaaaggaagttgatttcagtatgtatcatcctgatgatgaagctgatgaaatgaagtctttattgggaatatttgatggtattttctaaaacaaacaaatactttttatattgataagagaaagaataaagacacctaatcacaaagcatgctttttatttttaaaaagtagttcataattgttcggatttttttctcctgtatttgattagctttgttcactttttgcaacaaaatgtatgggccgatttattttcccattatattgtaacttcttgaaaagctcttttacagtggctttgtttcaataagcccttaagttaagggctgattgcacttagaaataagttgcacttagaaataattatttggctattaattggattttgacaagaaccaatgtaaaatttcatttttatattttcttaacaagaagaaaaatattctatgaaagcaaagtaatgctaacttaatgaatctgcttattgtatggattaatcactaatattattcccatgtattttgttttactaaagatttttaagaatccagtggctatttgaacctactgttatctaactttgagcaacaataaatgaaacattaatcagt

SEQ ID NO: 4207 - DNA, 2986 bp, Homo sapiens
ggcctaggagctgtccgcagggagatttatgacaaagtccagttttcaacaatgctgaaatcaaatgattgcctgttttctttggaaaatttgttttttgaaaaaccagatgaagttgaaaatggcaccaataaaagccttgtgcagtcagcgttttgatgactggaaagaaaaatttggaccaataggattgaattgtaaagaacttactggagatacagtaatggatgatctatttgagattcagcatgcccatattattatgacaactccagaaaaatgggatagcatgactaggaaatggagagacaactctttggttcagctggttcgactgtttctcattgatgaggtacatattgtaaaagatgaaaatcgtggtccaactcttgaagttgtagttagcagaatgaaaactgtacagtctgtttctcagactttaaaaaataccagcactgctattccaatgcgatttgtagctgtatctgcaacaattccaaatgctgaggatattgcagaatggctttcagatggtgaaagaccagctgtgtgtctgaaaatggatgagagccatagaccagtgaaacttcagaaagtggtccttggatttccctgcagtagtaaccaaactgagtttaagtttgatttaaccctcaactacaaaattgccagtgttatacaaatgtactctgatcagaaacccacacttgtgttttgtgcaacaaggaagggtgtgcaacaggctgcttctgttcttgtgaaagatgctaaatttattatgactgtggaacagaaacagaggttacagaagtatgcatattccgtaagagattcaaaactgagagatatcttaaaagatggtgctgcttatcatcatgctggtatggagctgtcagatagaaaagtagttgagggagcttttactgttggagatttaccagttctttttactaccagtactttagctatgggagtaaatttgcctgctcacctagtagttataaaatctacaatgcattatgctggaggactgtttgaagagtacagtgaaacagatattctacagatgattggtagagctggtcgacctcaatttgacactacagctactgcagttatcatgactcgattaagcacaagggacaagtacattcagatgttagcttgtagagacactgtagaaagcagtttgcacagacatcttattgaacatttaaatgcagagatagtactgcataccatcacggatgtgaatattgctgtggaatggatacgatcaactctgctttatatcagagccttgaaaaatccatctcattatggttttgcatctggattgaacaaagatggaattgaagcaaaattacaagaattatgtttgaagaatctgaatgatttatcatccctggacttaataaagatggatgaaggtgttaatttcaaaccaactgaagcaggaagattgatggcttggtattatattacatttgagacagtgaagaaattttatacaatcagtggaaaagaaaccttatcagatctggttacattgatagctggctgcaaggaatttctagatatacagttaaggataaatgaaaagaaaacactgaatactttgaacaaagatccaaatcggataactatcagatttccaatggaaggaagaattaaaacaagagaaatgaaagtaaattgtcttattcaggctcaactaggatgcattcccatacaagattttgctttgacacaagataccgcaaagattttcagacatggctcccgaattacaagatggttgtcagattttgtagctgctcaagaaaagaagtttgctgtactattgaatagtttgattttagctaaatgttttaggtgtaaactttgggaaaactctctgcatgtatccaaacaactggaaaaaattggtataacattgtcaaatgcaatcgtaaatgctggtttgacttcctttaaaaaaatagaagagacagatgcaagggaacttgaattgattttaaacagacatcccccctttggaacccagataaaagaaactgtgatgtatctaccaaaatatgaacttaaagtggaacagattacaagatatagtgatacgacggcagaaatattagtgactgttatattaagaaattttgaacagctacaaactaaaagaacagcatcggattctcactatgttaccttaatcataggtgacgcagataatcaagtagtttatctgcacaagattacggattctgttttgctaaaagctggaagttgggctaaaaagattgctgtgaaaagagctcttaaatctgaagatcttagcataaatctaataagttctgaatttgttgggcttgatattcagcagaaacttacagtcttttacttagaacccaagaggtttggaaatcaaatcactatgcaaagaaaatctgaaacacagatttcccattctaaacattcagacatatctacaatagcaggacctaataaaggaacgactgccagcaaaacctgggaaccgagaatgcaatcatctttgtaaaagtaaacatacatgtggacatgactgctgtaaaattggagttgcacagaagtcagaaattaaagagtcaacaatttcttcatatttatctgatttaagaaacaggaatgctgtttcatctgttcctccagttaaacgtctgaagatacagatgaataaatctcaaagtgtggaccttaaagagtttggttttactccaaaaccttcccttcctagtatatcaaggtcagaatatttaaacatatctgaattgcctataatggagcagtgggatcagcctgaaatctatggaaaagttagacaagaaccatctgaatatcaagacaaagaagttttgaatgtgaactttgaattgggaaatgaagtttgggatgattttgatgatgaaaacttagaagttactagcttttcaactgatactgagaagac

SEQ ID NO: 4208 - DNA, 3675 bp, Homo sapiens
ggcctaggagctgtccgcagggagatttatgacaaagtccagttttcaacaatgctgaaatcaaatgattgcctgttttctttggaaaatttgttttttgaaaaaccagatgaagttgaaaatccaaggcctttgatgatcttctttacacagataggaattttgtgatttgtgctccaactggttctggaaaaactgtagtgtttgaactagctataacaagattgttaatggaagtaccattgccatggttgaatattaaaattgtttacatggcaccaataaaagccttgtgcagtcagcgttttgatgactggaaagaaaaatttggaccaataggattgaattgtaaagaacttactggagatacagtaatggatgatctatttgagattcagcatgcccatattattatgacaactccagaaaaatgggatagcatgactaggaaatggagagacaactctttggttcagctggttcgactgtttctcattgatgaggtacatattgtaaaagatgaaaatcgtggtccaactcttgaagttgtagttagcagaatgaaaactgtacagtctgtttctcagactttaaaaaataccagcactgctattccaatgcgatttgtagctgtatctgcaacaattccaaatgctgaggatattgcagaatggctttcagatggtgaaagaccagctgtgtgtctgaaaatggatgagagccatagaccagtgaaacttcagaaagtggtccttggatttccctgcagtagtaaccaaactgagtttaagtttgatttaaccctcaactacaaaattgccagtgttatacaaatgtactctgatcagaaacccacacttgtgttttgtgcaacaaggaagggtgtgcaacaggctgcttctgttcttgtgaaagatgctaaatttattatgactgtggaacagaaacagaggttacagaagtatgcatattccgtaagagattcaaaactgagagatatcttaaaagatggtgctgcttatcatcatgctggtatggagctgtcagatagaaaagtagttgagggagcttttactgttggagatttaccagttctttttactaccagtactttagctatgggagtaaatttgcctgctcacctagtagttataaaatctacaatgcattatgctggaggactgtttgaagagtacagtgaaacagatattctacagatgattggtagagctggtcgacctcaatttgacactacagctactgcagttatcatgactcgattaagcacaagggacaagtacattcagatgttagcttgtagagacactgtagaaagcagtttgcacagacatcttattgaacatttaaatgcagagatagtactgcataccatcacggatgtgaatattgctgtggaatggatacgatcaactctgctttatatcagagccttgaaaaatccatctcattatggttttgcatctggattgaacaaagatggaattgaagcaaaattacaagaattatgtttgaagaatctgaatgatttatcatccctggacttaataaagatggatgaaggtgttaatttcaaaccaactgaagcaggaagattgatggcttggtattatattacatttgagacagtgaagaaattttatacaatcagtggaaaagaaaccttatcagatctggttacattgatagctggctgcaaggaatttctagatatacagttaaggataaatgaaaagaaaacactgaatactttgaacaaagatccaaatcggataactatcagatttccaatggaaggaagaattaaaacaagagaaatgaaagtaaattgtcttattcaggctcaactaggatgcattcccatacaagattttgctttgacacaagataccgcaaagattttcagacatggctcccgaattacaagatggttgtcagattttgtagctgctcaagaaaagaagtttgctgtactattgaatagtttgattttagctaaatgttttaggtgtaaactttgggaaaactctctgcatgtatccaaacaactggaaaaaattggtataacattgtcaaatgcaatcgtaaatgctggtttgacttcctttaaaaaaatagaagagacagatgcaagggaacttgaattgattttaaacagacatcccccctttggaacccagataaaagaaactgtgatgtatctaccaaaatatgaacttaaagtggaacagattacaagatatagtgatacgacggcagaaatattagtgactgttatattaagaaattttgaacagctacaaactaaaagaacagcatcggattctcactatgttaccttaatcataggtgacgcagataatcaagtagtttatctgcacaagattacggattctgttttgctaaaagctggaagttgggctaaaaagattgctgtgaaaagagctcttaaatctgaagatcttagcataaatctaataagttctgaatttgttgggcttgatattcagcagaaacttacagtcttttacttagaacccaagaggtttggaaatcaaatcactatgcaaagaaaatctgaaacacagatttcccattctaaacattcagacatatctacaatagcaggacctaataaaggaacgactgccagcaaaaaacctgggaaccgagaatgcaatcatctttgtaaaagtaaacatacatgtggacatgactgctgtaaaattggagttgcacagaagtcagaaattaaagagtcaacaatttcttcatatttatctgatttaagaaacaggaatgctgtttcatctgttcctccagttaaacgtctgaagatacagatgaataaatctcaaagtgtggaccttaaagagtttggttttactccaaaaccttcccttcctagtatatcaaggtcagaatatttaaacatatctgaattgcctataatggagcagtgggatcagcctgaaatctatggaaaagttagacaagaaccatctgaatatcaagacaaagaagttttgaatgtgaactttgaattgggaaatgaagtttgggatgattttgatgatgaaaacttagaagttactagcttttcaactgatactgagaagacaaaaatatcaggatttggaaacactttgagttcaagtaccaggggaagtaagctaccccttcaagagtcaaagagcaaattccaaagagaaatgtcaaacagttttgtttcatcacatgagatgtcggatatttctttatcaaattctgctatgcccaagttcagtgcatcctccatgacaaaattacctcaacaagccggaaatgcagttattgtccattttcaagaaagaaaaccacaaaatctgtcaccagagattgagaagcaatgctttactttctctgaaaaaaacccaaattcttcaaattataaaaaagtggatttttttattagaaacagtgaatgtaaaaaggaagttgatttcagtatgtatcatcctgatgatgaagctgatgaaatgaagtctttattgggaatatttgatggtattttctaaaacaaacaaatactttttatattgataagagaaagaataaagacacctaatcacaaagcatgctttttatttttaaaaagtagttcataattgttcggat

SEQ ID NO: 4209 - DNA, 4931 bp, Homo sapiens
agccaggcttggcggtcctcagaggggctgataaatcggcgctcgactggcctaggagctgtccgcagggagatttatgacaaagtccagttttcaacaatgctgaaatcaaatgattgcctgttttctttggaaaatttgttttttgaaaaaccagatgaagttgaaaaccatccagacaatgaaaagtcattggattggtttctccctcctgctccattgatttcagaaattccagatactcaggagttagaggaagaattagaaagtcataaactgttaggtcaggaaaagaggccaaaaatgttaacatcaaatttaaagataactaatgaagatacaaattatatttcactaacacaaaaattccagtttgcctttccttctgataaatatgaacaggatgatctaaatttagaaggggtaggtaataatgacttatcacatattgctggcaagctgacatatgcttctcagaaatataaaaatcacattggcactgagatagcacctgagaagagtgttcctgatgatacaaaattagttaattttgcagaagataaaggagagagcacatcagtattccggaaaagattatttaaaatatctgacaatatacatgggagtgcttattctaatgacaatgaattggactctcacattggctcagtgaaaattgtacaaacagaaatgaacaaagggaaatcaaggaactatagcaatagtaagcaaaaatttcagtattctgcaaatgtgtttacagcaaataatgctttttctgcttctgaaatcggagaaggcatgttcaaagcaccatctttttcagttgctttccaacctcatgatattcaagaggtaacagaaaatggtttaggttccttgaaggctgtcacagaaattccggcaaaatttagaagtattttcaaagaatttccatatttcaactatatacagtccaaggcctttgatgatcttctttacacagataggaattttgtgatttgtgctccaactggttctggaaaaactgtagtgtttgaactagctataacaagattgttaatggaagtaccattgccatggttgaatattaaaattgtttacatggcaccaataaaagccttgtgcagtcagcgttttgatgactggaaagaaaaatttggaccaataggattgaattgtaaagaacttactggagatacagtaatggatgatctatttgagattcagcatgcccatattattatgacaactccagaaaaatgggatagcatgactaggaaatggagagacaactctttggttcagctggttcgactgtttctcattgatgaggtacatattgtaaaagatgaaaatcgtggtccaactcttgaagttgtagttagcagaatgaaaactgtacagtctgtttctcagactttaaaaaataccagcactgctattccaatgcgatttgtagctgtatctgcaacaattccaaatgctgaggatattgcagaatggctttcagatggtgaaagaccagctgtgtgtctgaaaatggatgagagccatagaccagtgaaacttcagaaagtggtccttggatttccctgcagtagtaaccaaactgagtttaagtttgatttaaccctcaactacaaaattgccagtgttatacaaatgtactctgatcagaaacccacacttgtgttttgtgcaacaaggaagggtgtgcaacaggctgcttctgttcttgtgaaagatgctaaatttattatgactgtggaacagaaacagaggttacagaagtatgcatattccgtaagagattcaaaactgagagatatcttaaaagatggtgctgcttatcatcatgctggtatggagctgtcagatagaaaagtagttgagggagcttttactgttggagatttaccagttctttttactaccagtactttagctatgggagtaaatttgcctgctcacctagtagttataaaatctacaatgcattatgctggaggactgtttgaagagtacagtgaaacagatattctacagatgattggtagagctggtcgacctcaatttgacactacagctactgcagttatcatgactcgattaagcacaagggacaagtacattcagatgttagcttgtagagacactgtagaaagcagtttgcacagacatcttattgaacatttaaatgcagagatagtactgcataccatcacggatgtgaatattgctgtggaatggatacgatcaactctgctttatatcagagccttgaaaaatccatctcattatggttttgcatctggattgaacaaagatggaattgaagcaaaattacaagaattatgtttgaagaatctgaatgatttatcatccctggacttaataaagatggatgaaggtgttaatttcaaaccaactgaagcaggaagattgatggcttggtattatattacatttgagacagtgaagaaattttatacaatcagtggaaaagaaaccttatcagatctggttacattgatagctggctgcaaggaatttctagatatacagttaaggataaatgaaaagaaaacactgaatactttgaacaaagatccaaatcggataactatcagatttccaatggaaggaagaattaaaacaagagaaatgaaagtaaattgtcttattcaggctcaactaggatgcattcccatacaagattttgctttgacacaagataccgcaaagattttcagacatggctcccgaattacaagatggttgtcagattttgtagctgctcaagaaaagaagtttgctgtactattgaatagtttgattttagctaaatgttttaggtgtaaactttgggaaaactctctgcatgtatccaaacaactggaaaaaattggtataacattgtcaaatgcaatcgtaaatgctggtttgacttcctttaaaaaaatagaagagacagatgcaagggaacttgaattgattttaaacagacatcccccctttggaacccagataaaagaaactgtgatgtatctaccaaaatatgaacttaaagtggaacagattacaagatatagtgatacgacggcagaaatattagtgactgttatattaagaaattttgaacagctacaaactaaaagaacagcatcggattctcactatgttaccttaatcataggtgacgcagataatcaagtagtttatctgcacaagattacggattctgttttgctaaaagctggaagttgggctaaaaagattgctgtgaaaagagctcttaaatctgaagatcttagcataaatctaataagttctgaatttgttgggcttgatattcagcagaaacttacagtcttttacttagaacccaagaggtttggaaatcaaatcactatgcaaagaaaatctgaaacacagatttcccattctaaacattcagacatatctacaatagcaggacctaataaaggaacgactgccagcaaaaaacctgggaaccgagaatgcaatcatctttgtaaaagtaaacatacatgtggacatgactgctgtaaaattggagttgcacagaagtcagaaattaaagagtcaacaatttcttcatatttatctgatttaagaaacaggaatgctgtttcatctgttcctccagttaaacgtctgaagatacagatgaataaatctcaaagtgtggaccttaaagagtttggttttactccaaaaccttcccttcctagtatatcaaggtcagaatatttaaacatatctgaattgcctataatggagcagtgggatcagcctgaaatctatggaaaagttagacaagaaccatctgaatatcaagacaaagaagttttgaatgtgaactttgaattgggaaatgaagtttgggatgattttgatgatgaaaacttagaagttactagcttttcaactgatactgagaagacaaaaatatcaggatttggaaacactttgagttcaagtaccaggggaagtaagctaccccttcaagagtcaaagagcaaattccaaagagaaatgtcaaacagttttgtttcatcacatgagatgtcggatatttctttatcaaattctgctatgcccaagttcagtgcatcctccatgacaaaattacctcaacaagccggaaatgcagttattgtccattttcaagaaagaaaaccacaaaatctgtcaccagagattgagaagcaatgctttactttctctgaaaaaaacccaaattcttcaaattataaaaaagtggatttttttattagaaacagtgaatgtaaaaaggaagttgatttcagtatgtatcatcctgatgatgaagctgatgaaatgaagtctttattgggaatatttgatggtattttctaaaacaaacaaatactttttatattgataagagaaagaataaagacacctaatcacaaagcatgctttttatttttaaaaagtagttcataattgttcggatttttttctcctgtatttgattagctttgttcactttttgcaacaaaatgtatgggccgatttattttcccattatattgtaacttcttgaaaagctcttttacagtggctttgtttcaataagcccttaagttaagggctgattgcacttagaaataagttgcacttagaaataattatttggctattaattggattttgacaagaaccaatgtaaaatttcatttttatattttcttaacaagaagaaaaatattctatgaaagcaaagtaatgctaacttaatgaatctgcttattgtatggattaatcactaatattattcccatgtattttgttttactaaagatttttaagaatccagtggctatttgaacctactgttatctaactttgagcaacaataaatgaaacattaatcagta

SEQ ID NO: 4210 - DNA, 596 bp, Homo sapiens
aagtggggacccagccgagccgtccgggcagcggtcgatctctagagccgtctgccgggcaggcagcggacgggcgcggcgagttgttggtcaccaggcgtctccaggccgccggcccgcgccagcgcctcagccgcatttccagtcagaaagcgatttatgacaaagtccagttttcaacaatgctgaaatcaaatgattgcctgttttctttggaaaatttgttttttgaaaaaccagatgaagttgaaaaccatccagacaatgaaaagtcattggattggtttctccctcctgctccattgatttcagaaattccagatactcaggagttagaggaagaattagaaagtcataaactgttaggtcaggaaaagaggccaaaaatgttaacatcaaatttaaagataactaatgaagatacaaattatatttcactaacacaaaaattccagtttgcctttccttctgataaatatgaacaggatgatctaaatttagaaggggtaggtaataatgacttatcacatattgctggcaagctgacatatgcttctcagaaatataaaaatcacattggcactgagatagcacct

SEQ ID NO: 4211 - DNA, 2184 bp, Homo sapiens
agccaggcttggcggtcctcagaggggctgataaatcggcgctcgactggcctaggagctgtccgcagggagatttatgacaaagtccagttttcaacaatgctgaaatcaaatgattgcctgttttctttggaaaatttgttttttgaaaaaccagatgaagttgaaaaccatccagacaatgaaaagtcattggattggtttctccctcctgctccattgatttcagaaattccagatactcaggagttagaggaagaattagaaagtcataaactgttaggtcaggaaaagaggccaaaaatgttaacatcaaatttaaagataactaatgaagatacaaattatatttcactaacacaaaaattccagtttgcctttccttctgataaatatgaacaggatgatctaaatttagaaggggtaggtaataatgacttatcacatattgctggcaagctgacatatgcttctcagaaatataaaaatcacattggcactgagatagcacctgagaagagtgttcctgatgatacaaaattagttaattttgcagaagataaaggagagagcacatcagtattccggaaaagattatttaaaatatctgacaatatacatgggagtgcttattctaatgacaatgaattggactctcacattggctcagtgaaaattgtacaaacagaaatgaacaaagggaaatcaaggaactatagcaatagtaagcaaaaatttcagtattctgcaaatgtgtttacagcaaataatgctttttctgcttctgaaatcggagaaggcatgttcaaagcaccatctttttcagttgctttccaacctcatgatattcaagaggtaacagaaaatggtttaggttccttgaaggctgtcacagaaattccggcaaaatttagaagtattttcaaagaatttccatatttcaactatatacagtccaaggcctttgatgatcttctttacacagataggaattttgtgatttgtgctccaactggttctggaaaaactgtagtgtttgaactagctataacaagattgttaatggaagtaccattgccatggttgaatattaaaattgtttacatggcaccaataaaagccttgtgcagtcagcgttttgatgactggaaagaaaaatttggaccaataggattgaattgtaaagaacttactggagatacagtaatggatgatctatttgagattcagcatgcccatattattatgacaactccagaaaaatgggatagcatgactaggaaatggagagacaactctttggttcagctggttcgactgtttctcattgatgaggtacatattgtaaaagatgaaaatcgtggtccaactcttgaagttgtagttagcagaatgaaaactgtacagtctgtttctcagactttaaaaaataccagcactgctattccaatgcgatttgtagctgtatctgcaacaattccaaatgctgaggatattgcagaatggctttcagatggtgaaagaccagctgtgtgtctgaaaatggatgagagccatagaccagtgaaacttcagaaagtggtccttggatttccctgcagtagtaaccaaactgagtttaagtttgatttaaccctcaactacaaaattgccagtgttatacaaatgtactctgatcagaaacccacacttgtgttttgtgcaacaaggaagggtgtgcaacaggctgcttctgttcttgtgaaagatgctaaatttattatgactgtggaacagaaacagaggttacagaagtatgcatattccgtaagagattcaaaactgagagatatcttaaaagatggtgctgcttatcatcatgctggtatggagctgtcagatagaaaagtagttgagggagcttttactgttggagatttaccagttctttttactaccagtactttagctatgggagtaaatttgcctgctcacctagtagttataaaatctacaatgcattatgctggaggactgtttgaagagtacagtgaaacagatattctacagatgattggtagagctggtcgacctcaatttgacactacagctactgcagttatcatgactcgattaagcacaagggacaagtacattcagatgttagcttgtagagacactgtagaaagcaggctgcatgctcat

SEQ ID NO: 4212 - DNA, 371 bp, Homo sapiens
gatgggagaggaaaaacaaattatttttaatgattcacggcaaccacatttatatcctattgttactagagaaaaaaatgtcttcagataaccagtggtcagcagatgaggatgaaggccaattatcccgactaatcaggaaatctagagactccccctttgtccctataggtatagcaggctttgtgactgtggtgtcctgtggtctttacaagctaaagtacagaagagatcagaaaatgtcaattcatcttattcacatgagagttgctgcccaaggatttgttgttggagctgtgactctaggtgttctctattctatgtataaggattacattagaccacgattcttcagtgagtccaaaaaatga

SEQ ID NO: 4213 - DNA, 3560 bp, Homo sapiens
aggcggctctcgtggaggcagctagcgcgaggctggggagcgctgagccgcgcgtcgtgccctgcgctgcccagactagcgaacaatacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaagaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttaaaactcttctctattataacagtcaatttctgactcacagcagtgaacaaacccccactccattgtatttggagactggcctccctataaatgtggtagcttcttttattactcagtggccagctcacttagggctgagatgaaggagagggctacttgaagctactgtgtgattttgtttgtgtctgagtggcattcagatgaagtctggaggagttaggagaacgacataggcaaggttcagcagccttccaaggtataggaaggtgggtgattaggactgaggctatctaggtttaacttttgtcccacctccaccccctattttgtggggccaaatgcattgctaaacagcaatttcagagtgtatggtgtgtcaaaaattaaggccttattgtttttctctttcacccctaccccccgtgctcctggcacatatcacattatttgtggtgcccaacatttggggtcttgagcctgctgctggtctcctggatgccagtgagggtatgtgggatggggtggtggggtaggggacggtatcctttttttgctcctacttggaaacaccaaacaccccaaggaagatgataggctccatcttgggccacctgagctatagggcaggctaatggaatcaaccatttctgagcactaaatgtatcatgaaaagttgaatggcctgctcataagtttagctcattcactggaaatgtagattgatgttcaatgttaaactggaaggagcttggtttgtgtgtcagtggttatattagtgggtagtgtaacattttatccaggttggggtgaggggagatggccacagtagcaagtggtgacactaaataccattttgaaggctgatgtgtatatacatcattactgtccgtagcaatgaaggatacagtactgtgttgtgggtgagtgttgctattgcccagcattaatatttgggtgtgtatgtttgaggctatgaaacacgcaggagtgtttttgtgctattaattttaagagaaagcagctttttcttaaaattcactgttgagaaacttgcatgtctggaggcggtgtcctctccgccctgtcgggtcctggatgagtacgagttatggtcacggtcacagcctgatctcttatgtgttcatagccattcgctctcccatcagaactgtttgtcctgaatgtgttcctctagttctagaaaatgaccactaatttaaaaaactcggttgtgaggtttgcccagaggcacttgttccagaatttcccctcctgcttcagccatgtccttgtcacttggcattctaagctaaagctttagcttcccaattcgtgatgtgctaggccaagattcgggagctgttgccagcctcgtcaaatatggaagagaaacaacctgcggtcaaaagggagtgatttgttaagtggtgcgcgtctatctcataactagatgtaccaaccagggaagggccaaggatggaaaggggtaacttttgtgcttccaaagtagctaagcagaagtgggggagcagtttagccagatgatctttgattaggcaaacattgagttttaaagaggctgtcaagttgaggccacttggtccattagctggggcagcaagatcactactcaacgttttcacactgtggcaagattgctcttctagtggaataatgccctagtttctctgagatgatgtaagtggcatgatgttacctaaggcttaggcttagcttgatttctgggcccactgtctgtgttcttaagatgccaacctgttgctttttttttttttttcccccatttaaaaggatagtacctactccctctaaccacctcaccccattcttgaatgacattttatccttcggaaagaacaaggctgtgatgtagtgactattgtctgtgtctcctgtgtgtgtctgttcttgtcacaaatgtatttggggacgttggatgcattcattttctgtaataaagtttcttaatcactcttcccaaaaagtaa

SEQ ID NO: 4214 - DNA, 264 bp, Homo sapiens
atgcccaagagaaaggctaaaggggatgctaaaggagacaaagccaagagaagatccacaaggttgtctgctaaacctgctcctccaaagccacagcccaagcctaaaaaggcccctgcaaagaagggagagaagatacccaaagggaaaaagggaaaagctgatgctggcaaggaggggaataaccctgcagaaaatggagatgccaaaacagaccaggcacagaaagctgaaggtgctggagttgccaaagcatcagatgaa

SEQ ID NO: 4215 - DNA, 4856 bp, Homo sapiens
ccccagacttgtaagccgggggctgagcctcagggcaggggtgcagatgggggtgcagccctcccgcttcccggcgactccgggaaggtcagcgcgggcaggcggggcgcgctcctgcggccgggcctcgccggccacccggtccccacctgaaaccccgcctgccactccgctccagaggagccaatagccgtgcaacctgcccgggatggggcggggcttatgcaaatagtgtcgccttcgggaggcacatagtgatacaagagctggaaggcggctccggcgcagaccttggagagcacagctgccggcccgcgagccagcctcggttcccgcggcccgccgaggctcggagccatccagcgacccggcgaccggcctcaggccccgccatggggaagaccaacagcaagctggcccccgaggtgctggaggaccttgttcagaacactgagttcagcgagcaggagctgaagcagtggtacaagggcttcctgaaggactgccccagcggcatcctcaacctggaggagtttcagcagctctacatcaagttcttcccctacggcgacgcctccaagttcgcgcagcacgctttccgcaccttcgacaagaacggcgacggcaccatcgacttccgggagttcatctgcgccctgtcggtcacctcccgcggcagcttcgagcagaagctcaactgggcctttgagatgtacgacctggacggcgacgggcgcatcacgcgcctggagatgctggagatcatcgaggcaatctacaagatggtgggcaccgtgatcatgatgcgcatgaaccaggacgggctcacgccccagcagcgtgtggacaagatcttcaagaagatggaccaggataaggacgaccagattacattggaggagttcaaggaggcagccaagagtgacccatccattgtgttgctgctgcagtgtgacatgcagaagtagaagctggtgaggggcagggtccctggccagaaggggcatggccacctcccaacctgatgacctctctggctggcctcccaggaggagggacactccagcccccctctctggcccacccagtcctctgcccaagcccttcctcccctccatcaagatctttgagggaccacctcaccctgcaaaagagacaggtcctccagtaccctgtcttctagccccacctcccacttggccagaaccaatgtccattgggcataggggagttggcttttgccccaggaggtgaggttaaggagttgggggcctggggttctggttaggaattctcttgatcctgggattatgctttataggatgtggtcccacaggcctgtcacagggccaaattgggtctgtccattcctgaggctccagatcccataaagggggtctcttccccatcccttctactctacctggcccttccagccccagcctttggagcgttcattcagtcctttcttcagctaatgattactgagcacctgtttggtgctaaggatatggtcatttacaagacacatcttgtgccctctggaagctcatagggttgtgaggcaaacttccagccgtcagggtctcagctaagcagaaggtgctggaaggctggttagtctgggaggagctatttcatcttccagctcagctccacacaaagctgcagaaggacgaaatgaaaagcatttggaagtttaggagccacgtgagtgaaagttttaagaaaaatgaaatttatgtcatacttatttttttagtaccctttaaaggagctacagtcattttattatttcaggaggttaaaatatactctatattacttggtttcttataaaatgattaaatgaatagagaaaatattaattttcaaggggaaaaaacctgagaagaaagggagaaaagaccatgaaatttaccagataacactttttaagactaagtcctgagctgccactctcagcagtttttgctgcttcagctcttcctttttattacctttttcaattcaacaagcaactttctgctacatacttactccggttgggtgctgacttcagggacaggaaaaagcaaggtttgcaaagagtgaaactagtgtatattccgtatcttggtagttcgtttctggattgggtttagtttcagaactggacttgttccttcactgccacagaatcagaaagagctagaagaaaaggctcacctggccactgtttaggcacccagacataatttatggacgaaatgcctaaaaatgtgccaggcatgctctgtttgagaggctttttctaaccccaaatcttagatctgccaggtagttcaacatcttccaagtgtgctggttctgctttccaatgcctgcttcccaattttggatccatgagctatacagctgcatgctttgactgccggaaaaattaatcttgcttcttcatcaggtctttctcctgtacttgtgatcagaaattacctttgacgtgcagtgacagttgatttcctcttgaactgccggtgaaaacagtctagtacacaggtgctgtcagcccagggtgggagcaggaaatgattgctgagcccggggcaggggaattgcatctgcaggaaagagatgcagcatgctcctcactcctgagtgcccacctgtcctgcttctctgcaggtgaaaactctgggggatgctgatcaatagagcttggtcccaagctctactgggcccttggaggtagcaaggccactgggttgctatcctcttgctggggatagcaaccactggtttgcaaccactgggttgctatccttttgctatcctcttgctcatgaccagccatatggtgaggctggggagttcacatcctcaggcaggaactagcagttgtttatccagcaatgcctcaaggatgttgcattgctcccaggaactggctattaggtatgtcttgtgcggtcagtcagcatcacagacacatagatgctcaccagcctggcttagctgggacctaaatcttctggtgaaaagcttttcactaagtgaggttccttccctgcaaatgctgaatctagcctaattcgcaaccacacagaatttcatggctttcaaaggcttgccatgtgccccatctcattctatactcacatcccatggaggtgaggattttcacttcttttctctagacttggaagctgagattcagagaggaagcatcccttgtgcaagatcacatagtcaggaggtgacacagggctaagacttgaaccaaggctctaagaggatttcttcttttcagagtctcttccctgtccatttctgtgactaagctgtgcagaggttgacagcagggcaagttacattgatattcatcctttataggcttcctgctaaaaagcttctgagattgtggtcttccaaaaaaaataggagcttggttgaagtccccacattttcaagcactcagtgttctgcctctggcagctgtgctaacagctcagtgctgtcctgggagtcctctgactcagaaccctcgaagcatcctgcattgtctttacccaccatcatcttcactaagagaaacatgcctacccatgaaggcgtgtttgattactccaggcttctggacacacatacccatgggtgatttttgctcctcaggcccaatattctcagacagcccagcagtgtgaacacacaatgccaggccaggaactgggaccaccatcttgctgatggaaggaacaacaggtggcccaggacatgctcctgcatactcctgggtgtcccagggactgtgtgctcaggagcactgtggtagagcactggccctgccttgagaagagacacaggtctcccgtccctgcaccagctgagagagacttgccgcaaagcacaaggctggcagagatttatgtatgacttgcacagacacaaaaatatacagacaatcaaaacattgatatattcaaactctcctttaaattccaatcttattgcaacaactctgtgaattgcaaggtcccagaatctgccttctcacatactctaccctcattcatccttttgggctaattgatgagcatcttatttcttatctctaaaaattatcagcaaaggctacttcagatggccactttagtcctttcagctgtagtcaggattatttaacttacctgtatatcaaaagtgaagaaaaagttagttcataagtaaaggcactaaatcctttcctgacaatggcagagtctctagaggtagaaatttgccttgctgcagagagagaaggaatggcgtgggatgggggaaagaaaagaaagagaagaagctggggtctccaggcagggtagtaagctgacactaaatattttttacacaaaaatgtattgaagcaacaaatatttcctgaagatccaccctgggtgaggctttgagctgactttagagatcactgtggggtcaagaatgtcttacatgttttattcatcattcttgaaaaaagaaataattcaaaccttggaattaaaaagtcagaaaaatatgggattttctttctggaattttcgaggttttctttttacctttgccagagtgtgggggcaggactgggcctgccagggtgtatagcccttcctgcttggtggaggccagtcaggcccagggccttctaagcagcagtagaaaggaggcttggggaagtggggggtctgggtagcaggggaaggaggccagttccagtgtagccccctatcccctccagatgtgctgcttctggctgtgcactcagtgactgccctcactgctcaaccctgtgctgtgtggtgtgtttctttccccactgacagtgaataaaaggtgcaactgtg

SEQ ID NO: 4216 - DNA, 4098 bp, Homo sapiens
atggggaagaccaacagcaagctggcccccgaggtgctggaggaccttgttcagaacactgagttcagcgagcaggagctgaaggactgccccagcggcatcctcaacctggaggagtttcagcagctctacatcaagttcttcccctacggcgacgcctccaagttcgcgcagcacgctttccgcaccttcgacaagaacggcgacggcaccatcgacttccgggagttcatctgcgccctgtcggtcacctcccgcggcagcttcgagcagaagctcaactgggcctttgagatgtacgacctggacggcgacgggcgcatcacgcgcctggagatgctggagatcatcgaggcaatctacaagatggtgggcaccgtgatcatgatgcgcatgaaccaggacgggctcacgccccagcagcgtgtggacaagatcttcaagaagatggaccaggataaggacgaccagattacattggaggagttcaaggaggcagccaagagtgacccatccattgtgttgctgctgcagtgtgacatgcagaagtagaagctggtgaggggcagggtccctggccagaaggggcatggccacctcccaacctgatgacctctctggctggcctcccaggaggagggacactccagcccccctctctggcccacccagtcctctgcccaagcccttcctcccctccatcaagatctttgagggaccacctcaccctgcaaaagagacaggtcctccagtaccctgtcttctagccccacctcccacttggccagaaccaatgtccattgggcataggggagttggcttttgccccaggaggtgaggttaaggagttgggggcctggggttctggttaggaattctcttgatcctgggattatgctttataggatgtggtcccacaggcctgtcacagggccaaattgggtctgtccattcctgaggctccagatcccataaagggggtctcttccccatcccttctactctacctggcccttccagccccagcctttggagcgttcattcagtcctttcttcagctaatgattactgagcacctgtttggtgctaaggatatggtcatttacaagacacatcttgtgccctctggaagctcatagggttgtgaggcaaacttccagccgtcagggtctcagctaagcagaaggtgctggaaggctggttagtctgggaggagctatttcatcttccagctcagctccacacaaagctgcagaaggacgaaatgaaaagcatttggaagtttaggagccacgtgagtgaaagttttaagaaaaatgaaatttatgtcatacttatttttttagtaccctttaaaggagctacagtcattttattatttcaggaggttaaaatatactctatattacttggtttcttataaaatgattaaatgaatagagaaaatattaattttcaaggggaaaaaacctgagaagaaagggagaaaagaccatgaaatttaccagataacactttttaagactaagtcctgagctgccactctcagcagtttttgctgcttcagctcttcctttttattacctttttcaattcaacaagcaactttctgctacatacttactccggttgggtgctgacttcagggacaggaaaaagcaaggtttgcaaagagtgaaactagtgtatattccgtatcttggtagttcgtttctggattgggtttagtttcagaactggacttgttccttcactgccacagaatcagaaagagctagaagaaaaggctcacctggccactgtttaggcacccagacataatttatggacgaaatgcctaaaaatgtgccaggcatgctctgtttgagaggctttttctaaccccaaatcttagatctgccaggtagttcaacatcttccaagtgtgctggttctgctttccaatgcctgcttcccaattttggatccatgagctatacagctgcatgctttgactgccggaaaaattaatcttgcttcttcatcaggtctttctcctgtacttgtgatcagaaattacctttgacgtgcagtgacagttgatttcctcttgaactgccggtgaaaacagtctagtacacaggtgctgtcagcccagggtgggagcaggaaatgattgctgagcccggggcaggggaattgcatctgcaggaaagagatgcagcatgctcctcactcctgagtgcccacctgtcctgcttctctgcaggtgaaaactctgggggatgctgatcaatagagcttggtcccaagctctactgggcccttggaggtagcaaggccactgggttgctatcctcttgctggggatagcaaccactggtttgcaaccactgggttgctatccttttgctatcctcttgctcatgaccagccatatggtgaggctggggagttcacatcctcaggcaggaactagcagttgtttatccagcaatgcctcaaggatgttgcattgctcccaggaactggctattaggtatgtcttgtgcggtcagtcagcatcacagacacatagatgctcaccagcctggcttagctgggacctaaatcttctggtgaaaagcttttcactaagtgaggttccttccctgcaaatgctgaatctagcctaattcgcaaccacacagaatttcatggctttcaaaggcttgccatgtgccccatctcattctatactcacatcccatggaggtgaggattttcacttcttttctctagacttggaagctgagattcagagaggaagcatcccttgtgcaagatcacatagtcaggaggtgacacagggctaagacttgaaccaaggctctaagaggatttcttcttttcagagtctcttccctgtccatttctgtgactaagctgtgcagaggttgacagcagggcaagttacattgatattcatcctttataggcttcctgctaaaaagcttctgagattgtggtcttccaaaaaaaataggagcttggttgaagtccccacattttcaagcactcagtgttctgcctctggcagctgtgctaacagctcagtgctgtcctgggagtcctctgactcagaaccctcgaagcatcctgcattgtctttacccaccatcatcttcactaagagaaacatgcctacccatgaaggcgtgtttgattactccaggcttctggacacacatacccatgggtgatttttgctcctcaggcccaatattctcagacagcccagcagtgtgaacacacaatgccaggccaggaactgggaccaccatcttgctgatggaaggaacaacaggtggcccaggacatgctcctgcatactcctgggtgtcccagggactgtgtgctcaggagcactgtggtagagcactggccctgccttgagaagagacacaggtctcccgtccctgcaccagctgagagagacttgccgcaaagcacaaggctggcagagatttatgtatgacttgcacagacacaaaaatatacagacaatcaaaacattgatatattcaaactctcctttaaattccaatcttattgcaacaactctgtgaattgcaaggtcccagaatctgccttctcacatactctaccctcattcatccttttgggctaattgatgagcatcttatttcttatctctaaaaattatcagcaaaggctacttcagatggccactttagtcctttcagctgtagtcaggattatttaacttacctgtatatcaaaagtgaagaaaaagttagttcataagtaaaggcactaaatcctttcctgacaatggcagagtctctagaggtagaaatttgccttgctgcagagagagaaggaatggcgtgggatgggggaaagaaaagaaagagaagaagctggggtctccaggcagggtagtaagctgacactaaatattttttacacaaaaatgtattgaagcaacaaatatttcctgaagatccaccctgggtgaggctttgagctgactttagagatcactgtggggtcaagaatgtcttacatgttttattcatcattcttgaaaaaagaaataattcaaaccttggaatt

SEQ ID NO: 4217 - DNA, 1555 bp, Homo sapiens
atggccgaggtgttgcggacgctggccggaaaaccaaaatgccacgcacttcgacctatgatccttttcctaataatgcttgtcttggtcttgtttggttacggggtcctaagccccagaagtctaatgccaggaagcctggaacgggggttctgcatggctgttagggaacctgaccatctgcagcgcgtctcgttgccaaggatggtctacccccagccaaaggtgctgacaccgtgtaggaaggatgtcctcgtggtgaccccttggctggctcccattgtctgggagggcacattcaacatcgacatcctcaacgagcagttcaggctccagaacaccaccattgggttaactgtgtttgccatcaagaaatacgtggctttcctgaagctgttcctggagacggcggagaagcacttcatggtgggccaccgtgtccactactatgtcttcaccgaccagctggccgcggtgccccgcgtgacgctggggaccggtcggcagctgtcagtgctggaggtgcgcgcctacaagcgctggcaggacgtgtccatgcgccgcatggagatgatcagtgacttctgcgagcggcgcttcctcagcgaggtggattacctggtgtgcgtggacgtggacatggagttccgcgaccacgtgggcgtggagatcctgactccgctgttcggcaccctgcaccccggcttctacggaagcagccgggaggccttcacctacgagcgccggccccagtcccaggcctacatccccaaggacgagggcgatttctactacctgggggggttcttcggggggtcggtgcaagaggtgcagcggctcaccagggcctgccaccaggccatgatggtcgaccaggccaacggcatcgaggccgtgtggcacgacgagagccacctgaacaagtacctgctgcgccacaaacccaccaaggtgctctcccccgagtacttgtgggaccagcagctgctgggctggcccgccgtcctgaggaagctgaggttcactgcggtgcccaagaaccaccaggcggtccggaacccgtgagcggctgccaggggctctgggagggctgccggcagccccgtccccctcccgcccttggttttagcagaacgggtaaactctgtttcctttgtccgtcctgttgtgagtaactgaagcctaggccccgtccccacctcaaatcacacacaccccctccccaccacagagacaccattacatacacagacacacacagaaagacacacacagacacaaaatcacacacacaccctccccgccacagagacaccattacatacacagacacacacagaaagacacagacacaaaatcacacacacaccctccccgccacagagacacaccattacatacacagacacgcaatcgcagatacgcccttccggccacagaaacacaccattacacacacatacacagaaagacacacacagacacacaatcacacgcagcccctccccgccacagagacacaccattacatacacagacacacacagaaagacac

SEQ ID NO: 4218 - DNA, 384 bp, Homo sapiens
ccacatcccaggaggccgaggcggcttgccccgcatctcagaagccgggcaggccctgagccttctgacctcacatcctctgccacaccacagtggagaaaccagaactggaggagcagccagaatgcagagaagaaaaaagaggttctctgcatgtttggaagtcggaattggttgaagttgaagatgatgtgtatctgaggcacagctcttccctgacttataggctttgacactgctgttgaggtttgactcgaagcccagagttttggtgtggatgagcagggacaaattgctgagcatgaagaagagtaaaattaagcaagtggaacatatgccctttgcctctgctctgcacagtgaaatgaaaagtcaacctttgaa

SEQ ID NO: 4219 - DNA, 4190 bp, Homo sapiens
gaaggcggctagggactggctgaagagggttagcgaaacgttagcggtcgggtctgggcagggggtggagctggttgaaggaacggggcagtcccctgaggagcggggctggttgaaacgctaggggcgggatctggcggagtggaagaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaa

SEQ ID NO: 4220 - DNA, 396 bp, Homo sapiens
agaagctgtctatcgggctccagcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgacca

SEQ ID NO: 4221 - DNA, 396 bp, Homo sapiens; identical to SEQ ID NO: 4220

SEQ ID NO: 4222 - DNA, 7385 bp, Homo sapiens
ggcgccgccggaccgcgccccaccccgcgcgcccgagcagggcgactgtcattagcttcctggacgggacccggggcgggatcctggtgtcctgaaaggggcccgggcgaccctaagaggaagaacttttgggggcggggtccccggtcccgcgtcccctgggcagccgctattgtctacgcgcctcgctgggcggcgcggggggcgtgatcgcggcggccccgggctctgggtgcggagacccaggcggggctgggcccagggcggcggcgggagaagccggggaagccgaagagcctggggaggaggagctgcgagcgcgggagacgagcaggagccgcgcgggccgcggcgagcgcgatgccggcggcggcgggggacgggctcctgggggagccggcggcgcctgggggcggcggcggcgcggaggacgcggccaggcccgcggcggcctgcgagggaagtttcctgcctgcctgggtgagcggcgtgccccgcgagcggctccgcgacttccagcaccacaagcgcgtgggcaactacctcatcggcagcaggaagctgggcgagggctcctttgccaaggtgcgcgaggggctgcacgtgctgaccggggagaaggtggccataaaagtcattgataagaagagagccaaaaaggacacctatgtcaccaaaaacctgcggcgagagggtcagatccagcagatgatccgccaccccaatatcactcagctccttgatattttagaaacggaaaacagctactacctggtcatggagctgtgccctgggggcaacctgatgcacaagatctatgagaagaagcggctggaggagtccgaagcccgcagatacatccgacagctcatctctgccgtagagcacctgcaccgggccggggtggtccacagagacttgaagatagagaatttgctactagatgaagacaataatatcaagctgattgactttggtttgagcaactgcgcagggatcctgggttactcggatccgttcagcacacagtgtggcagccctgcctacgctgcacctgaactgctcgccaggaagaaatacggccccaaaatcgatgtctggtccataggtgtgaacatgtatgccatgttgaccgggacgctgcctttcacggtggagcctttcagcctgagggctttgtaccagaagatggtagacaaagaaatgaaccccctccccactcagctctccacaggtgccatcagtttcctgcgctctctcctggaaccggatcctgtgaagaggccaaatattcagcaggcactggcgaatcgctggcttaatgagaattacacgggcaaagtgccctgtaatgtcacctatcccaacaggatttctctggaagatctgagcccgagcgtcgtgctgcacatgaccgagaagctgggttacaagaacagcgacgtgatcaacactgtgctctccaaccgcgcctgccacatcctggccatctacttcctcttaaacaagaaactggagcgctatttgtcagggaaatctgacatccaggacagcctctgctacaagacccggctctaccagatagaaaagtacagggcccccaaggagtcctatgaggcctctctggacacctggacacgagatcttgaattccatgccgtgcaggataaaaagcccaaagaacaagaaaaaagaggggattttcttcatcgaccattctccaagaagttggacaagaacctgccctcgcacaaacagccctcaggctcgcttatgacacagattcagaacaccaaagccctcctgaaggaccggaaggcctccaagtccagcttccccgacaaagattcctttggctgccgcaatattttccgcaaaacctcagattccaattgtgtggcttcttcttccatggagttcatccccgtgccaccgcccaggaccccgaggattgtgaagaaaccggagccccatcagccagggcccggaagcactggcatcccccacaaggaagaccccctgatgctggacatggtgcgctccttcgagtctgtggatcgcgacgaccacgtagaagtgctgtctccctctcatcactacaggattctgaactccccggtcagcttggctcgcagaaattccagcgagaggacgctgtccccgggtctgccatccggaagcatgtcgcctctccatactcctttgcatccaactctggtctcttttgctcacgaagataagaacagccccccaaaagaggagggcctgtgttgcccacctccggttcccagcaatggccccatgcagcctctggggagccccaattgtgtgaaaagccgaggccggttccctatgatgggcatcggacagatgttaaggaagcgccatcagagtctgcagccatctgcagataggcccctggaggccagcctgcccccactgcagcccctagcccctgtgaaccttgcctttgacatggccgatggggtcaagacccagtgctaacttgggccagcggggtttggggtatctctagaaaacagcaactgaacagagctccacacatctgtcagggtgtgagcactccaaggcctcgcgtggagcatccttagtcccacctgtagctgaatccacagacccaaagcctgcacaacccaacctcgcttagggacccccagagatgctggaatcgctaggagggttggctccaggggcagccaattcctatcattcagatcttccttcctcccaagtactcaccaaccccttccacttcccacttcccccaggcttggggggaaaacagggcatgagccttctggggcactcagattatggactgttaccagatctttcttcacgctgtgctacatgtgtgcctctcacagcagttggccacagttacagggagagaacaatatcacagtcattcatccaggccacgtttcctctgcggagtgtagcagccctgcctttcatagcagggattacctgaaggccagcaggagccgggggcaggcccaggatcctcagaggaagatggagaggagcttcggaccaagatcaaaccaaacagtggggaccccaacagaagagaaagactgaaggagacactcatttcccaagcaagattttgatagatttttgttgttgttgttgttgaaacatgctaatgattgaattatcttttccaaagattttttttaaatgtgatgtcggtaaattgaaataacataattttttaaaacttggatggagagatgagaagcaattccaccaaactcatgttttcacaggagggttcagtgtggagagcaaaaaagctgactgtggtgatttgctgagtgctgtggcccacaggcagggcaagtctcggtggccctgtgttcatcctgttgtttaaggcatagccctgatccttctggaaggcatagaacacggttacagctggttctgtagaaagagggaaaagatgattgtgacaattcagagcataactcagatggcgagaaggcagcattatctctgtgcgatgctgatttcaagctgcccacagaactggtgcggctcagagctcggcgagtttgctgggagctgggagcaggcttgcctggcagagaacctgttcagatacaggccagtttcttcttcgaggaaagccaagctcctcaaacagggttcagtccacgttgtgttttcacacctttctccaaggatcgaaccaaagatgtgtctccagtattgtgtctgtgcccctgtgtgtgttttgtggacagccgtgttgtctgactgtatccagctggcacttgacagggtgcagtcattggtgagaagaatcagaaaaagaagacccatcagcacaggttggataggggttagtgtaggagaccagttacagaatggcctggagtcttcaacttttgaccggtgcaggtgtgaccagagaccacctctgtggccacctcagatagtcatctcagtccaaggatcccaaaacacaaatctagaattgcaaagccagcctttatttccctggcaggcagccttgccagaaggcagagaggcagttctgaatcattctctcattcaccagtggtgacatccttcagtccctcacatctctgacagagcgggacagaatggatatttggctgaccttggtgagacctggagctgcctgtttcttccctaggggatcaccacggctctagggcattctaggatgaggtcagaccccttggccattggtgttattttttgtatagcttcagactgggttccagaacttaccattgaaaacagagcttttaggccaggtgtggtggctcacacctgtaatcccagcactttgggaggccgaggcaggtggatcgcttgagctcaggagttcgagagcagcctgggcaacatggtgaaagcccgtctctaccgaaaaatacaaaaaaaaatagctgggtgtggtggtacgtgcctgtagtcccagctacttcggggactgaggtgggaggatcacttgaacctaggaggtcgaggctgcagtgagccaagatcatgctactgcactccagcttaggtggcaaagtgagaccctgtctccaaaaaaagaaaatagagctttataagcagagagaagaaaataatcatctaagaccatctctccattcgacatgaagtgtaccttttctaaagacggtttccagctgcaacggctccactttgcaggcttgcagggtgtatacctgcgcattgggaacttgctggaacccctgatgcattttccttgagagcaggggtacttccgccttgccgttagcttgtggagaacgtgcttcttattcctggcaggcttcaagaacagctgcacatgtgccgctaactgaccgcgttgccattggcgacctggactctgaactcaggtttattctaaacccagtgagaggtgagggggagtgatgaaaggggatcagctgtatttgtgtgtgtgtgtgtgtgtgagcacctgacaaatctatgaaaccgagtgaaaggagaaatgttagattctttattattttattatatttatatggaaagctcgactctccctttggtaagtccgaagcatgttgtctgttcgaccgtgactgtcttcctcagtctgtgcctgtgattccagtcaccctgtagttactgacagaaattgactggactgtcattgtgtgaagtctaggaggaaatgtccattttaattgtatgatttggtcataagtaaggactatatttatgtcaccattattagatatatgtacttttgtaatgactgtgaaatacacttttccctcactacgactgcttctttatttgctgataaatcttaaaacaactaagtacgttgcaaataatagtacaggtaccatcttttatgtgaagttctttttctttttttgagacagggtcttgctctgtcacccaggctggagtgcagtggcacaatcacagttcactgcagcctcaacctctccagattcaagtgatcctcccatctcagcctcccaagtagctgggactacagttgtgcaccacaatgcctagctaattttttttgtattttgtagaaatggggtttcgccatgttgctcaggctgatctcaaactcctgggctccaacgatctgcccaccttggcctcccaaagtgctgagattacaggcgtgagccactgtgcctggccttatgtaaagctcttgacctagcatctgactggaaacaagcgggaattgcattggggggcattttctgggccagtttccctgccttattttacctgcaataggtgtgcctacaaaagtctttctgacatacacactgcaggtggcagttcaagaagaatcaacctttttcatttggggatattaggatcttccttggagactctgaaaatggcacacaaagaatggcagttatgaacgtgacttctagattttgtccttgtaggaggccttggtcatggataggggaagagggatgatgggatggaatgggagggtgggatctagatgacctcttgaaattgtcccagttactgcttccttcataactgttcacaaaacgtttttcatatataccaccttgtttcccctgggaagtgaggggacgaagccttagagggtgacatagctagaaagtggagaagctcactgttcactgtgcaaagccccagtagtcggattccggggaaaagaacaagtatctagttttgatgacaatgttttcttgtaagaatcccaacactttagaatagaaaaggacctaagattctctggctcagccccagcctttctgaagaagggaaaactagggacccagatggtttaaggacaccccagagtccccagatgagctggcatttgagctggtctggagcagagtttctccctcaaagaacacagagaaatcagagagtggctgccatggtcagagggggatgtcaacaacagatcaagccgtcatcacaacaggtatttctgaagttcctgcagggactaggtcttgcatttttaagtccttttcaaaactgtgcagcttcctgaaccttatgctgtttgtcccatccactcttgaagctggggaaagacagctttctttgggaactctgtctttctcagttgacttcccaagtaagcagcaaacccctggatagccttgttatctactttaggtattaagaggctattgggttttactagattaaatcaataaaacatttcctatagagccatatcatacactgaagcaaattcagaaagaatgcaaaactgctatcttttgggggagtctggaagcctgttggttagtgtatttattttctttgtggggtcttctgtgagctacaggcacagtaagaataattcagagcggtactgggagttggttcaatttcatgtcatcacttttcaatgaagggagtgcatttcctgagtagtaaatgagtatattatttgtggcagcttttctgttaagggagctttccagacatctggttgcaaagacaaataggatatatatttgtacttcttctctgtggacatgtttttgtgacacacagttatctctaggagttgacgtctgtgggcactaagggactgaggttgggggagaaagctgaggaggctttggaagagaaggtgaggagcatttcaggatttgcagtccccctccacatgtatccacatctgagctggtggtgttccaataatgaggcatttggggcaaccaattttggaaggatagaatagctttatgtggagcaaacttgaggatcaattggagttgagtggtttaaaacttaaagatggcacaggaagctgtatcatttacaggtgaaaaaaataaatgggtctgacttca

SEQ ID NO: 4223 - DNA, 1167 bp, Homo sapiens
cgcggttcctccccgagccgcccccagtgcccaagcttccgcggctccgccgaccaggggccgcgccgactgggaactcgccaggggcgtagtcccctgcaaggcctgggggccggcgaggccgcagaggcgggatgggcctgagcccgggcgccgagggggagtacgcgctccgcctccctaggattcccccacccctccccaaacccgcctcgcgaaccgccagtaccgggcccaaggaccagccgcctgcgctcagacgttcagctgtgccccactcaggtctaaatagcatttccccccttgaattagaagaatccgtgggattcgcagcgttggtccagctcccagccaagcagcctccgccgggcacattagaacagggcagaagcatccagcaaggggagaaggctgtagttagcttggagaccacacccagccagaaagcagactggagttcaattccaaagcctgagaatgaaggcaagttaataaagcaagcagctgagggaaaaccaagacccagacctggagacctgattgagatttttcgaattggctatgagcactgggccatctatgtagaagatgattgcgtggtccatctggctcccccaagtgaggagtttgaggtgggcagcattacttccatctttagcaatcgggccgtggtgaaatacagtcgtctggaggatgtgctgcatggctgctcctggaaggtcaataacaagctagatgggacgtacctgcccttgccggtggacaagatcatccagcgtacaaaaaagatggtcaacaagatcgtgcagtacagcctgattgaagggaactgtagagcacgccctgatggaaggagcgaaggctgctggagcagttatttcagctgtagtggatagcataaagcccaaaccaataactgcctgaaggtgatgaaaactccagctagaggaagagttactgacacaagcaaaaagaacatgcttccttcccttgccttctctcaatggctccgattaagaaaattgtgaacttctggaagaatctacaatgtatccaattacccttccagaaatacatccaatatatacgagcatagacccacagactctcaggatgggaaggatctggtatctagtgtgtatctcttatgcgccaggcactgtgcta

SEQ ID NO: 4224 - DNA, 3032 bp, Homo sapiens
gcggttcctccccgagccgcccccagtgcccaagcttccgcggctccgccgaccaggggccgcgccgactgggaactcgccaggggcgtagtcccctgcaaggcctgggggccggcgaggccgcagaggcgggatgggcctgagcccgggcgccgagggggagtacgcgctccgcctccctaggattcccccacccctccccaaacccgcctcgcgaaccgccagtaccgggcccaaggaccagccgcctgcgctcagacgttcagctgtgccccactcagaagaatccgtgggattcgcagcgttggtccagctcccagccaagcagcctccgccgggcacattagaacagggcagaagcatccagcaaggggagaaggctgtagttagcttggagaccacacccagccagaaagcagactggagttcaattccaaagcctgagaatgaaggcaagttaataaagcaagcagctgagggaaaaccaagacccagacctggagacctgattgagatttttcgaattggctatgagcactgggccatctatgtagaagatgattgcgtggtccatctggctcccccaagtgaggagtttgaggtgggcagcattacttccatctttagcaatcgggccgtggtgaaatacagtcgtctggaggatgtgctgcatggctgctcctggaaggtcaataacaagctagatgggacgtacctgcccttgccggtggacaagatcatccagcgtacaaaaaagatggtcaacaagatcgtgcagtacagcctgattgaagggaactgtgagcactttgtcaatggcctcagatatggcgtaccccggagccagcaggtagagcacgccctgatggaaggagcgaaggctgctggagcagttatttcagctgtagtggatagcataaagcccaaaccaataactgcctgaaggtgatgaaaactccagctagaggaagagttactgacacaagcaaaaagaacatgcttccttcccttgccttctctcaatggctccgattaagaaaattgtgaacttctggaagaatctacaatgtatccaattacccttccagaaatacatccaatatatacgagcatagacccacagactctcaggatgggaaggatctggtatctagtgtgtatctcttatgcgccaggcactgtgctaggcatttcatatacggatctaatttcactctctttgtaggatgggaccttgcttgtgtcttaggctgaccttggtctccgatgcttgagtgccatcagaaacatcccagaaacctctgcttgaatatttccagtaacgaagatgtctttttccagatgttctttttatttaactaaaatgtctctagcttctttccatttatgataatcctgcccttttcgacccacagtgtagctcagaggaggaggaccttaagaaaaactgagattcgttattcagggcccatggtaccttaatctagaaacacatatcccaagaaatattttctttttaaaattatacatcaactttatgccttattgtttaaaaatcttctatcaaaagtatcatcgataagacaatttatcttgcttttgtacctcataattaccctaaaatgtgaagtttctagtctcactgatttcagatgaatatttaaaataatttgataagtttaatcaattgaactctactgtgtgagtgagggagagaaaggagttatttttgtgttttgaagaaagttgacaggatggaagatctgaaattatggctggggattgtagtgatagctggtagctgaaaccacccaaaaaagctagaaaagtgttctcttatgcctccagagatacctagaaaatatgaagaatgtggaaaagagcaagatggaaccctcagagtgtttcagataaggtctgttggtatctccataagcttttctcctatttggagaaaatagactctcactgaaactcttcaatgtttttaccctccatccttttcttagcaatctaaactcaatggcctcctgttccccaacactgcagtctgggcatctgactttgtcttccctctgcactcatttctgtgaatcatgaccaggatgaaactgatatccctagttcctcttccccatttcttctcacactcccctgcctgagaatcagttgagttcccaatacctcttccttcagtctctattcattatatggtctaggttgagacttccttggaagcagaacctgagtaccaggaactcatattttataaagtatatttattccttttagctgcaaactaacccagccatgttttagtgaatgctttaatctgaagatgactttgagctcattgaccatattaatctttcatcaaacaaactggatgttgtttcattaacaaaaaactcctccacaccaaggagtgtttagtaacttctgcacagaggactcatccatctcttgcttatgtttgggacagaaagacacttctctggctttttactggcttgaacccaatgggacagagactctctagaaagtttcagggctcacattcacttgtttgtccaaaaaatatttttgagtgtctcccaagtgccaaaccctggctactcccacctttgcctgagcccatgagcggtagtctgggggctggatgtgaggagttctgagttggctaggaagacacaaggcacaatggacatggggcaaagtccacttgctggacattggtcccttccacttccaagctgtccatcaggctgagagatctggaatgcataccccacactttgaagatgaggaagggcgagtttctcaaagtgtgtgtgtgtgtttctcttttaatctgtaatggtttctgcattttgaggtagaaacagaaatctcttttttgagtgggaccactcgggtgcggcttcttagtcttgttgatataataaagcacatgcccactcctcatggagtggagaggagaaaattctaagggaacgtactctgaatgcaaatgtttctgagattaaacacta

SEQ ID NO: 4225 - DNA, 1166 bp, Homo sapiens
tttgcagcccgcggcgctttcccctccgcggttcctccccgagccgcccccagtgcccaagcttccgcggctccgccgaccaggggccgcgccgactgggaactcgccaggggcgtagtcccctgcaaggcctgggggccggcgaggccgcagaggcgggatgggcctgagcccgggcgccgagggggagtacgcgctccgcctccctaggattcccccacccctccccaaacccgcctcgcgaaccgccagtaccgggcccaaggaccagccgcctgcgctcagacgttcagctgtgccccactcaggtctaaatagcatttccccccttgaattagaagaatccgtgggattcgcagcgttggtccagctcccagccaagcagcctccgccgggcacattagaacagggcagaagcatccagcaaggggagaaggctgtagttagcttggagaccacacccagccagaaagcagactggagttcaattccaaagcctgagaatgaaggcaagttaataaagcaagcagctgagggaaaaccaagacccagacctggagacctgattgagatttttcgaattggctatgagcactgggccatctatgtagaagatgattgcgtggtccatctggctcccccaagtgaggagtttgaggtgggcagcattacttccatctttagcaatcgggccgtggtgaaatacagtcgtctggaggatgtgctgcatggctgctcctggaaggtcaataacaagctagatgggacgtacctgcccttgccggtggacaagatcatccagcgtacaaaaaagatggtcaacaagatcgtgcagtacagcctgattgaagggaactgtgagcactttgtcaatggcctcagatatggcgtaccccggagccagcaggtagagcacgccctgatggaaggagcgaaggctgctggagcagttatttcagctgtagtggatagcataaagcccaaaccaataactgcctgaaggtgatgaaaactccagctagaggaagagttactgacacaagcaaaaagaacatgcttccttcccttgccttctctcaatggctccgattaagaaaattgtgaacttctggaagaatctacaatgtatccaattacccttccagaaatacatccaatatatacga

SEQ ID NO: 4226 - DNA, 7066 bp, Homo sapiens
gactcggctcctcgcggcgacatggatcggatggccagctccatgaagcaggtgcccaacccactgcccaaggtgctgagccggcgcggggtcggcgctgggctggaggcggcggagcgcgagagcttcgagcggactcagactgtcagcatcaataaggccattaatacgcaggaagtggctgtaaaggaaaaacacgccagaacgtgcatactgggcacccaccatgagaaaggggcacagaccttctggtctgttgtcaaccgcctgcctctgtctagcaacgcagtgctctgctggaagttctgccatgtgttccacaaactcctccgagatggacacccgaacgtcctgaaggactctctgagatacagaaatgaattgagtgacatgagcaggatgtggggccacctgagcgaggggtatggccagctgtgcagcatctacctgaaactgctaagaaccaagatggagtaccacaccaaaaatcccaggttcccaggcaacctgcagatgagtgaccgccagctggacgaggctggagaaagtgacgtgaacaactttttccagttaacagtggagatgtttgactacctggagtgtgaactcaacctcttccaaacagtattcaactccctggacatgtcccgctctgtgtccgtgacggcagcagggcagtgccgcctcgccccgctgatccaggtcatcttggactgcagccacctttatgactacactgtcaagcttctcttcaaactccactcctgcctcccagctgacaccctgcaaggccaccgggaccgcttcatggagcagtttacaaagttgaaagatctgttctaccgctccagcaacctgcagtacttcaagcggctcattcagatcccccagctgcctgagaacccacccaacttcctgcgagcctcagccctgtcagaacatatcagccctgtggtggtgatccctgcagaggcctcatcccccgacagcgagccagtcctagagaaggatgacctcatggacatggatgcctctcagcagaatttatttgacaacaagtttgatgacatctttggcagttcattcagcagtgatcccttcaatttcaacagtcaaaatggtgtgaacaaggatgagaaggaccacttaattgagcgactatacagagagatcagtggattgaaggcacagctagaaaacatgaagactgagagccagcgggttgtgctgcagctgaagggccacgtcagcgagctggaagcagatctggccgagcagcagcacctgcggcagcaggcggccgacgactgtgaattcctgcgggcagaactggacgagctcaggaggcagcgggaggacaccgagaaggctcagcggagcctgtctgagatagaaaggaaagctcaagccaatgaacagcgatatagcaagctaaaggagaagtacagcgagctggttcagaaccacgctgacctgctgcggaagaatgcagaggtgaccaaacaggtgtccatggccagacaagcccaggtagatttggaacgagagaaaaaagagctggaggattcgttggagcgcatcagtgaccagggccagcggaagactcaagaacagctggaagttctagagagcttgaagcaggaacttgccacaagccaacgggagcttcaggttctgcaaggcagcctggaaacttctgcccagtcagaagcaaactgggcagccgagttcgccgagctagagaaggagcgggacagcctggtgagtggcgcagctcatagggaggaggaattatctgctcttcggaaagaactgcaggacactcagctcaaactggccagcacagaggaatctatgtgccagcttgccaaagaccaacgaaaaatgcttctggtggggtccaggaaggctgcggagcaggtgatacaagacgccctgaaccagcttgaagaacctcctctcatcagctgcgctgggtctgcagatcacctcctctccacggtcacatccatttccagctgcatcgagcaactggagaaaagctggagccagtatctggcctgcccagaagacatcagtggacttctccattccataaccctgctggcccacttgaccagcgacgccattgctcatggtgccaccacctgcctcagagccccacctgagcctgccgactcactgaccgaggcctgtaagcagtatggcagggaaaccctcgcctacctggcctccctggaggaagagggaagccttgagaatgccgacagcacagccatgaggaactgcctgagcaagatcaaggccatcggcgaggagctcctgcccaggggactggacatcaagcaggaggagctgggggacctggtggacaaggagatggcggccacttcagctgctattgaaactgccacggccagaatagagggtacagcatcccctaaagagttttatgccaagaactctcgatggacagaaggacttatctcagcctccaaggctgtgggctggggagccactgtcatggtggatgcagctgatctggtggtacaaggcagagggaaatttgaggagctaatggtgtgttctcatgaaattgctgctagcacagcccagcttgtggctgcatccaaggtgaaagctgataaggacagccccaacctagcccagctgcagcaggcctctcggggagtgaaccaggccactgccggcgttgtggcctcaaccatttccggcaaatcacagatcgaagagacagacaacatggacttctcaagcatgacgctgacacagatcaaacgccaagagatggattctcaggttagggtgctagagctagaaaatgaattgcagaaggagcgtcaaaaactgggagagcttcggaaaaagcactacgagcttgctggtgttgctgagggctgggaagaaggaacagaggcatctccacctacactgcaagaagtggtaaccgaaaaagaatagagccaaaccaacaccccatatgtcagtgtaaatccttgttacctatctcgtgtgtgttatttccccagccacaggccaaatccttggagtcccaggggcagccacaccactgccattacccagtgccgaggacatgcatgacacttccaaagactccctccatagcgacaccctttctgtttggacccatggtcatctctgttcttttcccgcctccctagttagcatccaggctggccagtgctgcccatgagcaagcctaggtacgaagaggggtggtggggggcagggccactcaacagagaggaccaacatccagtcctgctgactatttgacccccacaacaatgggtatccttaatagaggagctgcttgttgtttgttgacagcttggaaagggaagatcttatgccttttcttttctgttttcttctcagtcttttcagtttcatcatttgcacaaacttgtgagcatcagagggctgatggattccaaaccaggacactaccctgagatctgcacagtcagaaggacggcaggagtgtcctggctgtgaatgccaaagccattctccccctctttgggcagtgccatggatttccactgcttcttatggtggttggttgggttttttggttttgtttttttttttaagtttcactcacatagccaactctcccaaagggcacacccctggggctgagtctccagggccccccaactgtggtagctccagcgatggtgctgcccaggcctctcggtgctccatctccgcctccacactgaccaagtgctggcccacccagtccatgctccagggtcaggcggagctgctgagtgacagctttcctcaaaaagcagaaggagagtgagtgcctttccctcctaaagctgaatcccggcggaaagcctctgtccgcctttacaagggagaagacaacagaaagagggacaagagggttcacacagcccagttcccgtgacgaggctcaaaaacttgatcacatgcttgaatggagctggtgagatcaacaacactacttccctgccggaatgaactgtccgtgaatggtctctgtcaagcgggccgtctcccttggcccagagacggagtgtgggagtgattcccaactcctttctgcagacgtctgccttggcatcctcttgaataggaagatcgttccaccttctacgcaattgacaaacccggaagatcagatgcaattgctcccatcagggaagaaccctatacttggtttgctacccttagtatttattactaacctcccttaagcagcaacagcctacaaagagatgcttggagcaatcagaacttcaggtgtgactctagcaaggctcatctttctgcccggctacatcagccttcaagaatcagaagaaaggccaaggtgctggactgttactgacttggatcccaaagcaaggagatcatttggagctcttgggtcagagaaaatgagaaaggacagagccagcggctccaactcctttcagccacatgccccaggctctcgctgccctgtggacaggatgaggacagagggcacatgaacagcttgccagggatgggcagcccaacagcacttttcctcttctagatggaccccagcatttaagtgaccttctgatcttggaaaaacagcgtcttccttctttatctatagcaactcattggtggtagccatcaagcacttcccaggatctgctccaacagaatattgctaggttttgctacatgacgggttgtgagacttctgtttgatcactgtgaaccaacccccatctccctagcccacccccctccccaactccctctctgtgcattttctaagtgggacattcaaaaaactctctcccaggacctcggatgaccatactcagacgtgtgacctccatactgggctaaggaagtatcagcactagaaattgggcagtcttaatgttgaatgctgctttctgcttagtatttttttgattcaaggctcagaaggaatggtgcgtggcttccctgtcccagttgtggcaactaaaccaatcggtgtgttcttgatgcgggtcaacatttccaaaagtggctagtcctcacttctagatctcagccattctaactcatatgttcccaattaccaaggggtggccgggcacagtggctcacgcctgtaatcccagcactttgagaggctgaggtggtaggatcacctgaggtcaggagttcaagaccagcctgtccaacatggtgaaacccccatctctactaaaaataccaaaaattagccgagcgtagtgacgggtgcccgtaatcccagctactcaggaggctgagacaggagaatcacctgaaccccagaggcagaggttgcagtgagctgagatcacgccattgtactccagcctgggcaacaagagcaaaactccgtctcaaaaaaaaaaaaaaattacaaatggggcaaacagtctagtgtaatggatcaaattaagattctctgcccagccgggcacagtggcgcatgcctgtaatcccagaactttgggaggccaagacgggatgattgcttgagctcaggagtttgagaccaggctgggcatcatagcaagacctcatctctactaaaattcaaaaacaaaattagccgggcatgatggtgcatgcctgtagtctcagctagttggggagctaaggtgggagaattgcttgagcttgggaagtcgaggctgcagtcagccctgattgtgccagtgcactccggcctgggtgacagagtgagaccctgtctcaaaaaaaaaaagattctgtgtcagagcccagcccaggagtttgaggctgcaatgagccatgatttcccactgcactccagcctgagtgacagagcgagactccatctctttaaaaacaaacaaaaaattatctgaatgatcctgtctctaaaaagaagccacagaaatgtttaaaaacttcatcgacttagcctgagtcataacggttaagaaagcacttaaacagaagcagaggctaattcagtgtcacatgaggaagtagctgtcagatgtcacataattactttcgtaatagctcagattagaatggctaccccattctctagacaaaatcaaattgtcctattgtgactcttctaaaaatgaagatgaagagctatttaatgacacaccttggattaaaacgggaatcacatcttaaagctaaaaatgaacctgcaagccttctaaatgagtcactgagcatcactagtgacaagtctcgggtgagcgtaaatgggtcatgacaagatgggacagcaacaaaatcatggcttaggatcgacaagaagttaaaaaacagctgcatctgttacttaagtttgtaagacagtgccctgagacctctagagaaaagatgtttgtttacataagagaaagaggccagacatggtgtctcacacgtttaatcccagcactttgggaggcaggggcgggtggatcacctgaggtcaggagttcaagactagcctggccaacatggtgaaaccccgtctctactaaaaatacaaaaattagccgggcatggtggcaggcgcctataatcccagctactggggaggctgaggcaggagaatcacttgaacccgggggacagaggttgtagtgagccaagatcgcaccactgcactccagcctgggtcacagagtgagactccatctcaaaaaaaaaaaagagagagagagagaaagaaatagaagagaagagccatcttggcagggttattttatatctgagcaaggagtttaaatgagactagtttagattgtctgctgatgcagccgtccatagcagtacccctaaaatcccaccagaatacgggtccctctaacccagtggctggaagaaccactgtctagagcaacttttcttggaactgtcccagctaccaagtcagacaccaaggtttatgccaccaggtaacacgggaatcacaggtacatgtcgctccggtcagattagttggctttggcccctcgaccctgtgcaggagctagttctcagcttgcagctggaagttccctct

SEQ ID NO: 4227 - DNA, 2081 bp, Homo sapiens
gggtggggtgaccccctacaaaagctcagaatttccagcagcggctccttcctccaggagtctctggtgcagctggggtggaatctggccaggccctgcttaggcccccatcctggggtcaggaaatttggaggataaggcccttcagccccaaggttgtcctcgaccagtcccgtgccatggcagcccacctgcttcccatctgcgccctcttcctgaccttactcgatatggcccaaggctttaggggccccttgctacccaaccggcccttcaccaccgtctggaatgcaaacacccagtggtgcctggagaggcacggtgtggacgtggatgtcagtgtcttcgatgtggtagccaacccagggcagaccttccgcggccctgacatgacaattttctatagctcccagctgggcacctacccctactacacgcccactggggagcctgtgtttggtggtctgccccagaatgccagcctgattgcccacctggcccgcacattccaggacatcctggctgccatacctgctcctgacttctcagggctggcagtcatcgactgggaggcatggcgcccacgctgggccttcaactgggacaccaaggacatttaccggcagcgctcacgggcactggtacaggcacagcaccctgattggccagctcctcaggtggaggcagtagcccaggaccagttccagggagctgcacgggcctggatggcaggcaccctccagctggggcgggcactgcgtcctcgcggcctctggggcttctatggcttccctgactgctacaactatgactttctaagccccaactacaccggccagtgcccatcaggcatccgtgcccaaaatgaccagctagggtggctgtggggccagagccgtgccctctatcccagcatctacatgcccgcagtgctggagggcacagggaagtcacagatgtatgtgcaacaccgtgtggccgaggcattccgtgtggctgtggctgctggtgaccccaatctgccggtgctgccctatgtccagatcttctatgacacgacaaaccactttctgcccctggatgagctggagcacagcctgggggagagtgcggcccagggggcagctggagtggtgctctgggtgagctgggaaaatacaagaaccaaggaatcatgtcaggccatcaaggagtatatggacactacactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgattggccacacactgagttgcacatattgagaacctaatgcactctgggtctggccagggcttcctcaaatacatgcacagtcatacaagtcatggtcacagtaaagagtacactcagccactgtcacaggcatattccctgcacacacatgcatacttacagactggaatagtggcataaggagttagaaccacagcagacaccattcattccatgtccatatgcatctacttggcaaggtcatagacaattcctccagagacactgagccagtctttgaactgcagcaatcacaaaggctgacattcactgagtgcctactctttgccaatccccgtgctaagcgttttatgtggacttattcattcctcacaatgaggctatgaggaaactgagtcactcacattgagagtaagcacgttgcccaaggttgcacagcaagaaaagggagaagttgagattcaaacccaggctgtctagctccgggggtacagcccttgcactcctactgagtttgtggtaaccagccctgcacgacccctgaatctgctgagaggcaccagtccagcaaataaagcagtcatgatttactta

SEQ ID NO: 4228 - DNA, 2324 bp, Homo sapiens
agatgtggggagcgcctctgccctgtcgccccgtccgggatgtgaggagcgtctctccctggccgccccgtctgagaagtgaggagcccctccgcccagcagccgccctgtctgagaagctagtcttgaattcctgacctcaggtgatcctcccgcgttggcctcccaaagtgctgggattacaggcatgagccaccactcctggccccagaaagtgacattctttacttaccacaggaggaaaagatccacgaaagtaaagtgcctagggcccatcaatgtcagatgcagccacgtggacaaagaacactccctgagcacaagacacgaaagaacccggtctccagtgtcacaaacaggcctgcccagcagggtctgcccctgcccacctcctccagcctaggttgtcctcgaccagtcccgtgccatggcagcccacctgcttcccatctgcgccctcttcctgaccttactcgatatggcccaaggctttaggggccccttgctacccaaccggcccttcaccaccgtctggaatgcaaacacccagtggtgcctggagaggcacggtgtggacgtggatgtcagtgtcttcgatgtggtagccaacccagggcagaccttccgcggccctgacatgacaattttctatagctcccagctgggcacctacccctactacacgcccactggggagcctgtgtttggtggtctgccccagaatgccagcctgattgcccacctggcccgcacattccaggacatcctggctgccatacctgctcctgacttctcagggctggcagtcatcgactgggaggcatggcgcccacgctgggccttcaactgggacaccaaggacatttaccggcagcgctcacgggcactggtacaggcacagcaccctgattggccagctcctcaggtggaggcagtagcccaggaccagttccagggagctgcacgggcctggatggcaggcaccctccagctggggcgggcactgcgtcctcgcggcctctggggcttctatggcttccctgactgctacaactatgactttctaagccccaactacaccggccagtgcccatcaggcatccgtgcccaaaatgaccagctagggtggctgtggggccagagccgtgccctctatcccagcatctacatgcccgcagtgctggagggcacagggaagtcacagatgtatgtgcaacaccgtgtggccgaggcattccgtgtggctgtggctgctggtgaccccaatctgccggtgctgccctatgtccagatcttctatgacacgacaaaccactttctgcccctggatgagctggagcacagcctgggggagagtgcggcccagggggcagctggagtggtgctctgggtgagctgggaaaatacaagaaccaaggaatcatgtcaggccatcaaggagtatatggacactacactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgattggccacacactgagttgcacatattgagaacctaatgcactctgggtctggccagggcttcctcaaatacatgcacagtcatacaagtcatggtcacagtaaagagtacactcagccactgtcacaggcatattccctgcacacacatgcatacttacagactggaatagtggcataaggagttagaaccacagcagacaccattcattccatgtccatatgcatctacttggcaaggtcatagacaattcctccagagacactgagccagtctttgaactgcagcaatcacaaaggctgacattcactgagtgcctactctttgccaatccccgtgctaagcgttttatgtggacttattcattcctcacaatgaggctatgaggaaactgagtcactcacattgagagtaagcacgttgcccaaggttgcacagcaagaaaagggagaagttgagattcaaacccaggctgtctagctccgggggtacagcccttgcactcctactgagtttgtggtaaccagccctgcacgacccctgaatctgctgagaggcaccagtccagcaaataaagcagtcatgattt

SEQ ID NO: 4229 - DNA, 2055 bp, Homo sapiens
attctggagggaaacagggtcaaggcgatctcctcccccacgcctgttcctggccctttcctctcagggggcagcaggaagtgaggagaaagggctgggatgggaggcgggagcggatgggagggaatggggtttatcaagtcctcggcgagctgcccaacgggcagcagctggcgcaagtagcctagctggagaggctcaccccaggaaggagggaggccaccgacctactgggccgacggactcccacacagttcctgagctggtgccaggcaggtgacacctcctgcagcccccagcatgcgggcaggcccaggccccaccgttacattggccctggtgctggcggtgtcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggccgcaactttgtgagcttccgtgttcaggaggcccttcgtgtggctcgcacccaccatgccaaccatgcactcccagtctacgtcttcacacgacccacctacagccgcaggctcacggggcttagtgagatggacctcatctctaccattggcgagagtgcggccctgggcgcagctggtgtcatcctctggggtgacgcggggtacaccacaagcacggagacctgccagtacctcaaagattacctgacacggctgctggtcccctacgtggtcaatgtgtcctgggccacccaatattgcagccgggcccagtgccatggccatgggcgctgtgtgcgccgcaaccccagtgccagtaccttcctgcatctcagcaccaacagtttccgcctagtgcctggccatgcacctggtgaaccccagctgcgacctgtgggggagctcagttgggccgacattgaccacctgcagacacacttccgctgccagtgctacttgggctggagtggtgagcaatgccagtgggaccataggcaggcagctggaggtgccagcgaggcctgggctgggtcccacctcaccagtctgctggctctggcagccctggcctttacctggaccttgtaggggtctcctgcctagctgcctagcaagctggcctctaccacaagggctctcttaggcatgtaggaccctgcagggggtggacaaactggagtctggagtgggcagagcccccaggaagcccaggagggcatccataccagctcgcacccccctgttctaagggggaggggaagtccctgggaggccccttctctccctgccagaggggaaggagggtacagctgggctggggaggacctgaccctactcccttgccctagatagtttattattattattattttggggtctcttttgtaaattaaacataaaacaattgcttctctgcttgga

SEQ ID NO: 4230 - DNA, 2318 bp, Homo sapiens
gggtttatcaagtcctcggcgagctgcccaacgggcagcagctggcgcaagtagcctagctggagaggctcaccccaggaaggagggaggccaccgacctactgggccgacggactcccacacagggctggcggcgccgcggagctgggaggactgaaccaccggcctcgggctgcaggggaaacatttcaggctgactggcgctcgtggctgagactcccatagaaagcccggctcagaggggcattagggtcctaaatgggcggccacgtccctctgcagaggacctggggctcttcgagcccgaaacgaggcaccggcaccgagaaaggtggaccacaccttcccgccccgtccgcaagtccaatcccgggcccacctccgcactggagtcttaaagggccagcgtgcctgggggcggagccagcagaggcgctgagccgggccgcgcctgggcgaacggccggagcgggctgggctgggcccgggatggcggtggccctggcgccggtcccggtggcgccccgcgcgagttcctgagctggtgccaggcaggtgacacctcctgcagcccccagcatgcgggcaggcccaggccccaccgttacattggccctggtgctggcggtgtcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggccgcaactttgtgagcttccgtgttcaggaggcccttcgtgtggctcgcacccaccatgccaaccatgcactcccagtctacgtcttcacacgacccacctacagccgcaggctcacggggcttagtgagatggacctcatctctaccattggcgagagtgcggccctgggcgcagctggtgtcatcctctggggtgacgcggggtacaccacaagcacggagacctgccagtacctcaaagattacctgacacggctgctggtcccctacgtggtcaatgtgtcctgggccacccaatattgcagccgggcccagtgccatggccatgggcgctgtgtgcgccgcaaccccagtgccagtaccttcctgcatctcagcaccaacagtttccgcctagtgcctggccatgcacctggtgaaccccagctgcgacctgtgggggagctcagttgggccgacattgaccacctgcagacacacttccgctgccagtgctacttgggctggagtggtgagcaatgccagtgggaccataggcaggcagctggaggtgccagcgaggcctgggctgggtcccacctcaccagtctgctggctctggcagccctggcctttacctggaccttgtaggggtctcctgcctagctgcctagcaagctggcctctaccacaagggctctcttaggcatgtaggaccctgcagggggtggacaaactggagtctggagtgggcagagcccccaggaagcccaggagggcatccataccagctcgcacccccctgttctaagggggaggggaagtccctgggaggccccttctctccctgccagaggggaaggagggtacagctgggctggggaggacctgaccctactcccttgccctagatagtttattattattattattttggggtctcttttgtaaattaaacataaaacaat

SEQ ID NO: 4231 - DNA, 1635 bp, Homo sapiens
gaccaaagggtgcggctgctgcagaggtggctgatgcaggtttccatccttggggaatgaccacgcaactgggcccagccctggtgctgggggtggccctgtgcctgggttgtggccagcccctaccacaggtccctgaacgccccttctctgtgctgtggaatgtaccctcagcacactgtgaggcccgctttggtgtgcacctgccactcaatgctctgggcatcatagccaaccgtggccagcattttcacggtcagaacatgaccattttctacaagaaccaactcggcctctatccctactttggacccaggggcacagctcacaatgggggcatcccccaggctttgccccttgaccgccacctggcactggctgcctaccagatccaccacagcctgagacctggctttgctggcccagcagtgctggattgggaggagtggtgtccactctgggctgggaactggggccgccgccgagcttatcaggcagcctcttgggcttgggcacagcaggtattccctgacctggaccctcaggagcagctctacaaggcctatactggctttgagcaggcggcccgtgcactgatggaggatacgctgcgggtggcccaggcactacggccccatggactctggggcttctatcactacccagcctgtggcaatggctggcatagtatggcttccaactataccggccgctgccatgcagccacccttgcccgcaacactcaactgcattggctctgggccgcctccagtgccctcttccccagcatctacctcccacccaggctgccacctgcccaccaccaggcctttgtccgacatcgcctggaggaggccttccgtgtggcccttgttgggcaccgacatcccctgcctgtcctggcctatgtccgcctcacacaccggagatctgggaggttcctgtcccaggaggagtgctggcatctccatgactacctggtggacaccttgggcccctatgtgatcaatgtgaccagggcagcgatggcctgcagtcaccagcggtgccatggccacgggcgctgtgcccggcgagatccaggacagatggaagcctttctacacctgtggccagacggcagccttggagattggaagtccttcagctgccactgttactggggctgggctggccccacctgccaggagcccaggcctgggcctaaagaagcagtataaagccagggcccctgccactgcctcttcttttccctgctgccacttttccagtcctggaactactctgtcccactcttgctctattcagtttacagtcaaccctcccaagcacacaccccgcttcccttggaatccctgaggggtagaaggggccagaaaaaacgcttataaaaccagaggccctctgagatcatgtgagtcctccatggcaaggaagcagttccagggagagtcaggttccagctagttagggctgccagcctagggctttgtgcctacacctcactaagcccatggagaggtcacagatgggccgtgcacgggcagatgggccccaaaaaatcttggcgaaggtcggtaaagtgctaagctgttgtctgcactctttcatcataaagtcacttttttccactgc

SEQ ID NO: 4232 - DNA, 1434 bp, Homo sapiens
gcggagccggggctggttggggaccggccgggttccgctcctgctggagcccggtgcgtggaattccacgcgagtgccggggagttcctggggagccgggcttctcttttggcccccagcgtgttgaccgagcccgcttcgcacagcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcgggtgagcgcgcgctcccgggaggggcggggagggcgccccgggtccacccgccctcacaggtccgcctgctcctccgccgcagttcggggccatccacgtgcgttgcctcctgacgcccggccacaccgccggccacatgagctacttcctgtgggaggacgattgcccggacccacccgccctgttctcgggcgacgcgctgtcggtggccggctgcggctcgtgcctggagggcagcgcccagcagatgtaccagagcctggccgagctgggtaccctgccccccgagacgaaggtgttctgcggccacgagcacacgcttagcaacctggagtttgcccagaaagtggagccctgcaacgaccacgtgagagccaagctgtcctgggctaagaagagggatgaggatgacgtgcccactgtgccgtcgactctgggcgaggagcgcctctacaaccccttcctgcgggtggcagaggagccggtgcgcaagttcacgggcaaggcggtccccgccgacgtcctggaggcgctatgcaaggagcgggcgcgcttcgaacaggcgggcgagccgcggcagccacaggcgcgggccctccttgcgctgcagtgggggctcctgagtgcagccccacacgactgagccacccagaccctcacagggctggggcctgcgtccctcctcgtgacctcggccagctggacccacatgagggccacctctggaaccttcttcgaggccctggccagccatctgcccagcctcggagggtgggcaacctggtgcttcccgggtggacacacaggaccactcagtggggcctgtgtgggcgccgagacctgggtgtctgggaagtggggcacacggggcctccgaactatgaataaagctttgaaaggcc

SEQ ID NO: 4233 - DNA, 1347 bp, Homo sapiens
gccggggctggttggggaccggccgggttccgctcctgctggagcccggtgcgtggaattccacgcgagtgccggggagttcctggggagccgggcttctcttttggcccccagcgtgttgaccgagcccgcttcgcacagcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcggttcggggccatccacgtgcgttgcctcctgacgcccggccacaccgccggccacatgagctacttcctgtgggaggacgattgcccggacccacccgccctgttctcgggcgacgcgctgtcggtggccggctgcggctcgtgcctggagggcagcgcccagcagatgtaccagagcctggccgagctgggtaccctgccccccgagacgaaggtgttctgcggccacgagcacacgcttagcaacctggagtttgcccagaaagtggagccctgcaacgaccacgtgagagccaagctgtcctgggctaagaagagggatgaggatgacgtgcccactgtgccgtcgactctgggcgaggagcgcctctacaaccccttcctgcgggtggcagaggagccggtgcgcaagttcacgggcaaggcggtccccgccgacgtcctggaggcgctatgcaaggagcgggcgcgcttcgaacaggcgggcgagccgcggcagccacaggcgcgggccctccttgcgctgcagtgggggctcctgagtgcagccccacacgactgagccacccagaccctcacagggctggggcctgcgtccctcctcgtgacctcggccagctggacccacatgagggccacctctggaaccttcttcgaggccctggccagccatctgcccagcctcggagggtgggcaacctggtgcttcccgggtggacacacaggaccactcagtggggcctgtgtgggcgccgagacctgggtgtctgggaagtggggcacacggggcctccgaactatgaataaagctttgaaaggcc

SEQ ID NO: 4234 - DNA, 1820 bp, Homo sapiens
ccgggcacgcgcaccgccggcgggccttgtggtctcatcgcgcgcaggatccgggccgggcgggggcgggggcggggcgcgtccgcggaggggggcggttggcggctcccgagcccagcgccgcgctcagtccggaccccgtgaccggcggccgaggccccgcctccgtcagtctgtccttcgggtcctcagcacagccgtgccgcccttcctagggtgtggagagcgggccccgccctgaaggggcaccgtgggctggggggcctgttttggagcaggcaccggtggccgagctccgtgaccatgaaggtcaaggtcatccccgtgctcgaggacaactacatgtacctggtcatcgaggagctcacgcgcgaggcggtggccgtggacgtggctgtgcccaagaggctgctggagatcgtgggccgggagggggtgtctctgaccgctgtgctgaccacccaccatcactgggaccacgcgcggggaaacccggagctggcgcggcttcgtcccgggctggcggtgctgggcgcggacgagcgcatcttctcgctgacgcgcaggctggcgcacggcgaggagctgcggttcggggccatccacgtgcgttgcctcctgacgcccggccacaccgccggccacatgagctacttcctgtgggaggacgattgcccggacccacccgccctgttctcgggtacccgcagcgcggagcgcgcccaccccgcctcccgccggccccgccccatctgctctgacccgccctcccccgccaggcgacgcgctgtcggtggccggctgcggctcgtgcctggagggcagcgcccagcagatgtaccagagcctggccgagctgggtaccctgccccccgagacgaaggtgttctgcggccacgagcacacgcttagcaacctggagtttgcccagaaagtggagccctgcaacgaccacgtgagagccaagctgtcctgggctaaggcacggcccctttcccgccgcggcaagagggtggggggggagggaacaggcttcggggtggggggggctctcagacaaggcctaatggtgaccggggcctgtggtcactccagaagagggatgaggatgacgtgcccactgtgccgtcgactctgggcgaggagcgcctctacaaccccttcctgcgggtggcgtgagtatggctgttgtcccggggcctccaccgttacgtggacccttaggaaggcatctggggactgcgtgttgggctgagtgagcatctctggcttgggggaggctgctcattaagtgcctgcctgcccgcccacccctcggcgccatgctcccgcgtgggcagcgggccctgcgcctcactgcacccctccctgcagagaggagccggtgcgcaagttcacgggcaaggcggtccccgccgacgtcctggaggcgctatgcaaggagcgggcgcgcttcgaacaggcgggcgagccgcggcagccacaggcgcgggccctccttgcgctgcagtgggggctcctgagtgcagccccacacgactgagccacccagaccctcacagggctggggcctgcgtccctcctcgtgacctcggccagctggacccacatgagggccacctctggaaccttcttcgaggccctggccagccatctgcccagcctcggagggtgggcaacctggtgcttcccgggtggacacacaggaccactcagtggggcctgtgtgggcgccgagacctgggtgtctgggaagtggggcacacggggcctccgaactatgaataaagctttgaaaggccgttgtcagtgttggcaga

SEQ ID NO: 4235 - DNA, 3264 bp, Homo sapiens
atccgcctgggcgtcacgcttcgtggggcgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtgggtgtgatcagcactggaaaagatgcctgcccctgctgccacatatgaaagagtagtttacaaaaacccttccgagtaccactacatgaaagtctgcctagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaagttatggttccagaagcttccaaatcctgaaatagatgttttaaagatgcaacctcaaacaccaatgctgttgttaaagagcctatggggaattgctgctctttaccaaagaatggttgataggcccagaagcccatcttagttaggggaagggagcaggaagagggttgttcaaatgcccactttccagtttggccttatgcttcatgcagacttgagtgtatgcaggatttcattatctgcctgggttttttgtttgttttttgttttttaattcaagaagtaggctgggcccggtggctcatgcctgtaatcctggcactttgggaggctgcggcaggcggatcacttgaggtcaggagtccaagaccagcctggccaacatggtgaaaccccatctctaccaaaaaaaaaaaaaaaaaaaaagtgcaactagctgtgcttggtgacttggccctgtagtcccagttgcttgggaggctgaggtgggagaattgcttgggcctgagagctggaggttatggtgagaaactgagattgcaccactgcactgtagcctgagtgacagagcgagaccctgtctcaagaaagaagtattgggaaggttatttaaagactctacttttaaatcaggcgtggcagctcacgcctgtaatcccagcattttgggaggctgaggcaggcgaatcacttgaggtcaggagttcaagaccagcctggccaacatgtgaaaccccatctctactaaaaatacaaaaactaaccgggcatggtggcgggcacctgtaatcccagctacttgggaggctgaggcaggagaatctcttgaacctgggaggttgcagtgagctgaaatcacaccactgcacttcagcctgggtgacagagcaaaactccacctcaaaaaaaaaaaaaagattctacttttagaaattcagacctagatagatttgcatttggataacaaatccctacctatagccatgtggaagcagcttgtcactgtattttaactgtgtaacaattattgaaggcgaaaatagaagttgggtcatctttgaacacctaccttttatcaatgaatatttttagactgttcttcagtatctgagtcagagtttattgtaatttgttatttacaccaaggtggcatcttagtctaccttcagtgagacttgcgtttcaggggaggggcgtatgtgcatcctcggtctcagttatgtaaacggtctgatctgtaaaatagtggtagcacatgccatgtgggatagttggtggagatgatagatggagttaagcacagggcccagcctgtcagcagtagctactattattgttgcccatttcccctgcaactgaggtgagaggttttcctgagtttgaagctgactggcccacagttaaacgtaacagaccagtttttcagggtgtcagccaacctctattagtgttcttaagtacagtttctgttataaaagttcagattattccttgaaaatttggatctacctcccattattatgagtaatacatgcttatagtaaaaaaaaaaaaattgtaagaaataaatattaagaagattatggaggccaaattcttaagactttgggggctggggtcagggaggttatattgaaggggagatgtgcctaacatgttactactaaatggccatcccaacacagccaacacttttgtttcccatttttttttgtttcccgttttttaataaaattgagatataattcacataccataaaattcaccttttaaaagtgtacagtttagtggttttcagaatatccacaaagttgtacaaccatcaccaaatcaattttttatagcatttttcatcacccccaaaagaacctcccattagcagtcaatccatttctctcctccagtctttgggaatcaccagtctactttctgtctctatgggtttccctgttctggacatttcataaaagttcatacaatgtatgatcctttggaactggcttctttgatatagcatgttttcagggttcatccatgttacagcatgtatcagtacatcattttattttatggctgaataatattccattgtatttacccata

SEQ ID NO: 4236 - DNA, 2137 bp, Homo sapiens
ttcgtagtttcctgataaccattcagtcatctatttcaacaccctgacatgacataaaggcaggcacggaaccacacgttcaccatacagacacacgccactttgctggagcattcactaggcgaggcgctccatcggactcactagctgcactcatgaatcggcaccatctgcaggatcactttctggaaatagacaagaagaactgctgtgtgttccgagatgacttcattgccaaggtgttgccgccggtgttggggctggagtttatctttgggcttctgggcaatggccttgccctgtggattttctgtttccacctcaagtcctggaaatccagccggattttcctgttcaacctggcagtagctgactttctactgatcatctgcctgccgttcgtgatggactactatgtgcggcgttcagactggaagtttggggacatcccttgccggctggtgctcttcatgtttgccatgaaccgccagggcagcatcatattcctcacggtggtggcggtagacaggtatttccgggtggtccatccccaccacgccctgaacaagatctccaattggacagcagccatcatctcttgccttctgtggggcatcactgttggcctaacagtccacctcctgaagaagaagttgctgatccagaatggcactgcaaatgtgtgcatcagcttcagcatctgccataccttccggtggcacgaagctatgttcctcctggagttcttcctgcccctgggcatcatcctgttctgctcagccagaattatctggagcctgcggcagagacaaatggaccggcatgccaagatcaagagagccatcaccttcatcatggtggtggccatcgtctttgtcatctgcttccttcccagcgtggttgtgcggatccacatcttctggctcctgcacacttcgggcacgcagaattgtgaagtgtaccgctcggtggacctggcgttctttatcactctcagcttcacctacatgaacagcatgctggaccccgtggtgtactacttctccagcccatcctttcccaacttcttctccactttgatcaaccgctgcctccagaggaagataacaggtgagccagataataaccgcagcacgagcgtcgagctcacaggggaccccaacaaaaccagaggcgctccagaggcgttaatcgccaactccggtgagccatggagcccctcttatctgggcccaacctcaaataaccattccaagaagggacattgtcaccaagaaccagcatctctggagaaacagttgggctgttgcatcgagtaatgtcactggactcggcctaagatttcctggaacttccagattcagagaatctgatttagggaaactgtggcagatgagtgggagactggttgcaaggtgtgaccgcaggaatcctggaggaacagagagtaaagcttctaggcatctgaaacttgcttcatctctgacgctcgcaggactgaagatgggcaaattgtaggcgtttctgctgagcagagttggagccagagatctacttgtgacttgttggccttcttcccacatctgcctcagactggagggggctcagctcctggggtgatatctagcctgcttgtgagctctagcagggataaggagagctgagattggagggaattgtgttgttcctggaggaagcccaggcatcattaaacaagccagtaggtcacctggcttccgtggaccaattcatctttcagacaatctttagcagaaatggactcagggaagagactcacatgctttggttagtatctgtgtttccggtgggtgtaataggggattagccccagaagggactgagctaaacagtgttattatgggaaaggaaatggcattgctgctttcaaccagcgactaatgcaatccattcctctcttgtttatagtaatctaagggttgaacagttaaaacggcttcaggatagaaagctgtttcccacctgtttgcttttaccattaaaagggaaacgtgcctctgccccacgggtagaggggtgcacgttcctcctggttccttcgcttgtgtttctgtacttaccaaaaatctaccatttcaataaattttgataggagaca

SEQ ID NO: 4237 - DNA, 1351 bp, Homo sapiens
agactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccaggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtg

SEQ ID NO: 4238 - DNA, 1411 bp, Homo sapiens
agtgtcctggttactgcagcggcagcaacagcaggtcctactatcgcctccctctagtctctgcttctctggatccctgaggagggcagaaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtgt

SEQ ID NO: 4239 - DNA, 1469 bp, Homo sapiens
gacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggtgagtgctgagccggtgaccagcacactttgggcttctggacgagccgtgcagcgattggccccaggttgccatcctcagtcgtctattggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccaggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaagg

SEQ ID NO: 4240 - DNA, 1115 bp, Homo sapiens
gtgatccctctctcgctaaccgtaggcgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctctccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgtgagtatcagcctcgaggagacacagtagagggcttgagttggctacgttcatactgggataggcggggccacccagaggctggccagtgagggcccgcacaccacccacgtgcctccagacagcgagtgacatcccatctcctcctctgcattaaagatgacctgctgaacattg

SEQ ID NO: 4241 - DNA, 768 bp, Homo sapiens
atggggctgggggccgtccccgggagacaggcggccttccgagagggactggagcaggccgtgcggagtgggcattgcttgatgggcaggaagttgagtgttccttgcaagggtgctgtggcaagaggaggcctggtgtatttggcagcgttcctgaggctggacatgatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgtgagtatcagcctcgaggagacacagtagagggcttgagttggctacgttcatactgggataggcggggccacccagaggctggccagtgagggcccgcacaccacccacgtgcctccagacagcgagtgacatcccatctcctcctctgcattaaagatgacctgctg

SEQ ID NO: 4242 - DNA, 796 bp, Homo sapiens
cgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgtgagtatcagcctcgaggagacacagtagagggcttgagttggctacgttcatactgggataggcggggccacccagaggctggccagtgagggcccgcacaccacccacgtgcctccagacagcgagtgacatcccatctcctcctctgcattaaagatgacctgctgaa

SEQ ID NO: 4243 - DNA, 1066 bp, Homo sapiens
cgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctctccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgagacacagtagagggcttgagttggctacgttcatactgggataggcggggccacccagaggctggccagtgagggcccgcacaccacccacgtgcctccagacagcgagtgacatcccatctcctcctctgcattaaagatgacctgctgaa

SEQ ID NO: 4244 - DNA, 1025 bp, Homo sapiens
cgcggactccgcccggcccggcctccccaggcatggcgccgctgcgcttctccgccaatctgtcctggctattccccgagctctccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggagtgggcattgcttgatgggcaggaagttgagtgttccttgcaagggtgctgtggcaagaggaggcctggtgtatttggcagcgttcctgaggctggacatgatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgtgagtatcagcctcgaggagacacagtagagggcttgagttggctacgttcatactgggataggcggggccacccagaggctggccagtgagggcccgcacaccacccacgtgcctccagacagcgagtgacatcccatctcctcctctgcattaaagatgacctgctgaacatt

SEQ ID NO: 4245 - DNA, 2871 bp, Homo sapiens
ggaaagatttttgagtctacaactgacaaaatgtcttcttcaaattaaaaaaaattgagaagcagcactttaagtctaactctacaccattttattgcatgtattagttttattaatgatttttggtgcatgcctttgggcttattcaaaagtgtacaataggaaagtatatttcctttcttagaaaggagatgttttctactttgcaacatgtgattacaaaaatcttcctctgtgggaagattaaccatgtattgaactactgaaaagtatatatttttagatatacagaaggaatctacatggagcagcattcagacctatatagaagtcatagcattctgtataggaccaaaaaggaaataacattaaacacttaaacagacgttgttgggtagaaatacctttagatcttgcatttacttccaaaaagaaaaaatgccacagaagtttgctgaaaacttttgtcgtttgaattttctctgtcagtgtatttagcccaaatacaacagctttgggttagcacacacataagaatcaaaaaaacaaagctcactaaataaatcagtctggtttgccaatccagcttgactgaaataagtaaaccaatcacttgcaacatgaaaaactgtccaactcctctaaggttctgacaaaataaccttggctgatgtgggaagactcccactttgattactgacctgacagtgaagattcatgcttgacatgatttcagacttgacaatgtctgtttaaggagctatggtacagtttgctaattcaatcccagatacctgttgattacctgtgagatctagagtccaaagtagccagcagccatatccctgagtgctctgtgcccatcagatatcttaaagtaagcagggttgggacaggtcacagcttggatgattgacctcaggtgccgtagacagccccagattcaagaattgtatctgctttcttggcagtcgtcactgaactaatgtcccatactgtgttacttactgtagatgctctcttttagaggaggcccagagcacacatcctaatcgctagcggtactcagagagggggtgctaactctgatgccctggccaaattccagtttagggatgtgggtcttcttcttgtcattctaattggaaatgtgcatcacttcccatttttcttactgatctcagtgcaaactacactagtctgtttctttgccctggtctcaagtctctaagacgctggtgtgtattatgtgggctaagttcatgtgttatcctaaggcacaagagttgaggaatgggtgagcttggtgtcagagcactgtgtggttggagggtggactcttgtgatgctgtggggatgaaattggccctcttttagcataagttggggagtgtgcactggctggaggcttccagaggcttccagccatgaggtgtgagctgaaaccaatttttcctctttccttatagcatgttgagaaaatctgttgggttttcagcagtcagggaaggccggagttctgctttaatctgggtaactgaggctaatatgagcaagactttggttaattaactgggttctcagatgccacagactccgtgagaagtcaccattattttcaatggttgtgatagaatttcccccagtagccattattttaagattatattgcagagttgctttattttgagctttttgtgtatacacaatcccaaactggaagaaattttaaaaaaaggaatcctgctgtgaaaggtatatattactctagatttttcttactgtaaatattgtaagattgtaatactgtcgatattttattaaccaacaaatgttaatctatgtgaaatcagacttattttaaatgtgcttcttatttactgtgtgtggtccctgttgctgacagtattaagttatattctgatgtaagattaactttattaaagaatgtaaacattaatgtttccttatgggaaaacaaataaagtataaagaagacaattcttttcattgaaatatactgtgtatttacacttgctagacccagcaccacttataaatttagtacactgttcagaattttagttaacacagctgacatggttgtgctctgtttgaaagtctaagaataggtattgttggaatatacagtttgtatttgtctgctgtgaatcataatcttgaaatttctaatcaagtttgtaaaatttttatagtgaaacattttaatgacaatttaaaaatttatcttctctaaagaatggtcaaaacaatatcctttcagaaatagaattgttctttaatatctttccaaaatgactttggttaaatggaccagatgtatattagttaaaatttaggactaagttgttgatattctttgagtttacaagttaatccttattggagatgtgccaatatacagttagaatatcattaatttgcactgtttggggaccccatttaagaatgctgaattttgccaactaagaagtaagcaaatgcaatttaaaaagtaaatttgagcattctgtattaaatatgtgcagttattatcacatgaagaaacgcagtgtgtcgggctgtaatattaccatatttgctgtcatgttctcccatctcagtgctgggaaatcaccatgtggaaaccaagcaaacgtgttgtgcatcagccggcttgagtttgttcaatatcaaagctgaaaactagcgaggtctgctgtactgcttattgaagtattgtgattattttaggcattgattcttacaaaatatatactgtaacagtatactttgtacagatttaaattttatttgaaaaaatgaaataaagtaggcaaaaaaataaagatgtttatttttcatgtgact

SEQ ID NO: 4246 - DNA, 2606 bp, Homo sapiens
atgcccccccctgcgcccggggcccggctccggcttctcgccgccgccgccctggccggcttggccgtcatcagccgagggctgctctcccagagcctggagttcaactctcctgccgacaactacacagtgtgtgaaggtgacaacgccaccctcagctgcttcatcgacgagcacgtgacccgcgtggcctggctgaaccgctccaacatcctgtatgccggcaatgaccgctggaccagcgacccgcgggtgcggctgctcatcaacacccccgaggagttctccatcctcatcaccgaggtggggctcggcgacgagggcctctacacctgctccttccagacccgccaccagccgtacaccactcaggtctacctcattgtccacgtccctgcccgcattgtgaacatctcgtcgcctgtgacggtgaatgaggggggcaatgtgaacctgctttgcctggccgtggggcggccagagcccacggtcacctggagacagctccgagacggcttcacctcggagggagagatcctggagatctctgacatccagcggggccaggccggggagtatgagtgcgtgactcacaacggggttaactcggcgcccgacagccgccgcgtgctggtcacagtcaactatcctccgaccatcacggacgtgaccagcgcccgcaccgcgctgggccgggccgccctcctgcgctgcgaagccatggcggttccccccgcggatttccagtggtacaaggatgacagactgctgagcagcggcacggccgaaggcctgaaggtgcagacggagcgcacccgctcgatgcttctctttgccaacgtgagcgcccggcattacggcaactatacgtgtcgcgccgccaaccgactgggagcgtccagcgcctccatgcggctcctgcgcccaggatccctggagaactcagccccgaggcccccagggctcctggccctcctctccgccctgggctggctgtggtggagaatgtaggcgcaacccagtggagctcacctccccctgcagggggcctcaggccaagagtgagagaaacgggggagcaagagccgtgggtctcgtgggggcagaagagctctcggccaccaaggaagaagagagaggagaagaggaggaggcagaggaagaaagatcttcagagaacccatcactgtgagggataacgcaaaattatgcatctttctacagccattctcgccacccgttcacgtttccgattgtgacccactcccgccaccccatacccctctctcttagctcaggctgtcaactggcttgtgtgggtgtgggtgtgtgagtgtgagcctgcatgcatgtgtaggtgtctgtgtctctgtttgtgtgtgtgtgggggggtgggctgggggaagggactcagccgtcctcccgcccccaaaacccccatgtccactgtccccaaccctattgcctctcacctctggctggaggtaggtatgaggctctgcagtggaagctgtgaagagaggcttaccaggctccctgcttccccaatatatgcacgcacactacccctccccctgtcgaaagggcaactcctggcaggttgggagtggggaggggcatcgcactcacctgtcaagctgtcattcagcctttgtgagtaagtgggggacctccatctaggctctgggcttccctgctgtcaaccaccagcttcctgtagccagaggccccatcgctggctcagtggcctgagaccttcccacttttcctgtccctccacaccctggattttctggccccctcctgggccaatcggtgcttccatccaactgtcagactggtggcaggagtcacctgtctgtttcagtgctttgccctacccttgccaccactccccttggccttgatttccccacctgcggcaccagccagctgcccttggggcctttgcagctggcccacaggtgtgagcttgctggtctatcacttcctggcctctccaccaactgtacctcccaaaggctacctgaccgccctcacagacactcagacgcaccacacacacatacacacacacagacacacacacacacacacacacacacaccagcgactgtgaccagcaatagccccctggctccagctgtccggtagctggtgactagctgtatttccccctgggtaggcatctggtgtcaggaagggacgctgagaggccgcagcctcagctctgactgtaggaacactccaccctggtacaccacaccacacaaagtgggggacagagaggcatcacacagacatcctgagcccagacaaagatgccatgtcaccaactccgactcccaggagaccctctatataaacacccaccccaaaccacaccacccagagtctggtggagaaaaggagagggcaaggcgcagtgactgtacctcagacgggggcatgggccccatcccacattgtcttccattcccagggtccaggggatggggtgggacaggggagggatgctagggagggggtggggggccctgggggccatgtgttccaattcatggggagtgttgagaccaccacaccaataaacgcctttttccaaa

SEQ ID NO: 4247 - DNA, 2706 bp, Homo sapiens
actcattgctttggcgccgtctggggagcgcgagcccgcgggtggcgcgcggcgcatggtggcggctcctttcggagcgcagccgaacctctgacccggactccgttacccctgcccggcgcgccccggcggccggctggaggcagaaacagcagaagcgttaacagcagcagcggcggcggctgctccgccgccgtctccgcgggagcatggagtgcgccctggacgcccagagcctgatcagcatctccctgcgcaagatccacagctcccgaacccagcgcggcggcatcaagctgcacaagaacctcctggtgtcctacgtgctccgcaacgcgcgccagctctacctgagcgagcgctacgccgagctctaccggcgccagcagcagcagcaacagcagcagccgccccaccaccagcaccagcacctagcgtacgcggcgccgggcatgccggccagcgcggccgacttcggcccgctccaacttggcggcggcggggacgcggaggcgcgcgagccggccgcccggcaccagctgcaccagctccaccagctccaccagctgcacctccagcagcagctgcaccagcaccagcacccggcgcccaggggctgcgcggcggcggcggcggccggagcgcccgcgggcggcgcgggggcgctctcggagctgcccgggtgcgccgcgctccagccgccgcacggcgcgccccaccgcgggcagcccttggagcctctgcagccgggtcctgcgccgctgccgctgccgctgccgccgcccgcgcccgctgcgctctgcccgcgggaccctcgcgccccggccgcctgctccgcgcccccaggggccgcccctccggccgccgccgcttctccgcccgcctccccggcccccgcctcctcccccggcttctaccggggcgcataccctaccccttcggacttcggcttgcactgcagcagccagaccaccgtgctggacctagacactcacgtggtgaccacggtggagaacggctacttgcaccaggactgctgcgcctccgcccactgcccctgctgtggccagggcgctccgggaccgggcctggcgtccgccgccggctgcaagcgcaagtattaccctggccaggaggaggaggaagacgacgaggaggatgcgggcgggctgggggccgagccccccgggggcgccccgttcgccccctgcaagcgcgcccgcttcgaggacttctgcccggactcgtccccggacgcgtccaacatctcaaacttgatctccatctttggctccggcttctcggggctggtgagccgacagccggactcctcggagcagccgccgccgctcaacgggcagctgtgcgccaagcaggcgctcgccagcctcggcgcctggactcgagccattgtcgccttctagggacccccgagggcacagggacccggggccccgcggggctggggccagacaaagactcggcaaaggggcgagaggagggaacgagcgggcgccgggccactcggggctgagctgggggcgagcgggggcaggcggctgatgttttataaattgtaaaataaaaaaaaaagaaatctaaaatcttggactttatttttgcagagagaaaaagcgcctatttaagtatgctttgtgtttctcctactcctttttttctttttattgtagtgattgcagtggtgtttagcgaggagcctaccacgtgagggagggctgctgcccggaggaggtgccgggcagccgggggcgaggcagggcgccctggccgccggggcgcgccgggggcgcagctcaggagggcgccggacctgggaagccgattccaatcagttgtcagacccgggaagcccgacgttccgctctcccgagtccctctgtggggtgaggaatgggtcttgtgaaattctgagcaaaaacaaaggcaaactctatctccgaaagggacgtttgggtcacatttcctctctgggggcggactccaaagttctcaaaatgagaaggcagaaatgaaaacacttcaactttttttttcttttcttcccggggcgggtgtcttgaacccctcttctccccgcccctctggctccgttctcctcccctcctccacccgtctcccggactcgggggtggcgcctgacaccccgacactctcggacactgggtaaggggtggggggcgggcacggcggactacatttcccatcatgcctagcactgcggtcctcactaaacaaaaaaggaagtcaattccttcacctggatccccggcggccccgggggagggaggggccgggaccgccgactgcgttggagactttgcactaagttcctggtcagctgtggtgtttgtgtgtgtgcttctaagttgcactgccttggttcagccttcggttgcatttcatgaaaccagcattgttcgagcctgtgagaaccccgtcctgtgtcttcagctcgatagatttgtttaatttaaaagccttttgttgtaaaaaggtggggttcgtctgcagcccctctggttctctgccatcagcaccgtgtggactccaaaacgagttgccaatccttcctttctcggcccttttccctcattaccctgtatttttgtgcatactgaattgtatatcaccgggtaaaactgttcagattgtttaaatttataatcttaataaaaagtcgattac

SEQ ID NO: 4248 - DNA, 1662 bp, Homo sapiens
aggtctggctgaccaataagctgctgcttgctatgataatgggtcctagcaacggtgtctgaccttggctaagagggaaggagatcctatcagtggggagagtgtgaggggagagggagagcctgcagggcaggcgctgaggatcacgcatcctgtgactctcccctgtcccccgccaccctctgaaccactggccaccatggctacttcaaagttgcccgtggtgcctggggaggaggaaaacaccatccttatggccaaggaaaggctggaggccctgcgcacagcctttgagtcgggtgacctcccccaggccgcctctcacctccaggagctgctggcctccacggaaagcatccgcctggaggtgggcgtcacgggcgagtcgggcgcgggcaagtcctccctcatcaatgccctgcgtggcctggaggccgaggaccctggcgcggctctcacgggcgtcatggagaccacgatgcaaccgtcgccctatccacacccacagttccctgacgtgaccctctgggacctgccaggagccggctctccaggctgcccggctgacaagtacctaaagcaggtagacttcagccgctatgacttcttcctgctggtctccccccgccgctgcggggccgtcgagacccgcctggccgctgagatcctgtgccagggcaagaagttctactttgtgcgcaccaaggtggacgaggacctggcggccacgcgcacccagcggccgtcgggcttcagagaggccgctgtcctgcaggagatccgagaccactgtgccgagcggctgcgggaggccggcgtggctgaccctcgcatcttcctggtgtccaacctctcgccggcccgctacgactttcccacgctggtgtccacctgggagcacgacctgccctcccaccggcgccacgctggcctgctgtcgctccccgacatctcgctggaggccttgcagaagaagaaggccatgcttcaagagcaagtcctcaagaccgccctggtgttgggcgtcatccaggccctgccggtcccagggctggcggccgcctacgatgatgcgttgctcatccactcactgcgtggctaccaccgcagctttggtctggacgacgactcgctggccaagctggccgagcaggtgggcaaacaggcaggtgacctgcgctcggtcatccgctccccactggccaacgaggtctcgcctgagactgtcctgcggctctattcccagtcgtccgacggcgccatgcgggtggcccgcgcctttgagaggggcatccctgtgtttgggacgctggtggctggcggcatcagctttggcgctgtctacaccatgctccagggctgcctcaacgagatggctgaggacgcccagcgtgtccgcatcaaggccctggaggatgacgagccgcagccggaggtcagcttggaagtggccagtgacaatggcgtggaaaaggggggctccggggagggaggtggggaggaagccccactctcaacctgcaggaagctcggcctccttcttaagtacattctggacagctggaagaaacacgactcagaagagaaataaagagtgcagccccgcccccctgcctcacccacaaactaagtcttaacaaaatccaaattaccaacaaaaaa

SEQ ID NO: 4249 - DNA, 9685 bp, Homo sapiens
caggttaaagctaccgggacgggtcccggcatctctaaatcaccgctccctggcctcttcggcctccgtccgccgcggcccaggggccgggcttctcagctgctgacctactgccaccgactgcgctctctcccgtgggtcggctttttgctcgccatgcctccgccgcagggtgacgtgaccgccttgttcctggggcctccgggcttggggaagtccgcgctgatcgcagcgctgtgcgacaaggatgtggagacgctcgaggcccccgagggacggccggactccggggttcccagcctaagagctgcgggcccaggcctttttctgggcgagctgagctgcccacccgcagcgccggggccctgggcggcggaagccaacgtgctggtactggtgctgcccggacccgaggggaacggggaaccgttggctccagccctgggagaggcagcgctggccgccctggcccgagggaccccgctactggctgtgcggaacctccgtcctggggattcacagactgccgcccaggcccgtgatcagacagcagctctgctgaacagcgcggggttaggagctgcggatctgtttgtgctaccggcgaactgcggcagcagcgacggctgcgaggagctagagcgcctccgggcggcgctgcagagccaggcagaagcgctgcggaggctcctgccaccggcgcaggatggcttcgaggtgttgggtgcagcagagctagaggctgtgcgtgaggcctttgagaccggcggccttgaggctgcgctgtcgtgggtgcgctcaggcctggagcgcctgggcagcgcacggctagacctggccgtggctggcaaggctgacgtgggccttgtggtggacatgctgcttggattggatcctggcgacccaggcgctgcgcctgcttcggtccccacagcacccactcccttcccagccccagagcgcccgaatgtggtgctctggaccgtgcctctgggccacacgggcactgccaccaccgcggccgccgcctctcacccaacgcactacgacgccctcatcctcgtcacccctggggcccccactgagaaggactgggcccaggtccaggccttgctgctaccagatgcgcctcttgtctgcgtgcgcacagacggcgagggcgaggatccggagtgtctgggagaaggcaagatggagaatcccaagggcgagagcttaaagaacgcaggtggagggggattggagaatgcactcagtaagggaagggagaaatgtagcgctggatcgcagaaagcaggcagcggggaaggtcctgggaaagctggcagcgagggtttgcagcaggttgtcggcatgaagaaatcaggtggtggcgactcagagcgggccgctgcgttaagcccggaggacgagacgtgggaggtgctggaggaggcgccgccgccagtgttccccctacggcctggcggactcccagggctatgcgaatggctgcggcgagcgctccccccagcccaggcaggggcactgctgctggcgttgccaccagcatctcccagcgctgcccgaaccaaggctgcggcgttgcgagccggggcgtggaggccagctctgctggctagtctggcggcggcggcggcaccactcccagggctgggctgggcatgcgacgtggcacttctgcggggtcagctggcggagtggcgacggggcctggggctggaacccacggcactggctcgacgtgagcgtgccctgggcctggcttctggagagctggcagcgcgcgctcatttcccaggcccggtgacgcgcgccgaggtggaagcaagactgggcgcctgggcgggcgagggcactgctgggggcgcagcactgggggctctctccttcctgtggcctgcgggtggtgcagcggcgacaggtggcctgggctaccgagcggctcacggcgtcctgctgcaggctctcgatgagatgcgggctgatgctgaggctgtgctggcaccccctgagcctgcccagtgaggagtgggagggggcttgggagtccagactctgacaggggatgcctgggcttaatcctgggtgcttgaaggggatgtggactcttgacttccagctgggatgtgtgacttcttatcacctggattcagagagtctgggggacaggaatcctgatttttttttttttttttcttttttttgtgagacgaagtctcttgttgcccaggctggagtgcaatggcgcgacctcggctcactgcaacctccgcctcccgggttcaagcgattctcctgcctcagcgtccggagtagctgggattacaggtgcctgccaccacacctggctaatttttgtatttttagtagagacggggtttcaccatgttggccaggctggcctcgaactcctgacctcaggcgatcgacccgctccggcctcccaaagtgctaggattacaggcgtgagccaccgcccctggccaggaatcctgatacctttgggaaccatggtgaatgacatctagacccttctgtcctgaagggagttggtggcccagactctagcagggactatgtctttgtctcctagggagtagaaactggagttactggatgtttagtcctccagggaggctggtagaagtcctgtttcctaattggtggggaggtgtccatgactgggacctgaactccagtataggggagggagacctgagcgccccagggagctggaactcttgggcttcagagcctcagagggaaacagggtctacatttctctgggagaaaaagcctgcacacaggtccccaaggagcagtgggctttgaatcttgatggggtggcggaggcccctggggtctgagacttccggggttctaagatggctgtggaccttggttcctaaatattgggtaaggggaggtctgcatctggaggagggatcgggggcttgtgcgagaaagctggagacttcttgatctctcctggggagtggatgggtttctataattgccctccaaaagcatgtagggagggtggtcccacaaaaatgaggtgaggtgggtaagaggtctgggcatggtgggctctgggagtagccagggaccaggaatgaggtcttttgggtgtggaagggcagtaaagcatacctcagagacagctcctccaaaccttgtattgggatcccggcaactgcctctgtgagtgtgactgggaagggatatgactgccttcatcttctaggtgctgagcaattcaggtgatctctggggagtctgtttctctgtctcttttctttaggagtttctatctttttttggcctttttctcctggtatttaaccataaccctttatggccttggtgttttgtgcaccttccttttcagaagagcagctgtactgctgcactggtccaaacacttctgtatggacacctcgggtatccccaagaggctctgctttctgatgtacatagagggtgctgcattgagccaggggcccaccaaatgggtggtcaggcacttgagaccatgggaatatgccaggagtgaatgaagcaaaggcagaaaccacagtgcctggaatgttctaggctgctagccacatgtgggggaaaagttgcaggttacagaattcttcagtgtcaaaaacagaaaaggaggatctgagaatccaagcgatagaatcccttttgtcgtagacagaaagagcaaagtccagagagggcaggcttgaggcccaacagcacacagtaaggccctgtgggtctggcccttgcctattctcattcactgccccttcccactcctgtccagcctgatagactttccttctttttttttttgaaatggagtctcaccttgtcacccagtctggagtacagggatgtgatgactgtagctgagatgacaggcatgtgccaccacacctggctaatttttgtagtttagtagagaagggatttcaccctgttggtcaggctggtctcgaactcctgacctcaggtgatccacccgactcagactcccaaagtgctgggattacaggtgtgagccatcatggccgcctgactctttctgatgcctgagtggctaccttgagtcctgcctggggacccatgcacctgctgttctctttccttcaaggctctactcacaacttcctgttctactctcaaaccttcctgtgacgggctcagtcagatctcagctcacgtatcccctcagagaggacttcccctccctgaccaccctatctgaagtagctcacattcccccactattcatttcggccagttgagtttccttgtagcaattattactgtcaaaaatgatcttatttatttacctgtttattggcttttgacccgttgcctgtcctgttctctgttgtttccccagcatctagaacaataggtgcctgacacaataggtgcttcgtaaatatttattattattattattattttagagacagggtcttgctctgttgccccggctggaatacagtgggatgatcatggctcactgccatctccaactcctgggctcaaacgatcctcccacctccgcctacagagtagctgggactataggtacacagcaccaaattttctgtagagacgggggtcttgctttgtagcccacactagtgttgaactcctggcctcaagtgatcctcctgccttgatgggattacaggtgtgagccaccacacccagcctaaatgtttatttcattggtcagtgtcagaactaggattggaatttagattgttaatctcttgccacaagataggaaaatggagcaagatgaggagaaaaaagcatttaatgggagagaacacccttgtctgaggtcagggacctgggaagcaagcacgactttgccactgtcactgtgtgttacttggacagtgccttattttcccatctgtgaaataaaagagctggataagaaccttagttttgagatcctgtctcccttaaaagctgaagacaaaggtaactgatccaagggcagacaagggatggtaccatcatctccagcttggactcccactgctgacaaaatttgtcccttcaaagttgagatagctaccatggggaagagcacttagttctatactgaatggctccaggcattttcatgaaagctctttcagctttggggaagaatattcatccatatctttaccccatcatattagtgtctaagccctgcaatcaggcatgtcagccacgtgatggaatgggagggctgcagggcagcactgtccagtagaaacgaaatgcaagccacatatgtcattttaagttttctttttttgagatggagtttcactccatcacccaggctggagtgcagtggcacgatctcgcctcactgcaacctccgcctcccaggttcatgtgattctcctgcctcagcctcctgagtagctgggattacaggcatatgccaccatgcctggctaatttttgtatttttagtagagatggggtttcaccatgttgatcaggctggtctggaactactgacctcaggccacccgccttggcctcccaaagtgctgggattacaggcatgagccaccgcgcccagctaatttttgtatttttattttatttatttatttattttttgggagacggagtcttgctctgtcacccaggctggagtgcagttgtgcgatcttggctcactgcaacctcagcctcccaagtagctgggattacaggcatgcaccatcatgcccagctaatttttgtatttttagtagagatggggtttcactgtgttggccaggctggtcttgaactcctgacctcaggtgatccaccggcctcagcctcccaaagtgctgggattataggcgtgagccactgcacccgtcctaatttttgtatttttagtagagatggggtttcaccatgttggctaagctggtctggaactcatggcctcaagttatctgcccacctcagcctcccaaagtgctgagtaagccaagttttctaatagccacattagacaagtaaaaggaaacaggttaaattcattttaacatgttttacttaacccaatgtatccaaaatagcatttcaacatgtcatcggttttttagttttttttttttttgagatagtgcttcgctttgttgcccaggctggagtgcagtggcacaatctcggctcactgcaacctccaccttccaggttcaagtgattctcctgcctcagcctcccgagtagctgggattacaggcacccgccaccatgcccactaatttttgtatttttggttagagatggggtttcgccatgttggccaggctagtctcaaactcctgacctcaggtgatccacccacctcggcctcccaaagtgctaggattacaggcgtgaggcaccgtgcctggcgtcatcggtattatttaaatgaattatgttacgttcttttgtgctgtcttcaaaatctgttatatattttacacttacaccaaatctcaattaccatggtacatttttatctgaaatgcttgacctttattttgatttcataaaattcatagttggagaagtagattcacatatccaagttgttccaattatataatagttttccaaaaactgagatgggtgtccattttttttttaagtaaagatgcaggtctggttatgttgaccaagttgctgggttgttttgttttgttttgagacagagtctcactttgtcacccaggctggagtgcagtggcatgacctcagctcactgcaacctctgcctcccaggttcaactgattctcttgcatcatcctcctgagtagctgggactacaggtgtatgccaccatgcctggctaattttggtatttttctcagagacggggtttcaccatgttgggcatgctggtcttgaactgctgacctcaggtgatccgcccacctcggcctcccaaagtgctggtattacaggcatgggccaccacacctggcctcagctgttcaattaaaagtaaatacaacttaaaattctatgtttcattggcagtagtgcaacattaatactgagtagccacatgtgattagtggctatggtattggacagggaaggtacagaatacttccatcaacatagaaaattctatcagtctagctctaggggcagatagtccttccactgacttgggcaagtcactctacaaatggcatctacctcacatggttatggtgagaattcagcgtatgtatgtacatgcaggcacacaatatgcacacagacacataacatagtacaccctttcctgaaaagcctgacacatggagctcaaacatgagtgccacccacccctgggcagcaccaagatggctctagtctgggtgcctttgtctcacccccatgcctttgctcggagtgtgctcctcatttttctgccactttgaccctgtctctgatttggtcctgtctgacatcactgctatatgctttgctcctctcaatttcctctgccctcatgccagcaggagtcatgccagagatcatatctgagaaagcaagacaattttgtgtgtgtgtctgtgcccatagaggagtgctggttgtgttgatatagttgtagattggttgtgtttacacagttgtatatattgacacccttgagtgttatgacttcttttgggggtggtcgccttttaaatcataacttttaatgggattccattttagtctttgtgaagacataaggttgttggcaggcatctgtccctgggagcatccaagcagaaaagactaagactcccttgtagacagatcactggccgccactgaagtgtgtctgcatggcaccacagggctggaagacccttgaaggcaggaattcaaggaaatgtatgatgaattttggcattgccatcaaaagcagaacaggcatggaaaacttgggtgagtgggcgagacaacctcctcaccacagcagagttccatccatgcctggataatgatggagggatttgtgtccactgcagtggggaaccatgaaggacacatcaagggtgtggttggcctgtggtgctctttggaggaatgaataaaaatgaatagaaatcctattgcgtgtctgttcttttggagtttgagggaaaagaaagatccttgagattttgactgggctggaaacctagactccagcgtctggggataggagggatggtggggaatccgctgggaaaaactgggctgtgatcaagagaatttatcagtatctgagtttttccaccctggaaggagtgcgggcagacttactgtttaaacattgggagcttatgatggtaaagcgccttagttctggagccaggtatacccattaatgaccccaactgggccagcctttctgtagccatgcccttggattgttgctctccttctaggtttgactatgtggtttgcttcagccactagaacaatagcaaacatgatacaagcagaggcttggaaagtgcttatgcggccgggtgtggtggctcacacctataatcccagcactttgggaggccagggcgggcagatcacaaggtcaggagatcgagaccatcctggctaacacagtgaaaccccgtctctctactaaaaatacaaaaaattagctgggtgtggtggtgcacacctgtagtcccagctactcgggaggctgaggcaggagaatagcttgaacctgggaggcggaggttgtagtgagctgagactgcgccgctgcactccagcctgggcaacagagcgagacttctctcaaaaaaaaaaaaccaaagtgcttatgcactgggacttcctctcttgctccccttgggacccctaccaccactgccacatccaaaccccgggctggctgagcatggtggcatatgggtataaacccataatcccagcacttagggaggcaaaggtggaagaatttcatgagcccaggagatcgagactagcctgagcaacatggcaagacccccatctctacaaaaaagcaacaacaacagaattagccagatgtggtggtgtgcacctgtggtcccaactacatgggggaggctgaggcaagtggattgtttgagcccaggaagtcgaggctgaagtgagctatgatggctccactgcactccagcctgggtgacagagcaagacaatgtctaaaaaaataaaaagaaggaaagaaaaggaaaagatctgggctaacctgctgggtaataaagggaaaagagacacatggctccgtcatccttgatccctgccacccatagccaaccaacctctgaaacagagctccctagctgataggcagctgaacccagctgagaccagcaaaagaactgcccagctgatcccagaccaagttgcaacccagagaatcattaactaaataggtgattgttctaaaccactaaattttggagtggtttgttatgtagcaaaagcaactaatacagacttgttctctctgtgtgtgatgtggtctctttctccccaacaacatgacccaatgattaaaatcttaaattctgccactttttagctgtgtgactgccaatgtgacagccttctgagcctctgatgtctcctgaaaacagagatgtgaataatagtgcctatgacatagagttgtgaaaataaaatgaaaaacagcttctt

SEQ ID NO: 4250 - DNA, 4284 bp, Homo sapiens
ggcaaaggaagaaggagacgggccaccctacagtccaggcactagctgagcctccaaagccgtggacacagcattcgagtgttgggagggactggtcagtgctgaagtctcacaggtgagtgcccacgcctgctgtcaccatgacaaccattcacagccggcagatgctgcaggagcacgtgtccatggagttctccagctccaccacccacgtgcagaccttctcccagacaaccaagatcgtgggagaggaggtcgtgaggaggaagtcctcgagcatagtggagttcttcagcttagtgacccggagctcaaacatccctgcgggcgacagcgtccctgagttcgtggagaagcctcaaccggtcaccgcgcccgagggggacaaagccgtgttccgagcccgggtgcaggggaacgccaaaccccacatctcctggaagagggagagcggcatccccatcaaggagtccgccaagatattctacgacagcattaacaaggaacacgtgctgaagctggagccactgacttcggatgactctgacaactataagtgcattgcaagcaatgaccatgcagatgccatctataccgtatctctgctggtaacagaaggtcaagagaaaatggacttcaaaaagatgctgaagaagagggcaccccctgctcccaagaagaagcagaagaaggtggcaaatgagaaagagatgctggagattttgtccaaagtgcccaagaaagactttgagaaggtgtgcatggagtatggtttcaccgactttcgggggctgctcaggaagctcaaagagatgaagaagaaagtagaggtggaggccatccggattctgaagcccctggaagacaaagagaccaaggttgacaccacagtggtctttgactgcataatggaactgaaagaccccaatgtcaagatgatatggatcaagggtactgagccactgaggatccagtactccctgggcaagtacgatgtgaagcagatgggcaccaagtacatgctggttattagcaacgtgaacatgaacgatgctggcatctacagcctgtccgtgggcgataagcggatgagtgcagagctcacagtgctggatgagccactgaagttcctgggagagatgaagcctgtgaaggtgacagagcgccagacagctgtgtttgagatccgcctctccaagaaagagcccaactttgtgtggaagttcaatgggaaggagctgaagagggatgacaagtatgaaatcacggtgtccgaagatggtctgacgcacacgcttaagattaaggatgccagactcagtgacagcggcgagttctctgctgaggcggggaacctggtacaaaaggcccagctcactgttgaccgcatccccatcaagtttgtgagcaacctcaaaaatgtacgtgtgaaagagaggagtcgcgcatgcctggagtgtgagctgacatccaaggatgtgacactgcgctggaagaaggatgggcagctgctgatgcatggcactaagtacagcatgaaccatgagggcaagcgagcagagctgatcattgaggatgcacagctcagtgatggtggcgagtacactgtggtggccatgcaggatggagaccctactgaatactacagtactgccatcgtcactgtggaggagcgtctggccacagtgaagagcgggatgtccgacgtgcacgcggccactgggagcccagctgagttgtgtgtagtgctgaatgacgagaaggtggagggtgtgtggctgaaggatggcaaggagatcacggacttgccaggcatgcagattgtgaagcagggtgcagtgcacaagctcatctttcccagtatgggccctgagcacgagggcaagtacacattccgggccaagggcacggaaagtgaagcctctgtattcatcgcagatcctcctaccatcgacccgtcagtactggaggcactggctgcgcacgccatcactgtgaaggtaggccacacggcccacatcaaggtccccttccggggaaaaccactgcccaaagtgacatggtacaaggatggcatggaagtgacggaggaggaacgcgtgtccatggagcgcggggaagaccaggcactgctcaccatctccaactgtgtgcgtgaagacagcggcctcatcctgctcaagctcaagaatgaccacggctcagccacggccactctgcaccttagtgtgctggaccgtccaaagcctccacagggccgggtggagttcctggagctctcaggtagttgtgtgcacatgaagtggaaggccccaaaggacaatggtggacgacctgtgacacagttcatagtggaacggagggcagttggcaagaagtcctggattaagataggcgaggtggacggcaaagtcaccaacttctccaccaacaaggtggaagagggaaaagcctaccagttccgtatcctggcagtcaattcagaaggtgtgagtgacccactggagacagaagaagtgtttgcaggaaatcccatagagcctcctggttttgcctcccagcctcaagtgactgatgtgactaaagaagccgtgaccatcacgtggaatgcccctacccaggatgggggagccccagtgctcggctacattgtagaacgaaggaagaaaggcagcaacctgtgggtgccagtcaacaaggaccccatccagggcaccaagtgcactgtggatggtctcctggaggacacagaatatgaattccgagttatagctgtaaataaggcaggccctggacagcccagtgtgccatccagctcagtagtggccaaggatcctgttaaacccccaggcctggtccaggacctgcatgtatctgattcctccaactccagcatttccctggcctggcgggagcctgcagagggagacccaccctctggctacatccttgagatgagggctgaagacacaaaggagtggtccaagtgcacaaagatccccatctcaggcacctgctacacagtgggaggactcatcgagaggcagaaatacttcttccgaatccgggctgtgaatgaggctggggttggggagcctgtggagctagacaagggggtccgtgccatgccaccaccagctgcacccaagtttgacctcagtgcccggctgaagagtcacatggtggttcgcgctgggacagccctctgcatccatgcagccttctctggctcaccaccacctgacgtgatctggcagaaagatggcgttcccaccaagggccgagagacaattaccaagagcaaaaaccactcccagttcctcattaatagcaccaagcgctctgactcaggggtgtaccgaatcttgcttcagaatgagtttggagaagcacgctatgacatccatgtgcgcgtggcagatttccctcggccccccacaaacctacggttgtttgaggaagtccccaacacagtgactctgacctggaaccacagcccagatgtgcaggaggacggtgaggctcactacatcatcatgaagcgggatgcaagcacagccacctggtacacggcagccgagcgtgtcttcagcaacaagtacacagtgacggggctgctcccaggcaggaagtactacttcagagtggtggctcggaatgaaatcggtgacagtgagccacttgactccagggacacctggctcatcaataaggaccagatccaggacctgagcgccaagctcaagccctacgagaagaaggactggcgccacgcgccgcgcttcgtgacgcccctcaagccacacacggtgctccgcggccaggactgcaccatgacctgcgccttccttgggaacccgcggcccacagtgaccctctacaagggcgacgtcaacatcacggccaactccaagttctggtacaactccaccagcggcgtgtgcaccctcgtcatccccacctgcacgctcaaggacagcggcgattacagcgtgctggtggagaacgagctgggcaaggaccgcagcagctgcacgctcaccgtctatgacaaagatgataagtcagttgtagcatccatcaccgagagtctgcagaagaaatcaaagcacctcatgtgagctccagccaagcccaggcatcaggaggctgttatgatgtggagtttcttggcctgtcctctgcatggcccagtgtaggaagcccagtttgctctctggtgtttgttaatgtaaacattcagtgaagggatggggcaataaacgtaactcatcctttcccgtt

SEQ ID NO: 4251 - DNA, 11614 bp, Homo sapiens
gtcaatccagagcctcagcaagcagcagctggaaacggggaagagggagcagacaggaagcgggaggtcagctgtacacccagggtaatagaacttctaccctcagaggagtcaaagaggaggcagaactatggcaggaaagctccggaagtcccacatccctggagtgagcatctggcagctggtggaggagatccctgaaggctgcagcacgccggactttgagcagaagcccgtcacctcggctctgccagaggggaaaaatgctgtctttcgggctgtggtctgtggggagcccaggcccgaggtgcgttggcagaactccaaaggtgacctcagtgattccagcaagtacaagatctcctccagccctggcagcaaggagcacgtgctgcagatcaacaagctgacaggcgaggacacggatctgtaccgctgcacagcagtaaatgcgtacggagaggccgcttgctcagtgagactcactgtcatcgaagttggctttcggaagaatcggaagaggcacagggaaccgcaggaagacctcaggaaggagctgatggacttccggaagttgctgaaaaagagggccccaccagcccccaagaaaaagatggaccttgagcagatatggcagctgctgatgacagcagacaggaaggactacgagaagatctgcttgaagtatggcatcgtcgactaccgtggcatgttgcgcaggctgcaggagatgaagaaggaacaggaggacaagatggcacagtacatcaacaccatctccagcttaagacacatcagggtcaccaaggatgggaatgcaaagtttgacttggagctggatctcaaggattctcagagcaagatttacctgtataaggatggtgagatgatcccctatggcttcaacaaccaaaccaagcactgtctgcgccggctggggaagcgctatgagttccagattcaagacctgaggcctgaggactctggcatttaccaggtcaaggtggaggatgctgtggtcttctccacagaactggaggccagtgccatccccccaagagtggtggtcccactggcggagacccactgtgaggagcagggtgacgcagtctttgaatgtaccctctccagcccctgccctagtgcagcctggcatttccggcaccggctactccaccccagtgacaaatatgaagtgtatgtgtcccctgacgggctgacccaccggctggtggtgaggggggcacgtttctcagacatgggcccctattcgctgggcaccgggctctacacttccagcgcctggctggtggttgaagctgggaaggataaagaccttcagtccacaagtgctgaccacaaactgcagaggcaaggagcccaggcatcaggagcagaagagtctgggagcatcgagagccagggagagaaatccagagagcagggccccagggggggctcccttgaaggggctgggccggcttctgggctccagcacatagccagcccagacagggatggccttggcagacatggctactccttgatgggggacaaagggacagctgactcagcctggggccctggacaggagggcgagggctttccagtagcagagggaagcagagccactcttcccagggaaaatcaatcccacagagagggaggctgggccagaagccttgcagagaggccccatctacagggagagagctcagaatcagggttgggcctcccagaaaaacaacagcaagatcgtggcagagacagcaacagtgatgaatgctggaggaaagcaggaggctgggaggctgggtccagtcggcttcaggctggaggactggggagcagcagggaaggaaaggagcacagaggggacagtggaagacaactggacaggcatgccccagagcaactgtgggatgctcgactgggacctgggagaggaaagagcgacctgcagggatgccagtctgatcctgtagggtcctggccaagaggaaagcagatagagatttcacaggatgacagcctggctgagatggacagaggggatgctccaagtagggaaagggggagaggaatagtagtgtggggtggtgggactggcctgggagaagctggagacagcaatggggcaggaggtcctggcaccctggagcttactggaggaagaggttctggctccaaggtgggcatggcccctgaatcctggggttctcagggaggtagagatgctgactatggggaagccaggggctactgggggtcaggagagttgctagaacagatacctggaggcaaggacttccaggaaccatcaatatcaggtggtagaaaattccttctgggagatgggagtcctgagatcaaagctgaagactcactgcaggaggcagatggtatatgccggggggagtctgtagttacaggaagtgcctacaaaactggccctggaggcccaggagaccccagaggctgcgaaggtgtcctacaggagctcaggggaagggatggccaggaaacagcttgggcctcgggtgaggtagagtatgaccccagaagcttccagtcttcccagggctggacagcaggtcacagagcagcagggggtattggcagaatagaatctaagggcacaagtccttgggatgacacaccatctagcctcagaaaaactggggcccaccatgggcctggagtgctggggcccagtggaggacaagagggtatgggtggtatctgggtggctggactgacggagtctggtcagggggtggatgccagaagccactggctaagtagggctccaggcctgggtgctcagggatctggggggacactaggagataagaaaggattaagaggtcctgggtcaatagggtctgaaccagatttctggaatgggtcagggagctccagagtaaaaggacccagaggtgagacaggctataaggatggcttggaaggtcccgggagaatggaatctaggtacgagggtggcttaggatattctagggaaataagctctaaaagcggggctggttatagctatggctcaggggttccaggagaaatggggtccggccatggtgctggttgtagagtttcccctagggcacctgcgggagtggagtctgaggaagggggtgggtacaggcatggctccggagcgcctgggggagtgtggtctggaaatgaagattctggccctgcaggaggagggtctgggagagttgccagtcttaaaaatggctcaggtggtcctgatggagcacccatgaatgacaccaggaattgggcctctgcatgccaggcaggcatggaccctaggggagggcaccattcagatggtggcctagggagtcctggggtgacagggtctgcgggtagaggtggtctcaaggcccctggagtagtggagactgttgggatgggatgtgtggaagcagaaccagagagctctggaagaataaggccttggggtcagactggaaattatgggggcttcagagcctcagaggccctgggggcctttggagaaggaggctatgaagatggctctgggggtccaggagccatgggaccagggtctctgagggcaggaagcaaagtgggtgagggggatgggacaagatgccctggtgctaaggcctctggagctggagctggttatagggatgataccaggcaccctgagtcactcgcacctcacaatggggccgcttctgggagccagtgggcttatggggctggcaatgtgctgggttatgaggatggatcagaacttccagggcctcagggaactggggtcagaacagcctatggagaaaggtcaaggggccttgggcctaggagtacagggccagggggtgaggcaggctttagagatggttcaggaggcctccaaggaatgggatcagcagatgggccaggttgtaggaagggtattgggagttctggggaaatggggtcagtggataaggaaggttataagaaagatttgggggctcctgagaatatgggttcggggagcaaggcagattatagggatggtgtagggggttctggggcaatggggtcaatggatgaagcaggttataggaaagatttaggggctcctgagggaataagttcagggagcaaggcagattataggggtggtttacaggattccagggaagcgggttcagggagcaaggcagattatagcggtggtttaaagggttccagggaaatcgggtcaatggatgaaacagataataggaaagatttgggggttcctgagggaatgggtgcaggttacagggctggtttaaggggtcctggggagatggggtcactggatgagtcaggtcataggaatgggattggaggttatggggaaatggggtcaggttatagggaggatttgggggctcctgagggaatgggcacagggagcaaggcaggttatagggatggcttaaggggttctggagaaatgaggtcaatggatgaggcaggttataggaaaaatttgggagctcctgagagaatggattcagggagcaaggcaggttacaggggtggtttaaggggttctggggaaatggggttaattgaggcaggctataggaaagatttgggggtttctgagggagggggttcagggagcaaagcaggttataggggtggcttaggttctggggaaatggggtctgtggataaggcaggctataggaaggatttgggggcttctgaggcaataggttcagggagtaaggcaggttttacggatggtttaggaggttctgaagaaatggggtcagtgaataaggcaggttataggaaggatttgggggctcctaagggaatgggttcagggagtaaggcaagttttagggatggtttaggaggttctggagaaatggggtcagtgaatgaagcaggttataggaaggacttgggggttcctgagggaataggttcaggaagtaaggcaggttttagggatggtttagggggttctgaagaaatggggtcagtgaataaggcaggttataggaaggatttgggggctcctaagggaataggttcagggagcaaggcaggttttagggatggtttagggagttctggggaaatggggtcaatggatgaggcaggttataggaagaatttgggggctcctgagggaataggttcagggagtaaggcaggttttagggatggtttagggagttctgtagaaatggggtcagtgaatgaggcaggttataggaaggatttgggggctcctgagggaatgggttcagggagtaaggcaggtttcagggatggtttagggggttctggagaaatggggtcagtgaatgaagcaggttataggaaggatttgggtgctcctaagggaataggttcagggagcaaggcagattttagggatgctttagggagttctggggaaatggggtcaatggatgaggcaggttataggaaggatttgtgggctcctgagggaataggttcaggaagtaaggcaggttttagggatggtttagggagttctgtagaaatggggtcagtgaatgaggcaggttataggaaggatttgggggctcctgagggaatgggttcagggagtaaggcaggtttcagggatggtttagggggttctggagaaatggggtcagtgaatgaagcaggttataggaaggatttgggtgctcctaagggaataggttcagggagcaaggcagattttagggatgctttagggagttctggggaaatggggtcaatggatgaggcaggttataggaaggatttgtgggctcctgagggaataggttcaggaagtaaggcaggttttagggatggtttagggagttctgtagaaatggggtcagtgaatgaggcaggttataggaaggatttgggggctcctgagggaatgggttcagggagtaaggaaggtttcagggatggtttagggggttctgaagaaatggggtcagtgaataaggcaggttataggaaggatttgggggctcctaagggaatgggttcagggagtaaggaaggtttcagggatggtttagggggttctgaggaaatggggtcaatggatgaggcaggttataggaaggatttgggggctcctgagggaataggttcagggagtaaggcaggtttcagggatggtttagggggttctgaagaaatgcggtcaatggatgaggcaggttataggaaggatttgggggctcctgagagaataggttcaggaagtaaggcaggttttagggatggtttagggagttctgtagaaatggggtcagtgaatgaggcaggttataggaaggatttaggggctcctaagggaatgggttcagggagtaagacaggtttcagggatggtttagggggttctgaagaaatggagtcaatggatgaggcaggttataggaaggatttgggggctcctgagggaataggttcaggaagtaaggcaggttttagggatggtttagggagttctacagaaatggggtcagtgaatgaggcaggttataggaaggatttgggggctcctaagggaatgggttcagagagtaaggcaggttttagggatggtttagggagttctggggaaatggggtcaatggatgaggcaggttataggaaggatttgggagctcctgagggaatgggttcagggagtaaggcaggtttcagggatggtttagggggttctgaagaaatggggtcagtgaataaggcaggttataggaaggatttgggggctcctaagggaatgggttcagggagtaaggcaggtttcagggatggtttagggagttctggggaaatggggtcaatggatgaggcagattataggaaggatttgggagctcctgaggaaatgggttcaggcagttacacagattacaggaatggtttaggcagttctggaaaaatcagttcaggggatgaggcaggttataagaatgttttagggggttctgggaggaatccattagggagcgaggcaggttctaggggtagtttggaggattctgggtacattttgtcatggaatgaggcaggttctaggcaaggctttgggggaactagtggcatggggtcagggagtgaggtcagttatagaggaggctcaggaggatctggggaaacgggaccagagggtaagatgggttatggagatggttcagggaggcttggagtaccaggctcactggctggaataggacatgaggctggacccagaggccataaagccatgggtcacaggtcaggatattgggtagcatcagagggtgacacgaactccaaggatggtccagagcgagccagggaaaccaggcttgtggatggggcaggacctggggtggaacctgggatggctggaatgccaggcactgcaggtggcatggcacacagagacagcctcaggggcacaggggtgctggggtctcagggagggcgacagactctttcagatgagcgaggctccaccaaagatcttgggggctatggaacttcagggatccctgaggcctcggaggctgctggtgccaagggaaaaccagatgtcaaagaatggcaagacagttctgggactccagggtcttctagagacagaggggctcccagggtgaaggataggtctccagaccaagcagggataatgggggcttctgggtttcttgatggcaagggggcagtggaaggtgagacctgggcaggaatggctgctctagggtctggatatgaacgggacatctggaaagcaggcccaggaatgacagacaggggtagagttgctggccagggggggttggcatctcagggaggtggggactcacttttgggaggcagaagggtaggctcagggagttcagtggggacaggtcaggatctggacagcggctctatgcctgggggaaggggcaagtcaacatcagggcctgctgatagacaagggacgagcaatgcttgggctcctgattgggaaaaccaggggtttagccaaggcagcatagatgctgggaagcagcccgcaggctccagagcttccggttctctgcaggagaaagatgccgcttttggtgggacccatgaagggccagggggctttaagggtggggagggtgcaccaggccaagaggcggctggtggatgccgaagcccatggtccctggatagcaaaggttcaagtcctggaaggggcagttctgttgatgcagaggactcaggtatcctgggcaaggggaattctactgagtgggggaatgccctcaccccaaaacctggggagtccggacctcagggagcctggaatggcttagatggtccctttggcagaaaagcctctagagataggtcaggagggacccaggacctgagctctcagcgaggcaagggacagagaggaggaaagaggtccctcggggagcaggggtccctggaggctgagaatggtgaggtccagggtcctggggccctaaaggaggatgaagggcagggagtggaagaggctgggaggtcaggcaggaggcctggctcactcaggagcaggtctcaggcacagtcaggggctgaggttggaggaggaaagagaaggggagcagacgaggctggaagcatggggtggcagcctatgggagagaactgggggtgcctggaggagatgctgaatgaagatcagagccgggagccccctggtcaccttggtagcaggagaagtggcaaagacggcaggttggacatctatggagagaggagagatgctacccggagttccacatccagatacaagcctggcactggcagtttctccaaggatgcccaaggccccatgggccacttctcccagggcctggctgacatggaagtgcagccgggggaggccgccacactctcctgtaccctcaccagtgacctgggacctggcacctggtttaaggatggcgtcaagctcaccacccaggatggagtcatctttaagcaagacggtctcgtgcacagcctcttcatcacgcatgtgcaggggacccaagctgggaggtacacctttgtagctggtgaccagcagagcgaggccaccctgaccgtccaggattcccctaccattgctccagatgtgacagagaaactgagagagccactggtggtcaaggctgggaagccggtgatagtgaagatccccttccagagccacctccccattcaggctgcctggaggaaggacggggctgaggtggtgggcagcagtgacagggaggcccaggtggacctgggggatggctacacgcggctgtgcctccccagcgcaggcaggaaggactgtggccagtacagcgtgacactgaggagtgagggaggctctgtgcaggccgagctcactctgcaagtcatagacaagcctgatcccccacaaggccccatggaggttcaggattgccatagggctggcgtctgcctccgctggcggcccccaagggacaatgggggccggactgtagagtgctacgtggtggagagacggcaggctggcaggagcacttggctgaaggtgggcgaggcccccgctgacagcaccaccttcacggatgcccatgtggagccaggcaggaagtataccttccgagtgcgggctgtgacctcagagggggctggcgaggccctggagtctgaggagatattggtggctcctgaggctctccccaaggccccttccgcgccagccatcctgtcggcctccagccagggcatcacactgacatggacagcacctcggggccccggcagcgcccacatcctgggctacctgatcgagaggcgtaagaaggggagcaacacctggacggcagtgaacgaccagccggtgcctgagaggaggtggacggtggcggacgtgcggcagggctgtcagtatgagttccgggtcacagctgtggctccctcaggtcccggagagcctggacctccatcggatgctgtctttgctcgggaccccatgagaccccctgggctggtgaggaatctccaagtcacagacagatcgaacaccagcatcactctgagctgggctgggccagacacccaggaaggggatgaagcccaggggtatgtggtggagctgtgcagctcagacagtctccagtggctcccgtgccatgtgggcaccgtgccagtcaccacctacacggccaaggggcttcggcctggagagggctacttcgtgcgggtgacagcagttaatgaaggaggccagagccagcccagtgccctggacacattagtgcaagccatgcctgttactgtctgtcccaagttcctcgtggactccagcaccaaggacttgctgacagtcaaggtcggggacacagttcgtgtgcccgtctcctttgaacatgcccgcaggcccctgggcccatccacctgcaggagaacgtgcctgggacggtgacggccgagtgggaaccctctcctgacgaggcccaggatgtcccgctgcactacgcggtgttcacacgctcctcagcgcacggtccctggcacgaggcagccgaccgcatccacaccaaccgcttcaccctcctgggcatcctccccggccacgaataccacttcagggtggtggccaagaatgagctgggggccagcaaaccctcggacaccagccagccctggtgcatcccccggcagcgcgacaggttcacagtgaaggctccgtgctaccgggagcccgacctgagccagaagccccggttcctggtgggcctgcggtcccacctgctgccccagggctgcgagtgctgcatgagctgtgccgtgcagggctcgccccggccccacgtcacctggttcaagaatgaccgcagcctggaaggaaaccccgcggtgtacagcactgacctgctgggcgtgtgctccctcaccatccccagcgtatccccgaaggacagcggggagtacaaggctgtggctgagaacacgctgggccaggcagtcagcactgccaccctcattgtcatagaacccagcacctagcctcacctcaccctgggatggtcctggacccttgaagcttcacttccgacacctgcactggcccgggaagccaatcccaaggatggaggctgtgcccagagccccaggaaaatgggagtgagaagatgcctggcgaggttttggccaggaggacgtgaagtccttggggaagaaaaacaagggaggagggcattccacctcctggctccaagctaagtcactcaacagaatgacagcgaacctcctggaccctcaccatatgggtttctttcttcttcgcttcaggagatccagagggcacctgcctgcaggatgggccggctccttattttcctgggctgagccgtttggagggagggtgggcacagctgggcctgctgtgaccactgggagggaagaggagaggaggtcagaggacctgggtgaggactagggcatcaaggtcgtgtgtgtgggtgggggcagcctccacctcctggattcaagagattccaggggtgcagcaagtgctttctatgcgtttcttcattaaaacattaggctaatacaggca

SEQ ID NO: 4252 - DNA, 11810 bp, Homo sapiens
gtcaatccagagcctcagcaagcagcagctggaaacggggaagagggagcagacaggaagcgggaggtcagctgtacacccagggtaatagaacttctaccctcagaggagtcaaagaggaggcagaactatggcaggaaagctccggaagtcccacatccctggagtgagcatctggcagctggtggaggagatccctgaaggctgcagcacgccggactttgagcagaagcccgtcacctcggctctgccagaggggaaaaatgctgtctttcgggctgtggtctgtggggagcccaggcccgaggtgcgttggcagaactccaaaggtgacctcagtgattccagcaagtacaagatctcctccagccctggcagcaaggagcacgtgctgcagatcaacaagctgacaggcgaggacacggatctgtaccgctgcacagcagtaaatgcgtacggagaggccgcttgctcagtgagactcactgtcatcgaagttggctttcggaagaatcggaagaggcacagggaaccgcaggaagacctcaggaaggagctgatggacttccggaagttgctgaaaaagagggccccaccagcccccaagaaaaagatggaccttgagcagatatggcagctgctgatgacagcagacaggaaggactacgagaagatctgcttgaagtatggcatcgtcgactaccgtggcatgttgcgcaggctgcaggagatgaagaaggaacaggaggacaagatggcacagtacatcaacaccatctccagcttaagacacatcagggtcaccaaggatgggaatgcaaagtttgacttggagctggatctcaaggattctcagagcaagatttacctgtataaggatggtgagatgatcccctatggcttcaacaaccaaaccaagcactgtctgcgccggctggggaagcgctatgagttccagattcaagacctgaggcctgaggactctggcatttaccaggtcaaggtggaggatgctgtggtcttctccacagaactggaggccagtgccatccccccaagagtggtggtcccactggcggagacccactgtgaggagcagggtgacgcagtctttgaatgtaccctctccagcccctgccctagtgcagcctggcatttccggcaccggctactccaccccagtgacaaatatgaagtgtatgtgtcccctgacgggctgacccaccggctggtggtgaggggggcacgtttctcagacatgggcccctattcgctgggcaccgggctctacacttccagcgcctggctggtggttgaagctgggaaggataaagaccttcagtccacaagtgctgaccacaaactgcagaggcaaggagcccaggcatcaggagcagaagagtctgggagcatcgagagccagggagagaaatccagagagcagggccccagggggggctcccttgaaggggctgggccggcttctgggctccagcacatagccagcccagacagggatggccttggcagacatggctactccttgatgggggacaaagggacagctgactcagcctggggccctggacaggagggcgagggctttccagtagcagagggaagcagagccactcttcccagggaaaatcaatcccacagagagggaggctgggccagaagccttgcagagaggccccatctacagggagagagctcagaatcagggttgggcctcccagaaaaacaacagcaagatcgtggcagagacagcaacagtgatgaatgctggaggaaagcaggaggctgggaggctgggtccagtcggcttcaggctggaggactggggagcagcagggaaggaaaggagcacagaggggacagtggaagacaactggacaggcatgccccagagcaactgtgggatgctcgactgggacctgggagaggaaagagcgacctgcagggatgccagtctgatcctgtagggtcctggccaagaggaaagcagatagagatttcacaggatgacagcctggctgagatggacagaggggatgctccaagtagggaaagggggagaggaatagtagtgtggggtggtgggactggcctgggagaagctggagacagcaatggggcaggaggtcctggcaccctggagcttactggaggaagaggttctggctccaaggtgggcatggcccctgaatcctggggttctcagggaggtagagatgctgactatggggaagccaggggctactgggggtcaggagagttgctagaacagatacctggaggcaaggacttccaggaaccatcaatatcaggtggtagaaaattccttctgggagatgggagtcctgagatcaaagctgaagactcactgcaggaggcagatggtatatgccggggggagtctgtagttacaggaagtgcctacaaaactggccctggaggcccaggagaccccagaggctgcgaaggtgtcctacaggagctcaggggaagggatggccaggaaacagcttgggcctcgggtgaggtagagtatgaccccagaagcttccagtcttcccagggctggacagcaggtcacagagcagcagggggtattggcagaatagaatctaagggcacaagtccttgggatgacacaccatctagcctcagaaaaactggggcccaccatgggcctggagtgctggggcccagtggaggacaagagggtatgggtggtatctgggtggctggactgacggagtctggtcagggggtggatgccagaagccactggctaagtagggctccaggcctgggtgctcagggatctggggggacactaggagataagaaaggattaagaggtcctgggtcaatagggtctgaaccagatttctggaatgggtcagggagctccagagtaaaaggacccagaggtgagacaggctataaggatggcttggaaggtcccgggagaatggaatctaggtacgagggtggcttaggatattctagggaaataagctctaaaagcggggctggttatagctatggctcaggggttccaggagaaatggggtccggccatggtgctggttgtagagtttcccctagggcacctgcgggagtggagtctgaggaagggggtgggtacaggcatggctccggagcgcctgggggagtgtggtctggaaatgaagattctggccctgcaggaggagggtctgggagagttgccagtcttaaaaatggctcaggtggtcctgatggagcacccatgaatgacaccaggaattgggcctctgcatgccaggcaggcatggaccctaggggagggcaccattcagatggtggcctagggagtcctggggtgacagggtctgcgggtagaggtggtctcaaggcccctggagtagtggagactgttgggatgggatgtgtggaagcagaaccagagagctctggaagaataaggccttggggtcagactggaaattatgggggcttcagagcctcagaggccctgggggcctttggagaaggaggctatgaagatggctctgggggtccaggagccatgggaccagggtctctgagggcaggaagcaaagtgggtgagggggatgggacaagatgccctggtgctaaggcctctggagctggagctggttatagggatgataccaggcaccctgagtcactcgcacctcacaatggggccgcttctgggagccagtgggcttatggggctggcaatgtgctgggttatgaggatggatcagaacttccagggcctcagggaactggggtcagaacagcctatggagaaaggtcaaggggccttgggcctaggagtacagggccagggggtgaggcaggctttagagatggttcaggaggcctccaaggaatgggatcagcagatgggccaggttgtaggaagggtattgggagttctggggaaatggggtcagtggataaggaaggttataagaaagatttgggggctcctgagaatatgggttcggggagcaaggcagattatagggatggtgtagggggttctggggcaatggggtcaatggatgaagcaggttataggaaagatttaggggctcctgagggaataagttcagggagcaaggcagattataggggtggtttacaggattccagggaagcgggttcagggagcaaggcagattatagcggtggtttaaagggttccagggaaatcgggtcaatggatgaaacagataataggaaagatttgggggttcctgagggaatgggtgcaggttacagggctggtttaaggggtcctggggagatggggtcactggatgagtcaggtcataggaatgggattggaggttatggggaaatggggtcaggttatagggaggatttgggggctcctgagggaatgggcacagggagcaaggcaggttatagggatggcttaaggggttctggagaaatgaggtcaatggatgaggcaggttataggaaaaatttgggagctcctgagagaatggattcagggagcaaggcaggttacaggggtggtttaaggggttctggggaaatggggttaattgaggcaggctataggaaagatttgggggtttctgagggagggggttcagggagcaaagcaggttataggggtggcttaggttctggggaaatggggtctgtggataaggcaggctataggaaggatttgggggcttctgaggcaataggttcagggagtaaggcaggttttacggatggtttaggaggttctgaagaaatggggtcagtgaataaggcaggttataggaaggatttgggggctcctaagggaatgggttcagggagtaaggcaagttttagggatggtttaggaggttctggagaaatggggtcagtgaatgaagcaggttataggaaggacttgggggttcctgagggaataggttcaggaagtaaggcaggttttagggatggtttagggggttctgaagaaatggggtcagtgaataaggcaggttataggaaggatttgggggctcctaagggaataggttcagggagcaaggcaggttttagggatggtttagggagttctggggaaatggggtcaatggatgaggcaggttataggaagaatttgggggctcctgagggaataggttcagggagtaaggcaggttttagggatggtttagggagttctgtagaaatggggtcagtgaatgaggcaggttataggaaggatttgggggctcctgagggaatgggttcagggagtaaggcaggtttcagggatggtttagggggttctggagaaatggggtcagtgaatgaagcaggttataggaaggatttgggtgctcctaagggaataggttcagggagcaaggcagattttagggatgctttagggagttctggggaaatggggtcaatggatgaggcaggttataggaaggatttgtgggctcctgagggaataggttcaggaagtaaggcaggttttagggatggtttagggagttctgtagaaatggggtcagtgaatgaggcaggttataggaaggatttgggggctcctgagggaatgggttcagggagtaaggcaggtttcagggatggtttagggggttctggagaaatggggtcagtgaatgaagcaggttataggaaggatttgggtgctcctaagggaataggttcagggagcaaggcagattttagggatgctttagggagttctggggaaatggggtcaatggatgaggcaggttataggaaggatttgtgggctcctgagggaataggttcaggaagtaaggcaggttttagggatggtttagggagttctgtagaaatggggtcagtgaatgaggcaggttataggaaggatttgggggctcctgagggaatgggttcagggagtaaggaaggtttcagggatggtttagggggttctgaagaaatggggtcagtgaataaggcaggttataggaaggatttgggggctcctaagggaatgggttcagggagtaaggaaggtttcagggatggtttagggggttctgaggaaatggggtcaatggatgaggcaggttataggaaggatttgggggctcctgagggaataggttcagggagtaaggcaggtttcagggatggtttagggggttctgaagaaatgcggtcaatggatgaggcaggttataggaaggatttgggggctcctgagagaataggttcaggaagtaaggcaggttttagggatggtttagggagttctgtagaaatggggtcagtgaatgaggcaggttataggaaggatttaggggctcctaagggaatgggttcagggagtaagacaggtttcagggatggtttagggggttctgaagaaatggagtcaatggatgaggcaggttataggaaggatttgggggctcctgagggaataggttcaggaagtaaggcaggttttagggatggtttagggagttctacagaaatggggtcagtgaatgaggcaggttataggaaggatttgggggctcctaagggaatgggttcagagagtaaggcaggttttagggatggtttagggagttctggggaaatggggtcaatggatgaggcaggttataggaaggatttgggagctcctgagggaatgggttcagggagtaaggcaggtttcagggatggtttagggggttctgaagaaatggggtcagtgaataaggcaggttataggaaggatttgggggctcctaagggaatgggttcagggagtaaggcaggtttcagggatggtttagggagttctggggaaatggggtcaatggatgaggcagattataggaaggatttgggagctcctgaggaaatgggttcaggcagttacacagattacaggaatggtttaggcagttctggaaaaatcagttcaggggatgaggcaggttataagaatgttttagggggttctgggaggaatccattagggagcgaggcaggttctaggggtagtttggaggattctgggtacattttgtcatggaatgaggcaggttctaggcaaggctttgggggaactagtggcatggggtcagggagtgaggtcagttatagaggaggctcaggaggatctggggaaacgggaccagagggtaagatgggttatggagatggttcagggaggcttggagtaccaggctcactggctggaataggacatgaggctggacccagaggccataaagccatgggtcacaggtcaggatattgggtagcatcagagggtgacacgaactccaaggatggtccagagcgagccagggaaaccaggcttgtggatggggcaggacctggggtggaacctgggatggctggaatgccaggcactgcaggtggcatggcacacagagacagcctcaggggcacaggggtgctggggtctcagggagggcgacagactctttcagatgagcgaggctccaccaaagatcttgggggctatggaacttcagggatccctgaggcctcggaggctgctggtgccaagggaaaaccagatgtcaaagaatggcaagacagttctgggactccagggtcttctagagacagaggggctcccagggtgaaggataggtctccagaccaagcagggataatgggggcttctgggtttcttgatggcaagggggcagtggaaggtgagacctgggcaggaatggctgctctagggtctggatatgaacgggacatctggaaagcaggcccaggaatgacagacaggggtagagttgctggccagggggggttggcatctcagggaggtggggactcacttttgggaggcagaagggtaggctcagggagttcagtggggacaggtcaggatctggacagcggctctatgcctgggggaaggggcaagtcaacatcagggcctgctgatagacaagggacgagcaatgcttgggctcctgattgggaaaaccaggggtttagccaaggcagcatagatgctgggaagcagcccgcaggctccagagcttccggttctctgcaggagaaagatgccgcttttggtgggacccatgaagggccagggggctttaagggtggggagggtgcaccaggccaagaggcggctggtggatgccgaagcccatggtccctggatagcaaaggttcaagtcctggaaggggcagttctgttgatgcagaggactcaggtatcctgggcaaggggaattctactgagtgggggaatgccctcaccccaaaacctggggagtccggacctcagggagcctggaatggcttagatggtccctttggcagaaaagcctctagagataggtcaggagggacccaggacctgagctctcagcgaggcaagggacagagaggaggaaagaggtccctcggggagcaggggtccctggaggctgagaatggtgaggtccagggtcctggggccctaaaggaggatgaagggcagggagtggaagaggctgggaggtcaggcaggaggcctggctcactcaggagcaggtctcaggcacagtcaggggctgaggttggaggaggaaagagaaggggagcagacgaggctggaagcatggggtggcagcctatgggagagaactgggggtgcctggaggagatgctgaatgaagatcagagccgggagccccctggtcaccttggtagcaggagaagtggcaaagacggcaggttggacatctatggagagaggagagatgctacccggagttccacatccagatacaagcctggcactggcagtttctccaaggatgcccaaggccccatgggccacttctcccagggcctggctgacatggaagtgcagccgggggaggccgccacactctcctgtaccctcaccagtgacctgggacctggcacctggtttaaggatggcgtcaagctcaccacccaggatggagtcatctttaagcaagacggtctcgtgcacagcctcttcatcacgcatgtgcaggggacccaagctgggaggtacacctttgtagctggtgaccagcagagcgaggccaccctgaccgtccaggattcccctaccattgctccagatgtgacagagaaactgagagagccactggtggtcaaggctgggaagccggtgatagtgaagatccccttccagagccacctccccattcaggctgcctggaggaaggacggggctgaggtggtgggcagcagtgacagggaggcccaggtggacctgggggatggctacacgcggctgtgcctccccagcgcaggcaggaaggactgtggccagtacagcgtgacactgaggagtgagggaggctctgtgcaggccgagctcactctgcaagtcatagacaagcctgatcccccacaaggccccatggaggttcaggattgccatagggctggcgtctgcctccgctggcggcccccaagggacaatgggggccggactgtagagtgctacgtggtggagagacggcaggctggcaggagcacttggctgaaggtgggcgaggcccccgctgacagcaccaccttcacggatgcccatgtggagccaggcaggaagtataccttccgagtgcgggctgtgacctcagagggggctggcgaggccctggagtctgaggagatattggtggctcctgaggctctccccaaggccccttccgcgccagccatcctgtcggcctccagccagggcatcacactgacatggacagcacctcggggccccggcagcgcccacatcctgggctacctgatcgagaggcgtaagaaggggagcaacacctggacggcagtgaacgaccagccggtgcctgagaggaggtggacggtggcggacgtgcggcagggctgtcagtatgagttccgggtcacagctgtggctccctcaggtcccggagagcctggacctccatcggatgctgtctttgctcgggaccccatgagaccccctgggctggtgaggaatctccaagtcacagacagatcgaacaccagcatcactctgagctgggctgggccagacacccaggaaggggatgaagcccaggggtatgtggtggagctgtgcagctcagacagtctccagtggctcccgtgccatgtgggcaccgtgccagtcaccacctacacggccaaggggcttcggcctggagagggctacttcgtgcgggtgacagcagttaatgaaggaggccagagccagcccagtgccctggacacattagtgcaagccatgcctgttactgtctgtcccaagttcctcgtggactccagcaccaaggacttgctgacagtcaaggtcggggacacagttcgtgtgcccgtctcctttgaagccatgcccatgcctgaggtgacctggctgaaggatggcttgcccttgcccaaaagaagtgtgactgtcactaaggatggcctcacccagcttctgatccctgtggctggactctcagacagtggtctctacactgtggtgctgaggaccctgcaggggaaggaggttgcccacagcttccgtatcagggtggcagcatgcccgcaggcccctgggcccatccacctgcaggagaacgtgcctgggacggtgacggccgagtgggaaccctctcctgacgaggcccaggatgtcccgctgcactacgcggtgttcacacgctcctcagcgcacggtccctggcacgaggcagccgaccgcatccacaccaaccgcttcaccctcctgggcatcctccccggccacgaataccacttcagggtggtggccaagaatgagctgggggccagcaaaccctcggacaccagccagccctggtgcatcccccggcagcgcgacaggttcacagtgaaggctccgtgctaccgggagcccgacctgagccagaagccccggttcctggtgggcctgcggtcccacctgctgccccagggctgcgagtgctgcatgagctgtgccgtgcagggctcgccccggccccacgtcacctggttcaagaatgaccgcagcctggaaggaaaccccgcggtgtacagcactgacctgctgggcgtgtgctccctcaccatccccagcgtatccccgaaggacagcggggagtacaaggctgtggctgagaacacgctgggccaggcagtcagcactgccaccctcattgtcatagaacccagcacctagcctcacctcaccctgggatggtcctggacccttgaagcttcacttccgacacctgcactggcccgggaagccaatcccaaggatggaggctgtgcccagagccccaggaaaatgggagtgagaagatgcctggcgaggttttggccaggaggacgtgaagtccttggggaagaaaaacaagggaggagggcattccacctcctggctccaagctaagtcactcaacagaatgacagcgaacctcctggaccctcaccatatgggtttctttcttcttcgcttcaggagatccagagggcacctgcctgcaggatgggccggctccttattttcctgggctgagccgtttggagggagggtgggcacagctgggcctgctgtgaccactgggagggaagaggagaggaggtcagaggacctgggtgaggactagggcatcaaggtcgtgtgtgtgggtgggggcagcctccacctcctggattcaagagattccaggggtgcagcaagtgctttctatgcgtttcttcattaaaacattaggctaatacaggca

SEQ ID NO: 4253 - DNA, 1843 bp, Homo sapiens
gtcaatccagagcctcagcaagcagcagctggaaacggggaagagggagcagacaggaagcgggaggtcagctgtacacccagggtaatagaacttctaccctcagaggagtcaaagaggaggcagaactatggcaggaaagctccggaagtcccacatccctggagtgagcatctggcagctggtggaggagatccctgaaggctgcagcacgccggactttgagcagaagcccgtcacctcggctctgccagaggggaaaaatgctgtctttcgggctgtggtctgtggggagcccaggcccgaggtgcgttggcagaactccaaaggtgacctcagtgattccagcaagtacaagatctcctccagccctggcagcaaggagcacgtgctgcagatcaacaagctgacaggcgaggacacggatctgtaccgctgcacagcagtaaatgcgtacggagaggccgcttgctcagtgagactcactgtcatcgaagttggctttcggaagaatcggaagaggcacagggaaccgcaggaagacctcaggaaggagctgatggacttccggaagttgctgaaaaagagggccccaccagcccccaagaaaaagatggaccttgagcagatatggcagctgctgatgacagcagacaggaaggactacgagaagatctgcttgaagtatggcatcgtcgactaccgtggcatgttgcgcaggctgcaggagatgaagaaggaacaggaggacaagatggcacagtacatcaacaccatctccagcttaagacacatcagggtcaccaaggatgggaatgcaaagtttgacttggagctggatctcaaggattctcagagcaagatttacctgtataaggatggtgagatgatcccctatggcttcaacaaccaaaccaagcactgtctgcgccggctggggaagcgctatgagttccagattcaagacctgaggcctgaggactctggcatttaccaggtcaaggtggaggatgctgtggtcttctccacagaactggaggccagtgccatccccccaagagtggtggtcccactggcggagacccactgtgaggagcagggtgacgcagtctttgaatgtaccctctccagcccctgccctagtgcagcctggcatttccggcaccggctactccaccccagtgacaaatatgaagtgtatgtgtcccctgacgggctgacccaccggctggtggtgaggggggcacgtttctcagacatgggcccctattcgctgggcaccgggctctacacttccagcgcctggctggtggttgaagctgggaaggataaagaccttcagtccacaagtgctgaccacaaactgcagagcaggagaagtggcaaagacggcaggttggacatctatggagagaggagagatgctacccggagttccacatccagatacaagcctggcactggcagtttctccaaggatgcccaaggccccatgggccacttctcccagggcctggctgacatggaagtgcagccgggggaggccgccacactctcctgtaccctcaccagtgacctgggacctggcacctggtttaaggatggcgtcaagctcaccacccaggatggagtcatctttaagcaagacggtctcgtgcacagcctcttcatcacgcatgtgcaggggacccaagctgggaggtacacctttgtagctggtgaccagcagagcgaggccaccctgaccgtccaggattcccctaccattgctccagatgtgacagagaaactgagagagccactggtggtcaaggctgggaagccgatccagacctaccactaa

SEQ ID NO: 4254 - DNA, 2165 bp, Homo sapiens
ccagcaaacaaattactcctctggttcactcctcctgaactgaacctcttctttacaacgaaatgatgctcaagtctatcacagaaagctttgccacagcaatccatggcttgaaagtgggacacctgacagatcgtgttattcagaggagcaagaggatgattctagacactctgggtgctgggttcctgggaaccactacggaagtgtttcacatagccagccaatatagcaagatctacagttccaacatatccagcactgtttggggtcagccagacatcaggctcccgcccacatatgctgcttttgtgaacggtgtggctattcactccatggattttgatgacacgtggcaccctgccacccacccttctggggctgtccttcctgtcctcacagctttagcagaagccctgccaaggagtccaaagttttctggccttgacctgctgctggctttcaatgttggtattgaagtgcaaggccgattactgcatttcgccaaggaggccaatgacatgccaaagagattccatcccccttccgtggtaggaacgttgggtagtgctgctgctgcatccaagtttttaggacttagctcgacaaagtgccgagaagctctggccattgctgtttcccatgctggggcacccatggccaatgctgccacccagaccaagcccctccacattggcaatgctgccaagcatgggatagaagctgcatttttggcaatgttgggtctccaaggaaacaagcaggtcttggacttggaggcaggatttggggccttttatgccaactattccccaaaagtccttccaagcatagcttcctacagttggctgctggaccagcaggacgtggcctttaagcgttttcctgcacatttatctacccactgggtggcagacgcagctgcatctgtgagaaagcaccttgtagcagagagagccctgcttccaactgactacattaagagaattgtgctcaggataccaaatgtccagtatgtaaacaggccctttccagtttcggagcatgaagcccgtcattcattccagtatgtggcctgtgccatgctgcttgatggtggcatcactgtcccctcattccatgaatgccagatcaacaggccacaggtgagagagctgctcagtaaggtggagctggagtaccctccggacaacttgccaagcttcaacatactgtactgtgaaataagtgtcaccctcaaggatggagccaccttcacagatcgctctgataccttctatgggcactggagaaaaccactgagccaggaggacctagaggaaaagttcagagccaatgcctccaagatgctgtcctgggacacagtggaaagccttataaagatagtcaaaaatctagaagacctagaagactgttctgtgttaactacacttctcaaaggaccctctccaccagaggtagcttcaaactctccagcatgtaataattctatcacaaatctctcctgaggcttaccaacatctaaatgactttgcatttggggagattcaatgatttggtttgtaaagcaagggtctgctgcttggttttcccaggaaaaatgaacaaagatggagagagtccagaaacagaactacatatatctggaaggagccttctcctgaaaattttgcaggacagttccacttacctaaatcaagatgaaacacacacacaaaaatgagtttgtaagcattcacaagggtgaaattcaactcacctgtgatttacttataaaattaatctcttcataggaattatgtgtggacttcatgagcctcaaggttttagagggatgtgaacctgcatgtatattttctgacagtggagagggctctggtgcattgtgtcaccaacagatctcctagaccatggcttattaccaagccctccacagtgcaaggggtgctactggggaatgggtgggtttaaatcctgcctctgccattcactagatgtagccttgagcatgttaccattagccctctgcctcagtttccctatttgtcaagccgaagtaaaaagcagtctggaaaaatcgcattttggctctagaacccatggtcttaagcactgcaatatatcacctttcagtataaaaatatttgaatcagagttgcaataaa

SEQ ID NO: 4255 - DNA, 1446 bp, Homo sapiens
ttccctttaaagtctatcacagaaagctttgccacagcaatccatggcttgaaagtgggacacctgacagatcgtgttattcagaggagcaagaggatgattctagacactctgggtgctgggttcctgggaaccactacggaagtgtttcacatagccagccaatatagcaagatctacagttccaacatatccagcactgtttggggtcagccagacatcaggctcccgcccacatatgctgcttttgtgaacggtgtggctattcactccatggattttgatgacacgtggcaccctgccacccacccttctggggctgtccttcctgtcctcacagctttagcagaagccctgccaaggagtccaaagttttctggccttgacctgctgctggctttcaatgttggtattgaagtgcaaggccgattactgcatttcgccaaggaggccaatgacatgccaaagagattccatcccccttccgtggtaggaacgttgggtagtgctgctgctgcatccaagtttttaggacttagctcgacaaagtgccgagaagctctggccattgctgtttcccatgctggggcacccatggccaatgctgccacccagaccaagcccctccacattggcaatgctgccaagcatgggatagaagctgcatttttggcaatgttgggtctccaaggaaacaagcaggtcttggacttggaggcaggatttggggccttttatgccaactattccccaaaagtccttccaagcatagcttcctacagttggctgctggaccagcaggacgtggcctttaagcgttttcctgcacatttatctacccactgggtggcagacgcagctgcatctgtgagaaagcaccttgtagcagagagagccctgcttccaactgactacattaagagaattgtgctcaggataccaaatgtccagtatgtaaacaggccctttccagtttcggagcatgaagcccgtcattcattccagtatgtggcctgtgccatgctgcttgatggtggcatcactgtcccctcattccatgaatgccagatcaacaggccacaggtgagagagctgctcagtaaggtggagctggagtaccctccggacaacttgccaagcttcaacatactgtactgtgaaataagtgtcaccctcaaggatggagccaccttcacagatcgctctgataccttctatgggcactggagaaaaccactgagccaggaggacctagaggaaaagttcagagccaatgcctccaagatgctgtcctgggacacagtggaaagccttataaagatagtcaaaaatctagaagacctagaagactgttctgtgttaactacacttctcaaaggaccctctccaccagaggtagcttcaaactctccagcatgtaataattctatcacaaatctctcctga

SEQ ID NO: 4256 - DNA, 3792 bp, Homo sapiens
agatgccggcggcgcggcgtggcagggttgtggttccgggtcgggccgcgccgcagccagctctcggctcgcagccgcagcgccccgcccccgcgctccggacctggcaggcggcggctgcagggcaggtccaggggccacatggctgagggggacgcagggagcgaccagaggcagaatgaggaaattgaagcaatggcagccatttatggcgaggagtggtgtgtcattgatgactgtgccaaaatattttgtattagaattagcgacgatatagatgaccccaaatggacactttgcttgcaggtgatgctgccgaatgaatacccaggtacagctccacctatctaccagttgaatgctccttggcttaaagggcaagaacgtgcggatttatcaaatagccttgaggaaatatatattcagaatatcggtgaaagtattctttacctgtgggtggagaaaataagagatgttcttatacaaaaatctcagatgacagaaccaggcccagatgtaaagaagaaaactgaagaggaagatgttgaatgtgaagatgatctcattttagcatgtcagccggaaagttcgcttaaagcattggattttgatatcagtgaaactcggacagaagtagaagtagaagaattacctccgattgatcatggcattcctattacagaccgaagaagtacttttcaggcacacttggctccagtggtttgtcccaaacaggtgaaaatggttctttccaaattgtatgagaataagaaaatagctagtgccacccacaacatctatgcctacagaatatattgtgaggataaacagaccttcttacaggattgtgaggatgatggggaaacagcagctggtgggcgtcttcttcatctcatggagattttgaatgtgaagaatgtcatggtggtagtatcacgctggtatggagggattctgctaggaccagatcgctttaaacatatcaacaactgtgccagaaacatactagtggaaaagaactacacaaattcacctgaggagtcatctaaggctttgggaaagaacaaaaaagtaagaaaagacaagaagaggaatgaacattaatacctgaaactataggaaaggttaatttgcctataattatatatacattccatagtcatcaaggaatatattgtgcagagagagtatccttgactgcttaagtcagccagttcagcatggataccaacattagcttttcttcttggttatatcatctgccaaaaatagagaacttatgatctattcatgtgtgtttcaggcttatttgggagaactaatttgaacttaatcaccacttcatctaattttagcaaggtaacagttgcccagggcagtacctgaattaactgtccatttcagtacatgtcaagtgcctttgttaggtggagaagaaatgtctctagaggaatataaatacctgatttcttgtcatcgagattcttgtactgttaaatgaatattgccttttactgctctttatggcttattggaataggagctcatttaagattgatcttggagagtttcttcttgtgattttagttcataagtatgtcacctttcattttatagtgttcatcattgagtaatggattaagtgaaaatccaggagtatccatctgcagttatgtgctgaggtgataattcatccaacatatttgttagcataaatattatgcttcagtttctgttgcaaattggtgattgtgaaattacagaaagtgattttctagtctgctttttttgtttaattcttgtaatgtaagcaataaatatggagtgtcagtagtctccttccaccccagaaatgtgttggtgtaacattctcgtttcttttaacaacctggaagtacctttcttgtgatcttcactgaggaattagaactatgatagaagttaggctgtggcaaatgggacattcgtagagtgggatagaggtggcagaatgaacctggtgtagggcaggagtatgttgtgtagttacatcaatttgatgcatgctttccatctgcactccagacggctttctcagttccaagattttgcagagagaaggagcaaaccttttcattggaaaaacagaaacaaccctcccccccattttttcccctctattcatcaaacctttatgtatctttcatcttccagttacctctaggcatttagatagtgaaatttacctttgagatataacaataagtgattaactgttcactttcagatgtaatggcaaacaattgttaaaagttattaactgatcacagatttgcctggacttcccttcccagggagggaacagaagttaggaggcaactttgggatggtgctagagcatggaaagcacagagaattggacaaacaggtctttttctcttttctctgatgttttacctttaaaagatccaacatccttaccgttggtatttttagtaaggttatagtaaatagctttacaccaggatggattctgaaatataaattctaaattatatttgttataactatattttatgttgtatgttatcaggagccatcagagaatgacctttttgtgtttggaacacttggttccatgaaaagtatgctttgtgttttaactgttaaaataatttaaaaattaattattttacataattaaagaagttaaaaactattaacattaaataatttcacaatttcaacatgtcaaacctatgaagggagataggaaacaatgagaaacttacttttgctcctttatacagaattattaactatattttactaactaaaaaactctagtattctttacctaaagtcaattggctggtaagagggagagatgcaaaattctccagctctgaacttggagctacttcacactctactcttaatggaaacttgaactaatgatagatagtatttttttcctctatttaaaatttttgtcttgattaggagatttttcagttctccatataataattttctacaatcagatctatgctgtggcatattttgctttatttaaaaatttttttttagagatgagttcttgctctgtcacctaggctggagtgcagtggcatgatcatggctcactgcagccttgaccttccagcctgccaagtagctgggattacagacaggcatgtgctattacacctggctaatttttaaagttttttttgtaaagatagggtctttctatgttgcccaggctcgtcttgagctcctggcctcaatcgatcttcctgccaaggttttggaattacaggtgtgagccaccatgcctggcctgctttgacatattttatagtgtgttaattacaaatagtcttcatatgccagaatataagagcaagtgttatctactttttagatgggaattgcagaagctgcatcaaaagtatgctttgaggtatatatagtgaaacagagcctttctgaagagaattatatcaaactaattacaaccaagaaataatagtatgaagcggatgctgtttggaggacaggaaaatttatcgggaaaattacataatccctctgattccactatccagagatagccattattattaatatttggtatgtacatccttatattatttttttcttatgcatgattttgtatatatggttatttttctttccataaaaatggtattaaactgtatatactgttttgtagcctacatatttcatatagaagtatattgttaacattttccatgtcaataaatattcttctatggcttaaatgtc

SEQ ID NO: 4257 - DNA, 2861 bp, Homo sapiens
agagaggcagataattcccaaacagaagacccccaaggcggagggccctggggctggactcctggcccccaggaggcgcgggcctggcccagaggcgacaggaagccaggacgccggggattgtctctcgcaaccgcagcccagccccagtccgggaggaagttctgccgggcgctctccgccggtgcctcactggttatagtgctatacaggaaacctggcagcgccggagccgcgcggtcgaggagggagcgcgggacgccgagcccacgcgcgcctgccgggacaagtggagacgaggccggcgagcggacgccccgaggttggcgaaggagctgtggccgggtccccttcttatccagcccgagacactgcgctccggtgggcgtccctgcgctgggaatccctctcggagtttttccaggcccggccgggttgctccgggaaaggccctgttgggggaggtgggcccggagctggcaggtctacaatccggttggaagggctcgcagtgggtgattcagggtgccaatgacctccccgcgaacgggaacgcccgcactagacaaccagccccagaccggcattcccagagccgcaggcgggagggacgcagggactccgggacagcaaatccccgggggagaagggaagggggaaggcgggacaggggaggcccaccctccttgggctccgctagcgaccagccagcgccccttcagacgcagccttcctggctccggaccccggctttctgctccggtcctcgtcccaatgccccccaaggtccccagcagaggcattcaggttcctcctcgccccgcccagacgcagcttctttgggtatgggtgacagcactcctgagcgtcgctgtccctattcgctgccgttgccagctccgattccgcgaaacctctccggcaccacctcggaagccccgcccagggcgatggtccgggcctaacctgccggccccgcccacccggcccttgggctccctgaggcccgcccagcagacaccggagagcaatggtgtgatctccgcacactgcaacctctgcctccagggttcaagtggttctcctgcctcagcctcccaagcagatgggactacaggtactggtagttaactctcaaggagaaatttcacggttgagcaccgaaaagaaagtggtcatgaaaggaagtatcaacaattatcttaaattgggtcaagaagggaagtatcgcgtctaccacaatcaatactccactaattcatttgctttgaataagcaccagcacagagaagaccatgataagagaaggcatcttgcacataagttctgtctgactccagcaggagagttcaaatggaacggttctgtccatgggtccaaagttcttaccatatctactctgagactgactatcacccaattagaaaacaacatcccttcatcctttcttcatcccaaccgggcatcacatagggcaaactggatcaaggcagttcagatgtgtagcaaactcagagaatttgcattggctttagccattttggagtgtgcagttaaaccagttgtgatgctaccaatatggcgagaatctttaggacataccagctttctccctttgtctcataaccatgtccaccaatgagaatgctaatacacaagctgcccatcttcacagatctaagaacaagggaaaggacagtacagaaacgaggcgtcacagaatagaggtcaatgtggagctgaggaaagctaagaaggatgaccagatgctgaagaggagaaatgtaagctcatttcctgatgatgctacttctccgctgcaggaaaactgcaacaaccagactcctgccctaagagccatagggaatatcgtcactggtacagatgaacagactcaggttgtgattgatgcaggagcactcgccgtctttcccagcctgctcaccaaccccaaaactaacattcagaaggaagctacgtggacaatgtcaaacatcacagccagccgccaggaccagatacagcaagttgtgaatcatggattagtcccattccttgtcagcgatctctctaagattttgagacacaaaaggaagctgtatgggccgtggaacagttgaacagattgtgtaccttgttcactgtggcataatagaaccgttgatgaacctcttacctgcaaaagataccaagattattctggttatcctggatgccatttcaaatatctttcaggctgctgagaaactaggtgaaactgagaaacttagtataatgattgaagaatgtggaggcgtagacaaaattgaagctctacaaaaccatgaaaatgagtctgtatataaggcttcattaagcttaactgagaagtatttctctgtagagctgccagagcagagctgagccacccattgctggagaggacatccacgcaggcctggacgagccggactgccttactaaggatttcctccgtatctgactgcaactcagcactcagctgcatgcgggacaggaagaggaagatcaaaacgttgtgccagaaactacctctgaaggctacactttccaagttcaggatggggctcctgggacctttaacttttagatcatgtagctgaggcataaatttgttgtgtactatgtttggtattttgtcttattgtttctctactaagaactctttcttaaatgtggtttgttattgtagcactttttacactgaaactatacttgaacagttccaactgtacatactgtatgaagcttgtcctctgactaggtttctaatttctatgtggaatttcctatcttgcagcatcctgtaaataaacattcaagtccacccttttcttgacttc

SEQ ID NO: 4258 - DNA, 945 bp, Homo sapiens
gattcctggagggagaggggaacggacagcaaacaatagacacaatacgatcgtgaggtatatagttaatgttggtgatgagtgctcctcaaaggaaacaactaaaaccagacaagggaagtcggggtgtcagggagaatggtttgtagtattgatgacaatggttaaggaaggcctgagttctgcaaagacctcaaggatatgagggactagagtgccctctgctgtggaagagcctgcgcaaagatcctgaggtgggaggggtcagggagccaactcattttacggtaagtggaggtgggatccaggggaggattctgagcagaggagggacgtggcccaatttgggctttgaaaggatcctgcttgtctgtgtgccagcatcctggtggtggttgggggagtctgcatcaatcctgggtgctgttacctgaaaaaatagcaggtgttagacgaaagaacagatgtctggcccattgtctccagtctgttcctgtccacagcttccctttatgctgagcccctgccacatgcatcatcatcctggccatgtggcattgtcacagaccgtctctcctgctagcctcctaactcagggcctgggtcttccccagcattaagtaaatcagtctcaggcagacagccctttataggtgtttgggccaggtgcggtggctcacgcctgtaatcccagctctttgtggggccgaggtctttgagctcaggagttcaagaccagcctgggcagcatgacaaaaccctgtctctaccaaaaatacaaaaattagccacgcatggtggcacacacctgtggtcccagctactcgggaggctgaggtgggaggatcgctggagcctgggaagttgaggctgcagtgagccgtgatcatgccactgcattccagcctgtgtgatggagagagaccctgtctcaaaaaaaataaa

SEQ ID NO: 4259 - DNA, 3741 bp, Homo sapiens
gacttctttccattttgttttttgcagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaatacatttcagttggataatcttcaccttggtcttttttgtttgtttttattgtcatgaatttgtggtgggggagatgatcacagatgtttcccaaaatctaggaactacttcaattcatcatcagcatattgctctgaaagaaatccattttaaaaaatcttacatgattcagtactgtcatttctagttctaagcttctatgtgttgagcctagctgattgagattggttcacaaagtgtaaatttcattcatgagtatttaaatgtttctgaggaaacatggatcatttcaataggactaggggtgattcacagagcaccactctccaaccaaatggaagagaggagagggggaaaaggaacatattttttttgtgatacaacttaatagcctatgagaacacagtcaacctgagaatcaatgtaagggatttaaaaaaaatgtgtagccactcaattaggtagagttaactcatgatctggaatactgaggcagtttgcaggtatgttccacaatgatctctatcatccagtcaaggtgtgactcctcccttgcaacaggcatatgcatggagtgagtaaagtggtcaacagacctttcaaaaccatggcatcttttcagaactctgacttgggttgtgtgatctagctgtgaatgtagcaatatagaacgtttaatagaatgataagcaaaacactgcaatgatctaaaatt

SEQ ID NO: 4260 - DNA, 2936 bp, Homo sapiens
aatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaatacatttc

SEQ ID NO: 4261 - DNA, 583 bp, Homo sapiens
gcgcacacgctcacacgctcgcaagcgaacgcaggaaagtcaggctaaaagtgtctgctgctgctgccgccccccactccgcctccgggagagaatacaaagaaatggtgttacctggcaagaggtcttctgtcttttatgaaaaattagacaaagggggcgctgttttggggaaatggcagaactccctcagaggctgatctaagggttcccggcagaaggggccatcttcagaggctctggttgcatgactgtttggagtttgatggcctgaagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccg

SEQ ID NO: 4262 - DNA, 673 bp, Homo sapiens
atggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccatagctaactcatccagaatttgagtataagtggatcttgaggtcctcagagctgagacaacttgagacaacttgctcagtcacctgttcaaatgtctgcaggatggttggccaagtgcaagacatcacatgagcttcttgacagctgcacgatggtaacttaatgagacacaacagttttcttgtgaaatagctggacatgcagagaggtcacatgaataataagctcacacctgtgttcccgccacccggatattattcaaagcacaaaacatcataaataaagtcaaggtcctctata

SEQ ID NO: 4263 - DNA, 563 bp, Homo sapiens
aaagcgcagatggggagagtcatttgccccacaccctacacagcccggaataaccaggaatacaaagaaatggtgttacctggcaagaggtcttctgtcttttatgaaaaattagacaaagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtg

SEQ ID NO: 4264 - DNA, 1506 bp, Homo sapiens
agacagcagaaggatcactgggctggaagctctaacaggcattgccagcctagctacctgcagtttgaggcaagggcagggtcacttaccctgctgtctgaatgtctcctgggacaacaggaggctgcactcactggctgagttcagacagaagagggatcatcggactggaagctctggcagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgatttgaatcaagaattaagagattagcagctgcaagaatttattcataataatgttctaccagtataaaaaacttcaatttctttttttatatatatttttaaaatatactaagaaacaacaacagataattttatcttgtcaaatggcaagaaatgcttgatgagcgaacacaagtttactaaaaaaatattatttcaagtcatcatggaactgtattgttgatcctagaagacacagtccccaaactgttaggttccttagcactttaagatcttcaactacaccatttcttgaagaattttttaaaaactactctttcaagggtattacagataaacccgtggatgttttactgtccatttttgtcatttttttctttgagattttttaattccacaaatcctccgacgtcacctattattgtatgagtaacttctattcatttcccaatgaaagaataatagcttcttaaatatttttatcatgtttaagggtgtgcatatttatttaatcagaagtaaaacaagaacaaattctaggaaaaagaaattcagtaaggaagagggctttttcgtctaattttaactaaatctttgatatttgattctctactcttaaccaaagtattcaaattatttaggaatttcaatgaccttgctttctaaattaggaaaacagccacaccaatcaatttgctaggtgccatattgctttgtataagttattttccatcaaggatttgtgtctgctttgtgtgctgctatataataattatgtcttgctgaagttcttctgcttattgaattcctctactgaagttccttacttattcaaataagtaaggtaggaggtacttagtcaattgagcagctaattggctaaaagtgtcttgagcacaagataagcatgtactgaaaaactgagtatctcttgtccattgttaactgtatttctaatggttgattgcatttaaattaaataattcacccctacaa

SEQ ID NO: 4265 - DNA, 3165 bp, Homo sapiens
cccaagaggggtcttactcatccttttccattttggagaggttctgctgactctacattaagcccagacagggtggtgtcctgctttgctcctttctgctctctgcgttcctctgctgccttgatggattctgatgtggttgctcagatgatcagcctgcaggagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaataca

SEQ ID NO: 4266 - DNA, 4334 bp, Homo sapiens
cgcacacgctcacacgctcgcaagcgaacgcaggaaagtcaggctaaaagtgtctgctgctgctgccgccccccactccgcctccgggagagaatacaaagaaatggtgttacctggcaagaggtcttctgtcttttatgaaaaattagacaaagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagcagacaaacccagggagcactgaatgaatccgatgatcctgaaacaggctgtctaactgataacaagccaacttctcgacacttctatcctgtcgccttgctgcttgtcagctcacacctgctagttgtgtggcttattttaagtctggcgttactcttagccaaataccaataagttttatgttgtattcctttttcttttctacaaatgacaatgaactttaaattatggggacaatgctgtaatatttttacattttcaaattcacagaatttaaaaaatgttaaattgtgtttagtttgtttttcctaaaatctaaaaaacaaaaagtactatgcattaggtggattattttgctcttttgttcatggaaaggtgtttcccactgttaactagctcaagaagaatttttaaattactgtctttggaataagacaaagaacagaatcctgaaagcttgaagttctgaacctcctgtcctcatcccactaaatttattaaagaaattaagactgaaatttgcacaaacactgaaaccctgagacaagttctagagatgtgggaggttgcagactttatttccactgtgctaatatcatagatgccatctgctgatagaaattttttttaacctgttttacttctttgctgcaattaactcttttctgtcaagtaactttatggagagaatggctatttatgttttgtaattaaattacctgtttgtatctcttgtttgggttgatttggctttcagaggacttttctattctttttaacaaggtcttgtttgtgtcttgatgtaccattcccagcacttgtgacttttgtactgtccgtggacaagcactcttcctttataaagctgagacttggcccaggctgttcagaaagccattttctctcttccttgcacagctaaaataataaaatagagatgaaatttttctttaaaaatctatagggccagacttaataaattaaatgccttatttctagaacctgcatccttagggctacatatagattttaatgtgttttaaagagactgagaaattaatttgtggaaatgttataaaaaggcagatatatttatgaaactaaagtggagctgtattgtggagcaaattatatttaaagagtttattaaattttaaatgttaagagtaaagagacttaagtcatctctttcagagggcaataatggtattgggcctggcctaggatttaattttgtaagatgtatcatcacttgtggaaaaaaaaaatgtagagttgaatctttgttatttttacttggatggttgctgcaactctgcattaaacaaataaagcatatttattta

SEQ ID NO: 4267 - DNA, 2855 bp, Homo sapiens
ggatgtttcctgccctcgaacatcagaatccatgtttttcagcttttgggctcttggacttacaccagtggtttgccagggccccccagccttcgaccacagattgaaggctacactgttggcctccctacttttgaggttttggaacttggactggcttccttgctcctcagtttgcagacagcctattgtggaacttcaccttgtgatcgtagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaa

SEQ ID NO: 4268 - DNA, 8831 bp, Homo sapiens
cacacgctcgcaagcgaacgcaggaaagtcaggctaaaagtgtctgctgctgctgccgccccccactccgcctccgggagagaatacaaagaaatggtgttacctggcaagaggtcttctgtcttttatgaaaaattagacaaaggctttacaggaggcatagtactggaaatctgctcctgatgaggtctcagaaagcttccactcgtggtggaaggcaaaggaggagcaggcacatcacatgagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaatacatttcagttggataatcttcaccttggtcttttttgtttgtttttattgtcatgaatttgtggtgggggagatgatcacagatgtttcccaaaatctaggaactacttcaattcatcatcagcatattgctctgaaagaaatccattttaaaaaatcttacatgattcagtactgtcatttctagttctaagcttctatgtgttgagcctagctgattgagattggttcacaaagtgtaaatttcattcatgagtatttaaatgtttctgaggaaacatggatcatttcaataggactaggggtgattcacagagcaccactctccaaccaaatggaagagaggagagggggaaaaggaacatattttttttgtgatacaacttaatagcctatgagaacacagtcaacctgagaatcaatgtaagggatttaaaaaaaatgtgtagccactcaattaggtagagttaactcatgatctggaatactgaggcagtttgcaggtatgttccacaatgatctctatcatccagtcaaggtgtgactcctcccttgcaacaggcatatgcatggagtgagtaaagtggtcaacagacctttcaaaaccatggcatcttttcagaactctgacttgggttgtgtgatctagctgtgaatgtagcaatatagaacgtttaatagaatgataagcaaaacactgcaatgatctaaaattacaaataaaataaaaatgaacaacattttgatacccaaaatgaaaattcccatcagcctgaactttatgttgtgaagttcatgaatgtcagtgaggtatctctgagatgtttcttagcagtcatcctggtgtaagcatgcagttatggcataggtttgtgtgtgttaataagcctttaaaacatatgcaaccacaacaaatgataaagtaaaacaattattttctgttgccctgaatatcaaacttgcccttgcccttactcagcaaaataacatttataagttttccaaaatcccaaagtagaagtttccttaaaaaaatcatcttgtataataccagtattcaaacatgggtaaggttaatcacccccaatcactcaggagatagttgcagaatttgaattacaatctcttcttactttcctagcctgtggcttgtcacttctccaaattgccatgctaaatatgcatgaaaattgagggagaatgctagttaaaaagaaattaggatttatcactggaattgaaactaagagtacaaaagtctgaacgaatgaaacttttctccaaattttacaaattcttgttcctttctcattagaagagcatgctatccaaagcataaatctcccttgaaaataacagaggcttcttaagccctctcttagctatgatcaatggatgatattatgcttcccatagctaatgtgatagctccttgcctaggattcctgttgaaataaggattctagccccatgttaagtttttcaaattactacaaattttagataagcatttggagctttttatactagaattatcaattttttattttagctaattacctgtgggcattatacttgaggcaggtaccaaactacttacagcctttttaatgaaaatgtgctgtgtactttgaatccattcatagacaaaattaccttgatgttctcttaactcattctttattttagtgattaaatacaacctttgagttgttcaatatcatttgaaaatggtaggatttgtggttattttcattaccctattagatttaagataggctgggatgacagaggcctccttgaatagctatgaagcctcattcagcatatcaaatggtagtctgagttctaagaaaccttaagtaatttatcattctgtaaatactcttataagcaataatttttatttgtatttttgaaaacaaactacttaaatatggaaaaatattaactggaaagccagcagtagggttttctatttttaaaagacatttcaaggatttcctgtaatcccagcactttgggagccaaggtggatagatcacctgaggtcaggaattggagatcagcctggccaacatggtgaaaccccatctctactaaagatacaaaaattagctggatgtggtggcacacacgtgtaatcccagctacttgggaggctgaggcaagagaatcgcttgaaccccggaggcggaggttgcagtgagctgagatcatgccattgcactccagcctgggtgaaaagagcgaaactccatctttaaataagtaaataaatgaataatatagaagtctcaaattatagtgcttactgtaatacaaatgcttatgaattttcattcattaccatagtcatctgcatttccttatagaaagcctgtactggtgcaaacttctaaaagtggatttcatcaagaaaatgtgtttcatagagacaacaatattgcttttttcctgagaggcagttcattcttaaacaaccacttcactatttcttaagttattaaggctaaatcaaagagcaaatgttaaagtgtttaaatctctcttgaacaaacacagccacagtcatgctattctatctatattttcacttaaaagatacaccagcagacctattttaggaggtcatattgagccaaaaaatgaactgagcaaatgacatttccaaactctttttttgctcaaaaataatatgttcccctttgatattaaatgcagatatcaattctggattagctatttactgagccctaggaaaaacatatttaaagacaaggaaaccattcatttacatctcatatcattgctttttgcttttaaatatcgccttgaggtttgtctacactctgccaaaacaatccctgaacataagtttggtcagcctcataattcagtgagtcgagcaaccatttgttccaagtgataaattgtactaaatgacaaactgcccaatcagggcagagctccatggacccagcctccagcccttattttataagactaacccctcttctgaaaaactctgaaggcttaaaagctagcatttggatggaggatacttcctttttatccttcagctatgtatggcactttacataaaataagaggtaaaaaaggagagaaactgatgtgtataaagtaatgcctttcttcccaagcaaatcaaacctctccctatgtaaaagttgatagtgtaccaagagacacaataccactggtgggctggaactagctcgttctgatgcataaaagttgataattaaagtaccagaaattttgtaagctagttgttaaacattaccattattaaatatgaaattataaaacacagtggaatacattaaaaaccaatgtaataatcaaaacataccacttcccaattattttactaccttatactatttattagtactcttgagtctatttaggtctattacatctttacagtgaaaacaggatacaatattgtgctactgtgggtctcttcctgactgcagattcagtaacatggtgttcgtagcttgaaactgtccacagtgggagtatttaacaccatagaaactggctggcaaatgctacaaactagcaattttaattcctggaaaggcaattgttgagcatttaccagcacacaatgaatgccatattcttttttttttattaggaaataaattattggaggcagtataaaattatttaaaaagtatcaaatgcaatcccttatcttcagatggctataattttggttatataaatgttttggtttttaccttctttaaagactcctattaggttaaaagtcatatttgatgactatattttattcataattaaattattaaatcaccttttctcctgataatgctttgccagagaattcttagcaattcaactgtagtctaagcaataactcagggctaaattcagggaactgttagcccaatcagatatcactaaaaatgtacttcaccatctattttggagtttataattttggcatttgctaaaagtaggaaaaacagtaacatattactgtgcccagattctaataaatatagctcaattgaaaccaaaactgttacattaaacaaattacactctggcactatgctaaatcaccacagatgttttaggtgtttgatttccaagcaggatggtatatcatttgtttggttcaatatatgaggcaccatttgtagtcttttaggaaataaattagcttttatcacagatttaggaaacttgtctaaaaaaactgtgatcatcagttacagagggaaggaaacatattgaacacaaggcatcatagtagctggaggccttaaaaattatgcacgaccaaaaagaatgatttggtgagagatgtgtagctgattgacaattttagtgtgaattcatattcatttaacccagcagcaatctacataagctatgctttttcccacctgtatttatgtttcttagcttataaagtcccaatatattatatcttttgttgctttggcagttttaatttagagctctgcgttcacagagatgccacctatagcaaaaactatctttaagaattggaaaataaaatgaatgttttagataaaatattgcaagccattatgtgtagagttaatgtatggaaatttgcatttgtttttctgaatcatggtgtacattaatcactcattgaattctatttctaagcaaataagagaatcaaacatttctaaaaggaacatatgtcttgctattaataacaaggagacaggaaaaatagtaaggtaatataagcaaaaaaaaaaatgtaatgaatttagctatcctaaattggaatttttacagattgcatgcatacttagaattttaaatttttaaaagatttacaattgagtatggtacccacagagagtgagtaccaagggaaggaagacctaatacaagtgatgttgcctgataaatcacatcttgccaaaaaaaatatattttagtaaatacagttctttaggaagaaaaatgttgccctttcacactcacagtgtaaatacattcataatattccttcaatcatctaaattaccgccaggtcatgaaaggacgcgatcaatgatgacctattgcactcacaggtaacattgactcaaattttggcaatattgctatattatctagataattcttgtgatgtttttatgtcactatcaacattaaaaatattttgttaaacaactatgaaactttcaaaagtttgcatataactgtatgggcactctcatttcactgcatacatacaatactttgtatacacatacttctcgtgtggatattttataattttatttaatctaacatttaacttttaggtttttgtggtactcatctgaaaggttggcatttgttttctttttatgttatatatgtattttagatgaatcaataatgtgtattcctagaaattttttctaggcataaatagatcattttatgttggcatttaagagatatcatttttgttttattgttctgtgtaaaccatattcattgtacactgtgtgtatatttttgtttaaataaatgatttttatttttta

SEQ ID NO: 4269 - DNA, 2263 bp, Homo sapiens
atatctggaatacaaagttgttgctgccagtgatttgaggaattctaataagaggaacaacagcattgcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatcc

SEQ ID NO: 4270 - DNA, 2429 bp, Homo sapiens
atgatacattttcaccctttaatcctaccccatgagcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaatacatttc

SEQ ID NO: 4271 - DNA, 4925 bp, Homo sapiens
tctcctcctaccggtcgggtgccccggggcgttccctctgccgctgcttctcggcgcggttcctacccggccgctccccgaggcgcgggctctggcggcctcgaccgactaggacgccccgtgcgccgcccgcgggccgccgcctccctgggcgcgcggggccagcatggagctcttccaagccaaggaccactacatcctgcagcagggcgagcgcgcgctgtggtgcagccgccgcgacggcggcctccagctccgacccgctactgatctacttcttgcctggaatcccatttgtttggggttggtagaaggtgttattgggaaaattcaacttcattcagatcttccatggtggcttattctaattcggcagaaagcattggtgggcaaactcccaggagaccatgaggtctgtaaagttaccaaaattgctgtgctctcactttctgaaatggaacctcaggatcttgagctagagctctgtaagaagcatcattttggtattaacaaaccagagaagatcataccatctcctgatgactcaaagtttctactgaagacctttacgcatattaaatccaatgtgtctgctcctaataaaaagaaagttaaggaaagtaaagagaaggagaagttggagaggagattacttgaagagttgctgaagatgttcatggactcagaatccttttattatagcttgacctatgacctgaccaattccgtgcagaggcagagcactggggagagggacggtcggcccctctggcagaaggttgatgaccgatttttttggaataaatacatgatacaagatcttactgagattggtactccagatgtggacttttggattatccccatgatccaaggttttgtgcagattgaagaacttgtggttaattataccgaatcatctgatgatgagaaaagcagcccagagaccccccctcaggagtccacctgtgtagatgatattcacccacgatttctagtggctctcatttcacgccgaagtaggcacagagcaggaatgcgctataaacgaagaggagtggataaaaatggaaatgttgccaattatgtggagactgagcagttgattcatgttcataatcataccctgtcatttgttcaaacacgaggctctgtgcctgtcttttggagccaggttgggtatcgatataacccaagaccgcggctggacagaagtgaaaaggaaactgttgcctatttctgtgcccatttcgaagaacaactgaacatttacaaaaaacaggttattattaacttggtagaccaggcaggaagagagaagattattggcgatgcttacctgaagcaagtgttgcttttcaacaactcacacctcacttacgtttcgtttgacttccatgagcactgccgaggaatgaagtttgagaatgttcagacactaacagatgccatttatgacattattcttgatatgaagtggtgttgggttgatgaagctggggtaatatgtaagcaggaagggatttttcgtgttaattgtatggactgcctggatcgcaccaacgtggtccaagctgccatcgcgagagtggtcatggaacagcagctgaaaaaattaggtgtgatgcccccggaacagccattacctgtgaaatgtaatcgcatctaccagataatgtgggccaataatggtgactccattagcagacagtatgctgggacagctgctctgaagggtgactttacaaggacaggagaaaggaagttagcaggagttatgaaagatggagtgaactcagcaaacagatattacctcaaccgatttaaggatgcttataggcaagctgttatagatttgatgcaaggcattccagtgacagaagatctttattccatatttaccaaggagaaagaacatgaagctttgcataaggaaaatcagagaagccaccaggaactaattagccagctcttacaaagttacatgaagttactactgcctgatgatgagaagttccatgggggctgggccctcattgactgtgaccctagcctcattgatgctactcacagagacgtggatgtgctgttactgctttctaactctgcctactacgtggcctattatgatgatgaagttgataaagtaaaccagtatcaacgactaagtctagaaaacctggaaaaaattgaaataggccctgaacccactctttttggtaagccaaagttctcctgcatgcgactgcactacagatacaaagaagcgagtggctatttccacacattgcgagctgtaatgcgtaatcctgaagaggatggaaaagatacccttcagtgcattgcagagatgctgcagatcaccaagcaagccatgggatcggatttacccataattgagaagaaacttgagaggaagagcagtaaacctcacgaagacatcattggtatcaggtctcaaaaccaaggttctttggcccagggaaagaattttttaatgagcaaattttcatctctaaatcaaaaagtgaagcagaccaaatccaatgtaaatattggcaacctccgaaagctaggaaactttaccaaacctgaaatgaaagttaactttctaaaaccaaacttaaaagtaaatctttggaaatcagatagtagtcttgaaactatggaaaacacaggagtgatggataaggttcaggcagagtctgatggggacatgtcttcagataatgactcataccactctgatgaattccttacaaattctaagtctgatgaagacaggcagctagctaactcattagagagtgtagggccaatagattacgttcttcctagttgtggtattattgcctcagcgcctcgattgggcagtcggtcccagtctcttagcagcacagatagtagcgttcatgctccttcagagattactgttgctcatgggagtgggcttggaaaaggccaggagtctcctttgaagaaaagtccttctgctggcgacgtacacatattgactggctttgccaagcctatggatatttactgccacagatttgtgcaagatgcacagaacaaagtgacccacctatcagagaccagatctgtgtctcagcaggctagtcaggaaagaaatcaaatgaccaatcaagtttcaaatgaaacccaatcagaatcaacagaacagacaccttctcggccatcgcaattagatgtctctctttctgcaacaggcccacagtttttgtcagttgagccagcgcattcagttgcatctcaaaaaacccccacctccgcttccagcatgcttgaacttgagacagggcttcatgtaactccttctccttcagagagcagtagcagcagagcagtctctccctttgccaagattcgaagttccatggtccaggttgctagtattacccaagctggattaacccatgggataaactttgcagtgtcaaaagttcagaagagtcctccagaacctgaaatcattaatcaagtccagcaaaatgaacttaaaaagatgtttatacaatgccagacacggataattcagatttagcttttagccataagaatccttccatggcttttatttaaaaatatgaaattttcacctcttggggtattttaattgtactgtctgaacccagggatcacaaattctgttcattggaaagggttttaaacggagtcggaacctgagtagatttccaaattttacagccaggactacagaagtgcatcattctagaatgtgtagacctgagtagcttatacactacagagcactttgcttatttgaaagtaattcagcaacaggtcactttgggatataacctgaacctttttttggagtggggtgggtagactacagtagacacaagggctggacatgcagatgcttaggggattagcgtttttcataatttgttctgtttgtcagttcattcctgtgtgttcttacctctacaaagtaaattacacatttagtttttagtgactttaacatgttactgaagcatttgaatataaagctattttagttttgatggcttaactgttccctgaggagttgagggttattgacactagagaaatgaattctcatttgatcctaattttccccgtattctacttgaacacattaaaaatactctgctgcctatacaatgtaaacctaggagcattaagacttgtcacacagtaaacctgatacatcagaggtgaataccagcacctattaggtttcattttgctgttttcaggaatgtaagaacacccatattggctactggaaattctagaagtcagtcaggttttaatttattccaggaggggcatcctcgacatcttatgtagatgatccacaacttcaaaatttagtctgggcctagtgcagtggctcacacctataatcccaacactttgggaggccaggagttttgagaccagcctgggaaacatctgtctctacaaaaaaatacaaaaattagctgggcatagtggtgcatgcctgtgtttctagctacgcaggaggattgcttgagcccatgagattgaggctgcagtgagctgtgatcgtgccactgacctccagcctgggggacagagcaagaccgtgtctcaaaaacaatttagtctgaaacacaattgtgctgaatctgtctgactataactctgaccacacagaaccagggctgcccctgtaatccccacagtaagaaagttgtatggcatattccaacaagtattggttcgtctggtgtctttagagctttactctgttgaagtgactgattctcaactgaacattatgtcgttactttgataagcattccacttttgttatttattagtgctatcttttttttttacgtgttaaatcttgtgattattaaaataaagtaccattgtaattt

SEQ ID NO: 4272 - DNA, 2882 bp, Homo sapiens
gcattcgccgcattcgctgcaggcgcgaggttgggtgcaggcagctgtttgagcctcgaggcatcgacggacggacagacggacggactgactgacgatgccgcgctctcacaggcctccgcctaccgcgcagcgggctgccactgccgcagcagccgagcccaagtctgagggcgttgtggctatgactttcaagatttttctcctttttgcagggcttatggttaaagttcctgtggggttatatttttcctgcaaattacttcttttccaaagtctgatgttgatgtcccctgaagacagcggcttttatgcgaccattgttgcagtggtcgggcttcatgtggtgctggcaattttcgtcttcatagtgtggaaggagggcttgccccagtggcgggaaaacaaaaacgaatagagcagcttcttcagagctgcagacgtggggggtggggaaatacctaaagggtttttgtcttgtttcttgttcgtattgaacgtgctttttttttttttttttttttttttaaaggggaagggtgggtggggagggaattaaatatttactgcagctaagacttcagtaaaattgggggtggggggagggttgacattttccgactgcctgttacgtgccaagtgctttttgttaaggacataatgtttttgactggggatcatgtttggctgatgtaaatattaatgccaaaataggagctaggatgaaagtaacactgtaattagtagtagaatttatttcatattaaaatgtgtcatgacgtaatttttatggcttggctcaagcaacaattttcagagtgcaccctcattgatgctactcacagagacgtggatgtgctgttactgctttctaactctgcctactacgtggcctattatgatgatgaagttgataaagtaaaccagtatcaacgactaagtctagaaaacctggaaaaaattgaaataggccctgaacccactctttttggtaagccaaagttctcctgcatgcgactgcactacagatacaaagaagcgagtggctatttccacacattgcgagctgtaatgcgtaatcctgaagaggatggaaaagatacccttcagtgcattgcagagatgctgcagatcaccaagcaagccatgggatcggatttacccataattgagaagaaacttgagaggaagagcagtaaacctcacgaagacatcattggtatcaggtctcaaaaccaaggttctttggcccagggaaagaattttttaatgagcaaattttcatctctaaatcaaaaagtgaagcagaccaaatccaatgtaaatattggcaacctccgaaagctaggaaactttaccaaacctgaaatgaaagttaactttctaaaaccaaacttaaaagtaaatctttggaaatcagatagtagtcttgaaactatggaaaacacaggagtgatggataaggttcaggcagagtctgatggggacatgtcttcagataatgactcataccactctgatgaattccttacaaattctaagtctgatgaagacaggcagctagctaactcattagagagtgtagggccaatagattacgttcttcctagttgtggtattattgcctcagcgcctcgattgggcagtcggtcccagtctcttagcagcacagatagtagcgttcatgctccttcagagattactgttgctcatgggagtgggcttggaaaaggccaggagtctcctttgaagaaaagtccttctgctggcgacgtacacatattgactggctttgccaagcctatggatatttactgccacagatttgtgcaagatgcacagaacaaagtgacccacctatcagagaccagatctgtgtctcagcaggctagtcaggaaagaaatcaaatgaccaatcaagtttcaaatgaaacccaatcagaatcaacagaacagacaccttctcggccatcgcaattagatgtctctctttctgcaacaggcccacagtttttgtcagttgagccagcgcattcagttgcatctcaaaaaacccccacctccgcttccagcatgcttgaacttgagacagggcttcatgtaactccttctccttcagagagcagtagcagcagagcagtctctccctttgccaagattcgaagttccatggtccaggttgctagtattacccaagctggattaacccatgggataaactttgcagtgtcaaaagttcagaagagtcctccagaacctgaaatcattaatcaagtccagcaaaatgaacttaaaaagatgtttatacaatgccagacacggataattcagatttagcttttagccataagaatccttccatggcttttatttaaaaatatgaaattttcacctcttggggtattttaattgtactgtctgaacccagggatcacaaattctgttcattggaaagggttttaaacggagtcggaacctgagtagatttccaaattttacagccaggactacagaagtgcatcattctagaatgtgtagacctgagtagcttatacactacagagcactttgcttatttgaaagtaattcagcaacaggtcactttgggatataacctgaacctttttttggagtggggtgggtagactacagtagacacaagggctggacatgcagatgcttaggggattagcgtttttcataatttgttctgtttgtcagttcattcctgtgtgttcttacctctacaaagtaaattacacatttagtttttagtgactttaacatgttactgaagcatttgaatataaagctattttagttttgatggcttaactgttccctgaggagttgagggttattgacactagagaaatgaattc

SEQ ID NO: 4273 - DNA, 611 bp, Homo sapiens
tctttcagatcttccatggtggcttattctaattcggcagaaagcattggtgggcaaactcccaggagaccatgaggtctgtaaagttaccaaaattgctgtgctctcactttctgaaatggaacctcaggatcttgagctagagctctgtaagaagcatcattttggtattaacaaaccagagaagatcataccatctcctgatgactcaaagtttctactgaagacctttacgcatattaaatccaatgtgtctgctcctaataaaaagaaagttaaggaaagtaaagagaaggagaagttggagaggagattacttgaagagttgctgaagatgttcatggactcagaatccttttattatagcttgacctatgacctgaccaattccgtgcagaggcagagcactggggagagggacggtcggcccctctggcagaaggtaccactcacagctcgtagagcagggtttgcacttgggaagaagtgatggcctgttttggcttttgtaggaaaactgaaataatgtgtttctgaactattgttcctgcaccttttctaggttgatgaccgatttttttggaataaatacatgatacaagatcttactg

SEQ ID NO: 4274 - DNA, 1294 bp, Homo sapiens
tctcctcctaccggtcgggtgccccggggcgttccctctgccgctgcttctcggcgcggttcctacccggccgctccccgaggcgcgggctctggcggcctcgaccgactaggacgccccgtgcgccgcccgcgggccgccgcctccctgggcgcgcggggccagcatggagctcttccaagccaaggaccactacatcctgcagcagggcgagcgcgcgctgtggtgcagccgccgcgacggcggcctccagctccgacccgctactgatctacttcttgcctggaatcccatttgtttggggttggtagaaggtgttattgggaaaattcaacttcattcagatcttccatggtggcttattctaattcggcagaaagcattggtgggcaaactcccaggagaccatgaggtctgtaaagttaccaaaattgctgtgctctcactttctgaaatggaacctcaggatcttgagctagagctctgtaagaagcatcattttggtattaacaaaccagagaagatcataccatctcctgatgactcaaagtttctactgaagacctttacgcatattaaatccaatgtgtctgctcctaataaaaagaaagttaaggaaagtaaagagaaggagaagttggagaggagattacttgaagagttgctgaagatgttcatggactcagaatccttttattatagcttgacctatgacctgaccaattccgtgcagaggcagagcactggggagagggacggtcggcccctctggcagaaggttgatgaccgatttttttggaataaatacatgatacaagatcttactgagattggtactccagatgtggacttttggattatccccatgatccaaggttttgtgcagattgaagaacttgtggttaattataccgaatcatctgatgatgagaaaagcagcccagagaccccccctcaggagtccacctgtgtagatgatattcacccacgatttctagtggctctcatttcacgccgaagtaggcacagagcaggaatgcgctataaacgaagaggagtggataaaaatggaaatgttgccaattatgtggagactgagcagttgattcatgttcataatcataccctgtcatttgttcaaacacgaggctctgtgcctgtcttttggagccaggttgggtatcgatataacccaagaccgcggctggacagaagtgaaaaggaaactgttgcctatttctgtgcccatttcgaagaacaactgaacatttacaaaaaacagcaacaaaaatga

SEQ ID NO: 4275 - DNA, 1867 bp, Homo sapiens
atgagcaaacgaaagtggcgcggatttcggggcgcccagcaggagcgagcgcagccgccagccgcaagtccgcagccgtgtcccgcgccccacgccggcctccccggcggcagccggagacgagcgccagcaccggcgggacagcagcagatgcgggccgagagccggtcaggggcgcagaggcggaggggatcggcgcggcggggagctcaccgcgaagctggaggctgcgtccgcgggcgcaccaggagctcaggcagcgagcgatcgaacgctctgtggcaggcggtggacgctgctgaagctctggctctgagctcaccgctccgccgtccgtgggaccaagcccagcattttacaaacccagctcctttctccaagggtcctcagagcgcccctccgtcaccccctgcagggcgccgcagacgaggcgctgaccttgcgctcactcccctcgctggggaaggacacactcgctggcgtcagcccggccggcctgggaagtaggactaaggacccgaactgcaaccctccacaccagacagcacagaccaccccaaggctgctcaatctgcccaaagccaaaagtacgtgggggatatgggtccaggttggggtgcttgggagagggccctgggagaggggttcagacggtgcacactccaaaggactgaggcggcgccactgtgttaccattttattgagtgtctaaggtaaagacacctttgaaagaacactcccggcttctatctgggatgggcaaatcagcctgaagagtcacctgctggatccctccctgcaggccctgtcgtggggcaggtacagggactccaatccatgtgcctccagctccaacgctccccaagtcctggagcctcccctgtcaccccagtgcctgaccagtgaatgggtgctgcccccactacagagctccctctggctgaggcagaggccactggctgggcctttctagccacctttcacccctcttgcacacgggaagccccgcaggctcctgaccacaatgggatcctgacgccggagccccttaggccctttgctcagaaggcctctggttattacctcaattctgaacagccaggaggcctgagactgtcacccactttgataaatacagaccgacagaaaggtcaggccattggtgcaagaccccatggccagcagcctggggcggggagaacccgggggtctcacagcccccagcagagcccagctttccttgggtttttaggttcttccccaatgatattttccctttttccctctctacccactttctgccccccatcttctcccctttggctgcccgctctctccctgcccctctccccttctttgccctctttcgtctcccaggagctcccctgccaggacctcggtgccgtggagactgcggggaacctgctctgcccacacctgctctggcccctagacggaagcacctggagccaaccacggaactccagatcccagctgtgtgactgaatccacgccagcctctctgagccaaagctgcttgcagaagggggagatcccagttcgaagactcccgcgcagagcctgtggccctctctgccaggcctcagggtgcctgagacactcacctctctgcctcgcagttggggctgaggctggggctggctgccagcctcagttctgggagcgctggggtcgcctgggccacaggccacagcagctcacctcaggactgggctctctggcctgctggggctcaggctgtggggcaggctgggcagggggctgagctggcagcgattcagagccctggggctgggggctggaatccacctcctcccacacaagctcggtggtgactcttcggccc

SEQ ID NO: 4276 - DNA, 4506 bp, Homo sapiens
ccttccactatggccgcttctgtgtggtgtggggagacgctggtcctccccgtcctcccatagcgcttattgcctcaccctcaccccctaggggccggatccaaaggcgctgcactccccaagccttggggcatcagccaggaaggtttcctacctcctaattcaggggcaggactcctcttttccccccacggggaaaagaggcagaaacttaggggtttccctcctttcttagggtcagacgctcttagggtccacttcttcaggggcggaagcctctcctacccttcccatagggacacaggcctttaccccactgtacttcggagccaacgcctttccctcagcactgccaccccagagtcaggacccagaggactgtgccttcgcccccaacgcaggcgcggccttttggagaggagggaggagtggagaggacaggggcccttgctctcccctccccaacttgttcctcttgccccccagtccctggcaatccagagatcccgatatctaggactgtccatccatccactccctgaccttttcccggctcctggctgcagccatggagttgcagaagggaaaaggggcggcagcagcagcagctgcttcgggagcagcgggaggtggaggaggaggagcgggagcaggagccccaggaggggggaggctgctactttcaaccagtttggatgccaaggatgagttagaggagagattggaaaggtgtatgagcattgtgacatcgatgactgctggtgtctcggagagagaagccaatgatgccctcaatgcgtatgtgtgcaaaggcctcccccagcatgaagaaatctgcctgggcctgtttactctcatcctcactgaacctgcccaagcccagaagtgttaccgggacttagctctggtgagtcgtgatggcatgaatattgtcctgaataaaatcaaccagatacttatggagaagtacctgaagctgcaggatacctgccgtactcagttggtgtggttggtacgggaactggtgaagagtggggttctgggagccgatggtgtttgtatgacgtttatgaagcagattgcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtc

SEQ ID NO: 4277 - DNA, 2361 bp, Homo sapiens
gaggaagaggcagagattggaggttcaggcagtgacgtaacttgctgccttaggtggccttccgctctggcggctgtcgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacgttaaatgaactggtggtgggagacaccagcgggaaggtgtctgtgtataaaaatgatgacagtcggccatggctcacctgttcctgccagggaatgctgacttgcgttggggttggagacgtgtgtaataaaggaaagaacctgttggtggcagtgagtgctgaaggctggtttcatttgtttgacctgacacctgccaaggtgttggatgcttctgggcaccacgagacactaatcggagaggagcagcgtccagtcttcaagcagcacatccctgccaacaccaaggtcatgctgatcagcgacatcgatggagatgggtgtcgtgagctggtggtgggctacacagaccgtgtggtgcgagctttccgctgggaggagctaggtgagggtcctgaacatctgacagggcagctggtgtccctcaagaaatggatgctggagggtcaggtggacagcctctcagtgactctggggccactgggtcttcctgaactgatggtgtctcagccaggttgtgcgtatgcaattctactgtgtacctggaaaaaggacactgggtcccctcctgcctctgaagggcccacggatggtagtagggagaccccagctgcccgagacgtggtgctgcaccagacatctggccgtatccacaacaagaatgtctccactcacctaattggcaacatcaaacaaggccacggcactgagagtagtggctctggcctctttgccctgtgcaccctggatgggacactgaagctcatggaagaaatggaagaagcagacaagctgctgtggtcagtgcaggtggatcaccagctctttgccctggagaaactggatgtcaccggcaacgggcatgaggaggtagttgcatgcgcctgggatggacagacatatatcattgatcacaaccgcaccgtcgtccgcttccaagtggatgaaaatatccgtgccttctgtgcaggcctgtacgcctgcaaagagggccgcaacagcccctgcctcgtatatgtcactttcaaccagaagatctatgtgtactgggaggtgcagctggagcggatggagtctaccaatctggtgaaactgctggagaccaagccggagtaccacagcctgctgcaggagctgggcgtggatcctgacgacctccctgtgactcgtgccctgcttcaccaaacgctctaccatccagaccagccaccacagtgtgctccctcaagcctccaggatcccacctagctgtacttgcctcatagctggtgaaggattcttctgaacccccaccctaccccctaaaggtatctgtggtattggcaggatagggaatatgcattacagaaatgcaggatttgactctgggcatgaaagatggcagcagccctagggtgaccgtgaactatagacctcgcagtcttttcggtgaaagaagagacaagttgaccctctgcccatttccttatggacctcacccatcatgccagcagggtcataggaccctggccttgttccaaatcatctgggacatgacccactccccactgtcactgtgttgaaaacagagacttgtttgtgtggccccaacacccataaggaaaccaggctttaggcccaggggagcagtggaggtaagggctccaccccatcttaagctctgtcttccgtggcacaattccaagttcttgacgttagtaattgttaaaggaatggcaaactgttttgttttgaaggatctttctacagtctggtcttacccatgttcctagcaaccctgagatgattttcttccatttaccaaagcagccgggtcagtgctttctcacgttgccgtattcttcaggtattagtcagcttcagaagccctgctcccatttttccacccacccattcccccataaaacagcttattgtctccaagacaatagacatttaaaatgtgatgcgggtttatgatccagaccacaatcagaattatatcttgggtcatttatgtgccgtctgttcttgattctctatgctctaaatcggtgtttttcaaactgtggttgcagtcctttggtggattatggccagcattttttaaataggtagaatagaataaagtaaaatagaaaatagca

SEQ ID NO: 4278 - DNA, 1419 bp, Homo sapiens
gctctggcggctgtcgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacgatggagatgggtgtcgtgagctggtggtgggctacacagaccgtgtggtgcgagctttccgctgggaggagctaggtgagggtcctgaacatctgacagggcagctggtgtccctcaagaaatggatgctggagggtcaggtggacagcctctcagtgactctggggccactgggtcttcctgaactgatggtgtctcagccaggttgtgcgtatgcaattctactgtgtacctggaaaaaggacactgggtcccctcctgcctctgaagggcccacggatggtagtagggagaccccagctgcccgagacgtggtgctgcaccagacatctggccgtatccacaacaagaatgtctccactcacctaattggcaacatcaaacaaggccacggcactgagagtagtggctctggcctctttgccctgtgcaccctggatgggacactgaagctcatggaagaaatggaagaagcagacaagctgctgtggtcagtgcaggtggatcaccagctctttgccctggagaaactggatgtcaccggcaacgggcatgaggaggtagttgcatgcgcctgggatggacagacatatatcattgatcacaaccgcaccgtcgtccgcttccaagtggatgaaaatatccgtgccttctgtgcaggcctgtacgcctgcaaagagggccgcaacagcccctgcctcgtatatgtcactttcaaccagaagatctatgtgtactgggaggtgcagctggagcggatggagtctaccaatctggtgaaactgctggagaccaagccggagtaccacagcctgctgcaggagctgggcgtggatcctgacgacctccctgtgactcgtgccctgcttcaccaaacgctctaccatccagaccagccaccacagtgtgctccctcaagcctccaggatcccacctagctgtacttgcctcatagctggtgaaggattcttctgaacccccaccctaccccctaaaggtatctgtggtattggcaggatagggaatatgcattacagaaatgcaggatttgactctgggcatgaaagatggcagcagccctagggtgaccgtgaactatagacctcgcagtcttttcggtgaaagaagagacaagttgaccctctgcccatttccttatggacctcacccatcatgccagcagggtcataggaccctggccttgttccaaatcatctgggacatgacccactccccactgtcactgt

SEQ ID NO: 4279 - DNA, 1935 bp, Homo sapiens
ggctgtcgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacgttaaatgaactggtggtgggagacaccagcgggaaggtgtctgtgtataaaaatgatgacagtcggccatggctcacctgttcctgccagggaatgctgacttgcgttggggttggagacgtgtgtaataaaggaaagaacctgttggtggcagtgagtgctgaaggctggtttcatttgtttgacctgacacctgccaaggtgttggatgcttctgggcaccacgagacactaatcggagaggagcagcgtccagtcttcaagcagcacatccctgccaacaccaaggtcatgctgatcagcgacatcggtgggcatgcctacctttgcaggcagccaggagagtaggagtcagtggatactagagcatatcccaagggattgggatggagatgggtgtcgtgagctggtggtgggctacacagaccgtgtggtgcgagctttccgctgggaggagctaggtgagggtcctgaacatctgacagggcagctggtgtccctcaagaaatggatgctggagggtcaggtggacagcctctcagtgactctggggccactgggtcttcctgaactgatggtgtctcagccaggttgtgcgtatgcaattctactgtgtacctggaaaaaggacactgggtcccctcctgcctctgaagggcccacggatggtagtagggagaccccagctgcccgagacgtggtgctgcaccagacatctggccgtatccacaacaagaatgtctccactcacctaattggcaacatcaaacaaggccacggcactgagagtagtggctctggcctctttgccctgtgcaccctggatgggacactgaagctcatggaagaaatggaagaagcagacaagctgctgtggtcagtgcaggtggatcaccagctctttgccctggagaaactggatgtcaccggcaacgggcatgaggaggtagttgcatgcgcctgggatggacagacatatatcattgatcacaaccgcaccgtcgtccgcttccaagtggatgaaaatatccgtgccttctgtgcaggcctgtacgcctgcaaagagggccgcaacagcccctgcctcgtatatgtcactttcaaccagaagatctatgtgtactgggaggtgcagctggagcggatggagtctaccaatctggtgaaactgctggagaccaagccggagtaccacagcctgctgcaggagctgggcgtggatcctgacgacctccctgtgactcgtgccctgcttcaccaaacgctctaccatccagaccagccaccacagtgtgctccctcaagcctccaggatcccacctagctgtacttgcctcatagctggtgaaggattcttctgaacccccaccctaccccctaaagaatgcggacccagaatgattggagagcaagaagagcaatccacatagaagaagcacagagcaaagacggtggccgaggaccagtgggaatttattgcgaatgttcaatagtgactgagtggttaagtggttccagagattacagggccaatgccttagaacacatgagttttttccagaattacgttatccatgcacacacaccatttgtctgtgtagagcacactgaggagtacttacttaatttaagtattgtattttgaccaaggaaggggggcagagtaatggtggtgacagatggagttgcaccgaggagacatggcttggggcagggaggaaggaggtagaggatcctggttaggtccaggctagggagagaggtgcccttt

SEQ ID NO: 4280 - DNA, 1124 bp, Homo sapiens
ttggccctgacctcgttggaaaacgaagctccccgcagggtcccggcctctagggctgctgtgcgggcgggggtggcctggagctatttccattcggcggcgggaacaggtgccggcgcctccgccccatccccaggggccgcctcccccggggcggcctccaggctgccgagacctataaaggcgccaggttttctcaatgaagccgggacgcactccggagcgcactgcgtggtcgcaccctacccgggctgccttggaagtcgtccccgccgcccctccgcaccggcatgaagctcatcgtgggcatcggaggcatgaccaacggcggcaagaccacgctgaccaacagcctgctcagagccctgcccaactgctgcgtgatccatcaggatgacttcttcaagccccaagaccaaatagcagttggggaagacggcttcaaacagtgggacgtgctggagtctctggacatggaggccatgctggacaccgtgcaggcctggctgagcagcccgcagaagtttgcccgtgcccacggggtcagcgtccagccagaggcctcggacacccacatcctcctcctggaaggcttcctgctctacagctacaagcccctggtggacttgtacagccgccggtacttcctgaccgtcccgtatgaagagtgcaagtggaggagaagtacccgcaactacacagtccctgatccccccggcctcttcgatggccacgtgtggcccatgtaccagaagtataggcaggagatggaggccaacggtgtggaagtggtctacctggacggcatgaagtcccgagaggagctcttccgtgaagtcctggaagacattcagaactcgctgctgaaccgctcccaggaatcagccccctccccggctcgcccagccaggacacagggacccggacgcggatgcggccacagaacggccaggcctgcagcgtcccagcaggacagcatgtgagcgtttccctatgggggtgtctgtacgtaggagagtggaggccccactcccagttgggcgtcccggagctcagggactgagccccaagacgcctctgtaacctcgctgcagcttcagtagtaaactgggtcctgttttttt

SEQ ID NO: 4281 - DNA, 834 bp, Homo sapiens
ctccaggctgccgagacctataaaggcgccaggttttctcaatgaagccgggacgcactccggagcgcactgcgtggtcgcaccctacccgggctgccttggaagtcgtccccgccgcccctccgcaccggcatgaagctcatcgtgggcatcggaggcatgaccaacggcggcaagaccacgctgaccaacagcctgctcagagccctgcccaactgctgcgtgatccatcaggatgacttcttcaagccccaagaccaaatagcagttggggaagacggcttcaaacagtgggacgtgctggagtctctggacatggaggccatgctggacaccgtgcaggcctggctgagcagcccgcagaagtttgcccgtgcccacggggtcagcgtccagccagaggcctcggacacccacatcctcctcctggaaggcttcctgctctacagctacaagtaccagaagtataggcaggagatggaggccaacggtgtggaagtggtctacctggacggcatgaagtcccgagaggagctcttccgtgaagtcctggaagacattcagaactcgctgctgaaccgctcccaggaatcagccccctccccggctcgcccagccaggacacagggacccggacgcggatgcggccacagaacggccaggcctgcagcgtcccagcaggacagcatgtgagcgtttccctatgggggtgtctgtacgtaggagagtggaggccccactcccagttgggcgtcccggagctcagggactgagccccaagacgcctctgtaacctcgctgcagcttcagtagtaaactgggtcctgttttttt

SEQ ID NO: 4282 - DNA, 1972 bp, Homo sapiens
agaactctgtggatgaaccttgaaggagcctccaagcctgaaccaaagcactacagatcacctgctatcttcatagcaccatgagtgaagaatctgatggaaagcttattgaagacagcctgattcagctgagatgtcactttacatggaagttgttaattgaagcccctgaaattcctgatttagaaaacaggatctgggaagagattcagttcctggacaccaaatacaatgtgggaatacacaacctactagcctatgtgaaacacctgaaaggccagaatgaggaagccctggtcagcttgaaaaaggctgaagacttaattcagaaagaacatgccaaccaagcagatattagaagtctggtgacctggggcaactttgcctgggtgtattaccacatgggcagattggcagaagcccagacttacctggacaaggtggagaacacttgcaagaagtttgcaaatccttcccgctatagaatggagtgtccagaggtggactgtgaggaaggatgggccttggcgaagtgtggtggaaagaattatgaacgggccaagacctgctttgaaaaggctctggaagggaaccctgaaaaccctgaattcaatactgggtacgcaatcaccgtctatcgcctggataaatttaacacagcatcagggaggaataaggcattttctctgcacgtcctaaaacgagctgtcaggctaaatccagatgatgtatatattagggttctccttgccctgaagcttcaggatgaaggacaggaagctgaaggagaaaagtacattgaagaagctctgaccagtatatcttcacaggcctatgtctttcaatatgcagccaagttttatcgaagaaaagggtctgtggataaagctcttgagctcttaaaaatggccttggagacaacacccacttctgccttcctgcatcaccaaatggggctttgctacagggcacaaatgatccaaatcaaggaagctacaaactggcagcctagagggcaagatagggaaactgtggacagattggttcaattggctatatgcaaatttgaaaagactataatgttaaagcgaacatttgagatggcctatgttgacctggctgaaacgtatgcagaaataggccaccacagaaaggctgaggaacattttcagaaagggttacgcatgaagatctttgaagatcagctaaagcaagagattcattaccactacggccgtttccaagaacatcatgggaaatctcaagataaagcaattacccattatttaaaaggtttgaaaatagaaaaaatgtcccattccagggaaaaacttctcaatgctttagagaaattggctaaaagatgtattcaccagaatgtacgggttgtggaaagtgtcagcctccttgggcttatccacaaattgaaaggagaagtaagtgatgctttgctgtgctatgagagggctctgaggctggctgctgacctgaaccctatattttaacatagaggtcaccattatccatttaatggtcttataactaaatagaatgactatgaaattaaataatgcaaacttaaagctgttggaaatttaccttattttgagccttgagaggaatgtggctgtgtggcctgagttatgtagcatgcaactgcaacttctgctttttcctgtaaatgatcaggaaaggccttgtggcaccagacataagaccccctgaaagtatcatccctcctgatggaatggtaaagcaatctttcttggaacatagcaagtagtaaccgatcaaattgctataacgtgtgtactgaccttatgtggaaaatgctgcaaccctgtttactgcctatgtaagtgaaatcttaacttccccattttggaatgctgactccagtcattaggtgtctgtatttcctgagtggttaccctcaagctttgtgctcaaataaactctatacttaatcata

SEQ ID NO: 4283 - DNA, 4015 bp, Homo sapiens
atctgattcaatctccagtttcctgttcttgctggggctggggtctctcctttaacaaagacacgccgcgcggccgagtccaggggctgcagaggcctggcgcgcgcacgcgcacgcgcacgcccaccgcgcggcttcccgcggtccccggtgctgaggagagagcgatccgagggactgcgccgcccggacggcctgcagagcgctgccatcatgagtgaaattcgtaaggacaccttgaaggccattctgttggagttagaatgtcattttacatggaatttacttaaggaagacattgatctgtttgaggtagaagatacaattgggcaacagcttgaatttcttaccacaaaatctagacttgctctttataacctattggcctatgtgaaacacctaaaaggccaaaataaagacgcccttgagtgcttggaacaagcagaagaaataatccagcaagaacactcagacaaagaagaagtacgaagcctggtcacttggggaaactatgcctgggtgtattatcacatggaccagcttgaagaagctcagaagtatacaggtaagatagggaatgtctgtaagaaattgtccagtccttctaactacaagttggagtgtcctgagactgactgtgagaaaggctgggcactcttgaaatttggaggaaagtattatcaaaaggctaaagcggcttttgagaaggctctggaagtggagcctgacaatccagaatttaacatcggctatgctatcacagtgtatcggctggatgattctgatagagaagggtctgtaaagagcttttctctggggcctttgagaaaggctgttaccctgaacccagataacagctatattaaggtttttctggcactgaagcttcaagatgtacatgcagaagctgaaggggaaaagtatattgaagaaatcctggaccaaatatcatcccagccttacgtccttcgttatgcagccaagttctataggagaaaaaattcctggaacaaagctctcgaacttttaaaaaaggccttggaggtgacaccaacttcttctttcctgcatcaccagatgggactttgctacagggcacaaatgatccaaatcaagaaggccacacacaacagacctaaaggaaaggataaactaaaggttgatgagctgatttcatctgctatatttcatttcaaagcagccatggaacgagactctatgtttgcatttgcctacacagacctggccaacatgtacgctgaaggaggccagtatagcaatgctgaggacattttccggaaagctcttcgtctggagaacataaccgatgatcacaaacatcagatccattaccactatggccgctttcaggaatttcaccgtaaatcagaaaatactgccatccatcattatttagaagccttaaaggtcaaagacagatcaccccttcgcaccaaactgacaagtgctctgaagaaattgtctaccaagagactttgtcacaatgctttagatgtgcagagtttaagtgccctagggtttgtttacaagctggaaggagaaaagaggcaagctgctgagtactatgagaaggcacaaaagatagatccagaaaatgcagaattcctgactgctctctgtgagctccgactttccatttaaatacatactctaggaaattagctctaagtttttcccttcattttgggttctcctgtttgttttttttttattattttaatcccttgtttattatagagctaatatttattgaatagttattgtgtaccaagcattgtgctaaatactttatatgcattatgatgaatcttgtgcggttttctttctttttttctttttaattaaaatactataatccattgagaaatagcaatattctagctattgtaacttctaaaaatggtatggccattagatctgtgctttttatctctgctctttgaatttctcatattatatagtaaatatattcctacgtaaacctttgatacctagatcaggaatactcttccaggagtacaaaattacattattgatagttaagctcttaattgtgtagcttgcaaaagacagcactttttagttacagatgttttgactttgatgaggatatttagctatcaatctaatagtcacctaaaatatcttttttgttggaaaaaagtttataataaaaaagtttgtcatctctagtgacttcaataaagaaaaaactagaagaggagaaaaaggatttcctcaaattttaaatatgtaacttcagggattcaatccccaaatgtttattaagtagctagaaataattatgtggaaaaaaatgaataatggaaaatagtgagtctcaaattgttctctttttttttttaactaaaacaaatctgcaatgaatctagatgcaattaattttattccttccaactaaaattacaatatttttaggttaaaattattgagatataaagcagccattgggaaattgggagaaatgataaacaaatggaaaaagaagatgtccctaacctacacccatagattaccaaggtttcagtgtactagttttgaatctgttctgaatggagtttttataccctcaatttctggcctttggctattttagcatttcaaagtgacttctatgaagctttttttttaatgtgaaattttcagaatgttgtttttttcatgtagatactccaggaagagttaagcactgctttcagttttaatatccaccttgaggggtcgctgcttgagggctcttatcccaggggactttttaattcggatgttacttaatgtggcttctctaatgtagtttctttgattaccgactacacaattatgtaccatcacagtattagtggaaaagtaccatgtgatttaattctccattcctccaatgtaactcttaaaattattatgtatgtgtgtgtgttttactttttgttttttatcatctttaaaatttctattatggtttgattattataaaaataatgaattctcactgtaaatttcaaaaaaaaattacaaaagtatgtgaatttaaaaatgagagcagtcctctcaccctaccacagttccacaccctcaaggtaaacttataacttataatttgatatgtaaacttccagatcttttttctatgcgtaatcagacatacatatatactgcagtgtatctcacgtattaatttttaaaaatcttttgttttacttaattctgtttttattattattattattttgtttgatctattaaggaagaacaaggaagggaatgatctttactcaagaatttcagaaagtcagcactgaagtcctgacctatcagtagacacatttgtccctttcagatattttaggatattctagcaaagcaggccatttctcccacctgaaagtacataacttctatcacttgccacataattaaaagaactcacattaagcggttactcagacagttaatcatagaaaagattatttgcttcatcagttcatagaaaagattatttgcttcatcagttaacttgtttttataaatcagggctgtgttcatacacagaaggggcctgagatttctgcactttaaacaagctcctcctaggtgaggatgctgtggctgttctaattacattttgagtagtaaggtctacagcattgttcctcaaacttggctacgtattggaatcacctaaaaagttaaaacaaaacatggatgtctgggtcccgccccatagagaatgacttaattggcatggggtgcagtccaggcatcatgatttttagatttcccagttggaacttgtgcagcaaagtttgggagctactgatggacatgtgaaaagtaagtataaatggaataaaattaattaggctaataggcttaacccaggaaatcctaagttccttgaatatccagtttgcatttggactcctcatcatatacttggtatataatactctaataaaagctgcctgagttgaattgt

SEQ ID NO: 4284 - DNA, 1513 bp, Homo sapiens
actgcgccgcccggacggcctgcagagcgctgccatcatgagtgaaattcgtaaggacaccttgaaggccattctgttggagttagaatgtcattttacatggaatttacttaaggaagacattgatctgtttgaggtagaagatacaattgggcaacagcttgaatttcttaccacaaaatctagacttgctctttataacctattggcctatgtgaaacacctaaaaggccaaaataaagacgcccttgagtgcttggaacaagcagaagaaataatccagcaagaacactcagacaaagaagaagtacgaagcctggtcacttggggaaactatgcctgggtgtattatcacatggaccagcttgaagaagctcagaagtatacaggtaagatagggaatgtctgtaagaaattgtccagtccttctaactacaagttggagtgtcctgagactgactgtgagaaaggctgggcactcttgaaatttggaggaaagtattatcaaaaggctgttaccctgaacccagataacagctatattaaggtttttctggcactgaagcttcaagatgtacatgcagaagctgaaggggaaaagtatattgaagaaatcctggaccaaatatcatcccagccttacgtccttcgttatgcagccaagttctataggagaaaaaattcctggaacaaagctctcgaacttttaaaaaaggccttggaggtgacaccaacttcttctttcctgcatcaccagatgggactttgctacagggcacaaatgatccaaatcaagaaggccacacacaacagacctaaaggaaaggataaactaaaggttgatgagctgatttcatctgctatatttcatttcaaagcagccatggaacgagactctatgtttgcatttgcctacacagacctggccaacatgtacgctgaaggaggccagtatagcaatgctgaggacattttccggaaagctcttcgtctggagaacataaccgatgatcacaaacatcagatccattaccactatggccgctttcaggaatttcaccgtaaatcagaaaatactgccatccatcattatttagaagccttaaaggtcaaagacagatcaccccttcgcaccaaactgacaagtgctctgaagaaattgtctaccaagagactttgtcacaatgctttagatgtgcagagtttaagtgccctagggtttgtttacaagctggaaggagaaaagaggcaagctgctgagtactatgagaaggcacaaaagatagatccagaaaatgcagaattcctgactgctctctgtgagctccgactttccatttaaatacatactctaggaaattagctctaagtttttcccttcattttgggttctcctgtttgttttttttttattattttaatcccttgtttattatagagctaatatttattgaatagttattgtgtaccaagcattgtgctaaatactttatatgcattatgatgaatcttg

SEQ ID NO: 4285 - DNA, 2985 bp, Homo sapiens
gtgaggcgagcctggagctcatttccaggcgcccttccctcttcggaactaagggagacttgtgggcttttgcacactggctgtagggttcccgggaaagactggagcagcgaacaggagggagagaggtggacaggcagagtctgcacctgccgcctgcacctccgttagggcgacagggcagctggtgtttcgctcctggagtgtgcctacctcgcaaggggggcgagggccacaggctgaggcgcccgcgtcccggagtgcaccgcttggccgaggcaaggtgttgctggggcaaggctgctccgaagcgaagtcgcgcaaaaggaagagtctgggaggcaggcgacttaggagagtctagtcactgagagacagaggcagcatctgccattctaactacggagctgagtaatttagaaaccctccttaactctccctttccagctctccccaaagtccacagaagctctgctgaactctagaaatcttccctggctggggggaagtttactagtatcctctttggctaagacagggagtggaaaaaacaggcggggctgtactgtccgctgtttggggagacgcggtcttcctcgcgcccccttcagccactccgactgcctgggaagtcccagcccgcgctctccggaacccggctcgccgtctcgccctggacatggaactacgcatctgagacctgctggacgttttgctggccgttttgcaagactcagctgtcaagaaaagtgaaggatgaagccaccatttcttttggcccttgtggtctgttctgtagtcagcacaaatctgaagatggtgtcaaagagaaattctgtggatggctgcattgactggtcagtggatctcaagacatacatggctttggcaggtgaaccagtccgagtgaaatgtgcccttttctacagttatattcgtaccaactatagcacggcccagagcactgggctcaggcttatgtggtacaaaaacaaaggtgatttggaagagcccatcatcttttcagaggtcaggatgagcaaagaggaagattcaatatggtttcactcagctgaggcacaagacagtggattctacacttgtgttttaagaaactcaacatattgcatgaaggtgtcaatgtccttgactgttgcagagaatgaatcaggcctgtgctacaacagcaggatccgctatttagaaaaatctgaagtcactaaaagaaaggagatctcctgtccagacatggatgactttaaaaagtccgatcaggagcctgatgttgtgtggtataaggaatgcaagccaaaaatgtggagaagcataataatacagaaaggaaatgctcttctgatccaagaagttcaagaagaagatggaggaaattacacatgtgaacttaaatatgaaggaaaacttgtaagacgaacaactgaattgaaagttacagctttactcacagacaagcctcccaagccattgttccccatggagaatcagccaagtgttatagatgtccagctgggtaagcctctgaacatcccctgcaaagcattcttcggattcagtggagagtctgggccaatgatctactggatgaaaggagaaaagtttattgaagaactggcaggtcacattagagaaggtgaaataaggcttctcaaagagcatcttggagaaaaagaagttgaattggcactcatctttgactcagttgtggaagctgacctggcgaattatacctgccatgttgaaaaccgaaatggacggaaacatgccagtgttttgctgcgtaaaaaggatttaatctataaaattgagcttgcagggggcctgggagcaatcttcctcctccttgtactgctggtggtcatttacaaatgctacaacattgaattgatgctcttctacaggcagcactttggagctgatgaaactaatgatgacaacaaggaatatgatgcctatctctcttacacaaaagtggaccaagatactttagactgtgacaatcctgaagaagagcagtttgctcttgaagtactgccagatgtcctggaaaaacactatggatataaactcttcatcccagaaagagacctgattccaagtggaacatacatggaagatctcacaagatatgttgaacaaagcagaagacttattatcgtgctaactccagactatattctcagacggggatggagtattttcgaactggaaagcagactccataacatgctagtcagtggagaaatcaaagtgattttgattgagtgtacagaattaaaagggaaagtgaattgccaggaagtggaatcactaaagcgtagcatcaaacttctgtccctgatcaagtggaagggatccaaaagcagcaaattaaattctaagttttggaagcacttagtatatgaaatgcccatcaagaaaaaagaaatgctacctcggtgccatgttctggactccgcagaacaaggactttttggagaactccagcctataccctctattgccatgaccagtacttcagccactctggtgtcatctcaggctgatctccctgaattccacccttcagattcaatgcaaatcaggcactgttgcagaggttataaacatgagataccagccacgaccttgccagtaccttccttaggcaaccaccatacttattgtaacctgcctctgacgctactcaacggacagctaccccttaataacaccctgaaagatacccaggaatttcacaggaacagttctttgctgcctttatcctccaaagagcttagctttaccagtgatatttggtagtgaaaaatctgaattcctctgaacagctagataagcatagagaatttctgttataccaagcataaagtacacctaataacgttgtgttaaaaaagtgtttgaagaaaaaggtacaaaaatggcttttatacttaaatatttttgtttacatttccagaatagtggggg

SEQ ID NO: 4286 - DNA, 1498 bp, Homo sapiens
taaaaatttgatcctaagattctataaagtagccattgaggcttaccaaagttacaatattacagatggatcaggggagacggttgctatggagatggatgatatcataactccattgtgaaccagtaagaacactctcgtgagtctaacggtcttccggatgaaggctatttgaagtcgccataacctggtcagaagtgtgcctgtcggcggggagagaggcaatatcaaggttttaaatctcggagaaatggctttcgtttgcttggctatcggatgcttatatacctttctgataagcacaacatttggctgtacttcatcttcagacaccgagataaaagttaaccctcctcaggattttgagatagtggatcccggatacttaggttatctctatttgcaatggcaacccccactgtctctggatcattttaaggaatgcacagtggaatatgaactaaaataccgaaacattggtagtgaaacatggaagaccatcattactaagaatctacattacaaagatgggtttgatcttaacaagggcattgaagcgaagatacacacgcttttaccatggcaatgcacaaatggatcagaagttcaaagttcctgggcagaaactacttattggatatcaccacaaggaattccagaaactaaagttcaggatatggattgcgtatattacaattggcaatatttactctgttcttggaaacctggcataggtgtacttcttgataccaattacaacttgttttactggtatgagggcttggatcatgcattacagtgtgttgattacatcaaggctgatggacaaaatataggatgcagatttccctatttggaggcatcagactataaagatttctatatttgtgttaatggatcatcagagaacaagcctatcagatccagttatttcacttttcagcttcaaaatatagttaaacctttgccgccagtctatcttacttttactcgggagagttcatgtgaaattaagctgaaatggagcatacctttgggacctattccagcaaggtgttttgattatgaaattgagatcagagaagatgatactaccttggtgactgctacagttgaaaatgaaacatacaccttgaaaacaacaaatgaaacccgacaattatgctttgtagtaagaagcaaagtgaatatttattgctcagatgacggaatttggagtgagtggagtgataaacaatgctgggaaggtgaagacctatcgaagaaaactttgctacgtttctggctaccatttggtttcatcttaatattagttatatttgtaaccggtctgcttttgcgtaagccaaacacctacccaaaaatgattccagaatttttctgtgatacatgaagactttccatatcaagagacatggtattgactcaacagtttccagtcatggccaaatgttcaatatgagtctcaataaactgaatttttcttgcgaatgttgaa

SEQ ID NO: 4287 - DNA, 3500 bp, Homo sapiens
ctcacccctctcactgttctgtccccagggctttgcctgcaggagccacaggaaccggaacatttttaacagcttctgccggccacgccccgtgtccatgtccaggtcagtcctggaggccctgacgtcctccactgccatgcagtgtgtcccctctgacggctgcgcgatgctcctgcgtgtacgcgcctccatcaccctgcatgagcgcctgcggggcctggaggcctgtgccatgagcctggacacccaggagacgcagtgtcagagcgtgtgggtggccagggcctcccaccggcagcagggggggcagcagctccaagtgcactttggctgctttgcggtgagcgtggcccagcacctctatgtcaccctgaggaccatccctcatttctgcggggtccagctggaccagaggcacctcgtggaagcggggaagctcagctactgggtggaccggaggcgcaaggcgattctggtgcaagtgcccagggcctccgggagccccgactactacctgcggctctgcctcaagcggttcacctgcgaggacgccggcgcccctgtgcgagtgaccgccaacagcgtctcccaggccgtcttcctgccctacagccaggagctgccgtgcctgtgcctggagggctggtctgcgacccctgacgcggtgcggatccagatctgcccctttgaaaacgacactgaggcactggaggtgctgtgggacacggtctactaccacccggagagccagacactgagctgggagcccgcctgccctgtgagtggccatgtgagcctgtgctggcgcccggggccgggggccggctgccgtaagctgcagcaatccagccagctggtgcatcgcagagtgcagtacccgctggtggacacccagccccagctctgcctgaagttctctaccagttgggggtcctgggtgcggtgccctttcgaacagcgtcgcttcccaaccccgcccacttccaggtgcacctgtgtcacaggaggaagtcacagctccctgcctgccaacgcacactccaggccagcccgctcccttcagcctcaggtgacctggcagccgcccctgcttttgccttcctagaccttcccagggaggaggcctgtgccccaggcatctgcatccagggctggaggaccgatgtacacttctccgtcccccagcagctctgcaacctccgctccagtgggtgcccatctctcaggggccgcaggaggccgaggactagacctaggcctcccacggcaggctgggcgtggcgtgcactgaacaggagactgggtgggggaaacggggagaccatccggccctgagtcaggtcaggcttctgcgccaaacccaggtctgtgcccagcactgccctccagccttgcatttccctccaccacacaccgctgggcctcccgcacgcccaccctggtctcactgtcactggccttgcctcctcctccctgggggtccaccttccctgatcagagctctggttccaaccgccagtgacttgggatgtccctttgcccaccagccactgaggcccaggctcccaggacccagggtacatcaggacaggactctgcccagtggacagaactaagcacatgtggcctgggtgtggtcaggagcgtggctctgccttggagtccaggaagggtcagagctggcactcctacctgcacccctccctgtgagcaaaagagcttgcctagcttcgggtggggtgaaccgcaacagccacagaggtgggaggggtgggagggggtggataggacagcctggcacccagggcctctggagaccctttccagggagcaccagtgggccaggcaggggtctctggaatgtctcctcagctcagctgagccacagccatttcagggcagcctgctgcccacaggacatgcccagggccgtggcagtacccgcagaccttcagctcccccttctcccagcaagactttttggccaagcctaggtccccctccctagcaaaggtcacctccagcagatcacagactaaaggggcaatggccacctgctggtcaggtgtccctggggctggcacctgccactgtggagtgcccatgctatgctgggcaagtccacggccccagggacaggcctggaggcagcaggaggaccgggcctggctcaggtggggggatctgggggtcatacacactcctcttggggccagggtgggctcctccttcacttgtctgctgagcctccctgcagatggaaggctgctgtccacagccactggcaccccaggactgggcagccccctccccttccctcacatgtctcagcctcgcacagtgggggcagggctgggaggtggtgtcccagccagtaccacccctacgtctctctccagctgcacccacccacatgggacggcagcctgaggccaggaatctcctcacgaacaagtaggtgccagggacacattgctggggggcaggaggccaaggcacagcctcggacagctgagccaggcccccctccgagagtgtggggtgttctcacctgactgtggggcctaggcacctgctggctgtcctggggctacagctccatggggccctcaggggctctgggtcacataaaagaccttcagccctgtcctgagtcccctgggaacagcaggagctgggtgggctaccccttccccggatggcccaggtgctggaccccagcctccctctcagacaattcatggtcatggccactgtccctggccctgaagacaaggccctggcagctgcctggagcttccccagtgctctggggtgcagggtgcaaccccacccttcctgtagctgatcaggcccgaggtggtcaaggatcaccccagtttctgcccagggcaccccacactggctggagtccacctctcctgtctgtgcatccttgggtgctgagcttcactggggcacccgccccactcggacccctccagagggtctcagcttccccagatcccagccccactcacccagcaacggtcagtcacttcctgtggtctcagaggccacctgcctgggggccacctgctgggatgtgcggttctcagacattccaagtggcacatccaggtcccagccaggggtgcccagcagtggcctgtgcagtgggccatggggtcggcccttgaagacttctcgtgtgggtcacgtaggctctccggcttccccgctgagccaccctctggagcctggacatcgtctcacctgagtgctgtgcaggaccacatgcccagcctgtcccagcggtggtcgcaccccatctgcagatgcactcccaccgcagtctgggcccaggctgccctcttccagctggccgtgggccgctgggccttcttttccctcctgcaacagaggctgctatgtcccatagactggagagggggctgcagagcgagtaagtccccgccactcagtaaacattggtccaggggtagctgttaaaatgg

SEQ ID NO: 4288 - DNA, 3668 bp, Homo sapiens
actgcacagccagatgctggctgggcaagcactcgcgttcttgggcctgacctggggcactttccagagcctggccatcccccggattacagaatgtggcctctcctgttctcagttacacagaatataagttgctgatttcccaggtttcggatcgttctgtctcccccttctcggaatgtgagctcctggagagggctttgcctgcaggagccacaggaaccggaacatttttaacagcttctgccggccacgccccgtgtccatgtccaggtcagtcctggaggccctgacgtcctccactgccatgcagtgtgtcccctctgacggctgcgcgatgctcctgcgtgtacgcgcctccatcaccctgcatgagcgcctgcggggcctggaggcctgtgccatgagcctggacacccaggagacgcagtgtcagagcgtgtgggtggccagggcctcccaccggcagcagggggggcagcagctccaagtgcactttggctgctttgcggtgagcgtggcccagcacctctatgtcaccctgaggaccatccctcatttctgcggggtccagctggaccagaggcacctcgtggaagcggggaagctcagctactgggtggaccggaggcgcaaggcgattctggtgcaagtgcccagggcctccgggagccccgactactacctgcggctctgcctcaagcggttcacctgcgaggacgccggcgcccctgtgcgagtgaccgccaacagcgtctcccaggccgtcttcctgccctacagccaggagctgccgtgcctgtgcctggagggctggtctgcgacccctgacgcggtgcggatccagatctgcccctttgaaaacgacactgaggcactggaggtgctgtgggacacggtctactaccacccggagagccagacactgagctgggagcccgcctgccctgtgagtggccatgtgagcctgtgctggcgcccggggccgggggccggctgccgtaagctgcagcaatccagccagctggtgcatcgcagagtgcagtacccgctggtggacacccagccccagctctgcctgaagttctctaccagttgggggtcctgggtgcggtgccctttcgaacagcgtcgcttcccaaccccgcccacttccaggtgcacctgtgtcacaggaggaagtcacagctccctgcctgccaacgcacactccaggccagcccgctcccttcagcctcaggtgacctggcagccgcccctgcttttgccttcctagaccttcccagggaggaggcctgtgccccaggcatctgcatccagggctggaggaccgatgtacacttctccgtcccccagcagctctgcaacctccgctccagtgggtgcccatctctcaggggccgcaggaggccgaggactagacctaggcctcccacggcaggctgggcgtggcgtgcactgaacaggagactgggtgggggaaacggggagaccatccggccctgagtcaggtcaggcttctgcgccaaacccaggtctgtgcccagcactgccctccagccttgcatttccctccaccacacaccgctgggcctcccgcacgcccaccctggtctcactgtcactggccttgcctcctcctccctgggggtccaccttccctgatcagagctctggttccaaccgccagtgacttgggatgtccctttgcccaccagccactgaggcccaggctcccaggacccagggtacatcaggacaggactctgcccagtggacagaactaagcacatgtggcctgggtgtggtcaggagcgtggctctgccttggagtccaggaagggtcagagctggcactcctacctgcacccctccctgtgagcaaaagagcttgcctagcttcgggtggggtgaaccgcaacagccacagaggtgggaggggtgggagggggtggataggacagcctggcacccagggcctctggagaccctttccagggagcaccagtgggccaggcaggggtctctggaatgtctcctcagctcagctgagccacagccatttcagggcagcctgctgcccacaggacatgcccagggccgtggcagtacccgcagaccttcagctcccccttctcccagcaagactttttggccaagcctaggtccccctccctagcaaaggtcacctccagcagatcacagactaaaggggcaatggccacctgctggtcaggtgtccctggggctggcacctgccactgtggagtgcccatgctatgctgggcaagtccacggccccagggacaggcctggaggcagcaggaggaccgggcctggctcaggtggggggatctgggggtcatacacactcctcttggggccagggtgggctcctccttcacttgtctgctgagcctccctgcagatggaaggctgctgtccacagccactggcaccccaggactgggcagccccctccccttccctcacatgtctcagcctcgcacagtgggggcagggctgggaggtggtgtcccagccagtaccacccctacgtctctctccagctgcacccacccacatgggacggcagcctgaggccaggaatctcctcacgaacaagtaggtgccagggacacattgctggggggcaggaggccaaggcacagcctcggacagctgagccaggcccccctccgagagtgtggggtgttctcacctgactgtggggcctaggcacctgctggctgtcctggggctacagctccatggggccctcaggggctctgggtcacataaaagaccttcagccctgtcctgagtcccctgggaacagcaggagctgggtgggctaccccttccccggatggcccaggtgctggaccccagcctccctctcagacaattcatggtcatggccactgtccctggccctgaagacaaggccctggcagctgcctggagcttccccagtgctctggggtgcagggtgcaaccccacccttcctgtagctgatcaggcccgaggtggtcaaggatcaccccagtttctgcccagggcaccccacactggctggagtccacctctcctgtctgtgcatccttgggtgctgagcttcactggggcacccgccccactcggacccctccagagggtctcagcttccccagatcccagccccactcacccagcaacggtcagtcacttcctgtggtctcagaggccacctgcctgggggccacctgctgggatgtgcggttctcagacattccaagtggcacatccaggtcccagccaggggtgcccagcagtggcctgtgcagtgggccatggggtcggcccttgaagacttctcgtgtgggtcacgtaggctctccggcttccccgctgagccaccctctggagcctggacatcgtctcacctgagtgctgtgcaggaccacatgcccagcctgtcccagcggtggtcgcaccccatctgcagatgcactcccaccgcagtctgggcccaggctgccctcttccagctggccgtgggccgctgggccttcttttccctcctgcaacagaggctgctatgtcccatagactggagagggggctgcagagcgagtaagtccccgccactcagtaaacattggtccaggggtagctgttaaaatgg

SEQ ID NO: 4289 - DNA, 468 bp, Homo sapiens
atgaggggtggcgggggagttcccctcatccacttcagccttccagtctgctcccccttcctgtacctctctcttccagaaccccaggccaagcaccagagaaggcctgggagtgagcaaggtgcccatgttgcttctgtggatcatcctcctgcttgtacagccctgggagggcctaggaacgcccgcccctctgctggagggagcctttttacttccttgcagccctctgaagataccagcgagtggggagcagagccagcagacggggaaaacaaaaatgatgacaccctctacaccccagatgatctctcaataccaggtcactttgtccctactgtgtgtcctgctgagactctaggctgctccaggttggagctgtctgtgattgggtttgaggagggaccatctatgggaactgctgtgttccagctacagtacctgctggatctcctggggtcccggctg

SEQ ID NO: 4290 - DNA, 5694 bp, Homo sapiens
atggtgaactcgctgctgttcggggagatggccttggccttcggctgcccgccgggcggcggcggcgggggctgccctggcgggggcggcggcggcggcggggcagggccgggtccgtcgccggtgacggcggcgctgcgggacgacctgggctccaacatccacctcttgaaggggctcaacgtgcgcttccgctgcttcctggctaaggtgcacgagctggagcggcgcaaccggctgctggagaagcagctggagcagcagcagagcgagcgcgagcggcggctgcgctacaagaccttctcccgcgagcaggccgtgcagaccgggcccgagttgctgcggcccccggcgcccggcggcgggcacggcctcagcagtggcgcggcggccggcgccaacgccaatgccgtggccctgggcggcctgccccccggcggcggctcgcacccgcagcactacggccgcctgcccgggaccatctggagctacacgcaggtgcggcgcacgggcggcggcggcgtggagaccgtgcagggccccggcgtgtcgtgggtgcaccccgacggcgtgggcgtgcagatcgacaccatcacgccggagatccgcgcgctctacaacgtgctggccaaggtgaagcgcgagcgcgacgagtataagcggaggtgggaggaggagctcgccaagcgcatgaaccttcagaccatggtggacacgctgcaggaggcagcacaggaggctgatgccatccaggaggagatgaatgagaagatcgagcggctcaaggccgagctggtggtgtttaaggggcttatgagtgacgtggtccccaaaaagaaagagcgtaaggtggcttccgatgatgacatctctgagcaggacggggaggtgaaccggttctcggacgatgaggtcggctccatgaacatcaccgatgagatgaagcgcatgtttaaccagctgcgggagacctttgactttgacgacgactgtgacagcctgacgtgggaagagaatgaagacacgctgctgctctgggaggatttcaccaactgcaatccgaccatcgacctgcagggcgagcaagaggaaaacttgggcaacttgatccatgagaccgaatccttcttcaagacgagagacaaggagtaccaggaaacgataggtcagatcgagctcgagctggccacagccaaaagtgacatgaaccgacacctgcacgagtacatggagatgtgcagcatgaagcgaggcctggacgtgcagatggagacctgccgccggctcatcaaaggctccgcagacaggaattcaccgtcccccagctccgtggccagcagcgactcaggaagtacagatgagatccaggatgagttcgagcgcgaggcggatgtggagcccatggtcagctgatgactgaggccctgcgagcctggtggtcttggtgatggggccctgccacctctcctcatggggccaggaaggcccctcggagtggggttcgaagccacaccacacagactttctctgccctcccttctctggaggccctgagggactgctgcttccttccttccttccacaccaccaacgggtgccccgtctccatcccccacccacccaaggaatggtgctgtcaatttctattgttctccacattacaaatgcagacttctgtgcggactttgcagtgttaactgtgccttctcccttaagctgagccactttgagctccaaagaattattcctagcaggtgtttttatacagaactctaagctgagggccgggccaaccggccgtggtgtaatgtggtttctgccgtccgtcccacctgctcctctgattggccatgggctatgccctcccttcctcctgagccagcccagactcggcctggagcttggggtgctctgccaacccccaggaaggagccgcttgcctctgtgagctttctaggcctgggtagggaccaccccaattttctcactccctgaaggagagaaaggtggaaggaagggaaggaggacacattttaattttttggggggatcgagtggcaaagttgaagggacaaggcactgtgaggggaaggcagagcctcactgtgtttaaactactatgcaaaaaacaaaacaaacaacaaaagcagcttgccttatatcattgtggaaggcaggacctctcctgggctcctggcttccccctggagctgggagagaggccggggttagggtgatctgtgtggcagcactgactgggtagtgtgggtttggccgaggttggtcatgaggctggggttcccgcaaggcactggcctccctgaccgcttgcttccttccggacctctgggttcagggcgggggcggagggatccttgatttccctgataacttgatgttcttccctccctcgccagccaacaatagaggcttagagatctgtaatttctctgtgagaaagtctgaaggggccaggcctggtctctgctcccttctacccgccttgggttaggactgtccggcagttgcctgcttttggctgctggcaggagagaagcagggtgggctgctggcagtgcaggagctggagtgagggccatcctctttctgctcctcgacacacgcaagccgctctcagcagttccctcgactggccagtcggggtattgatctgagccagcatcccccaagacttgaatggcttgagtgggactgcgttgaagggcactgtgtggcccccttccaaatctcagcttggagccagctgagcaggctttgctttattattattttttaagcctactgcagtgggtctgttgccaattttaattttttattgtcccaggagctccctctagtggtcaaggtagcaaaatgtgcccaaggactagaacttgggtccctctgccttgcctggaggcagaaggagggggctctgggtttgactgggattgtggtccccaggggtccgtggcctttaaggctcttctctcttttctgtttcccccacctgtgttacagtcttaaaaatactgtacataaaagatatatgtagagagagagagagagcgtgagaatgtgttagtgactatgtgtgatgtaatttatcacgatttggtggccttcgtcatgagttttttcctttgttttcttttgctgggggcacctcccacgggtcccctgtggcagtctggctgtgacacttccatagtcagcatctcttgttagccaaacagttccctttgacaggtacttggagggacaatggttttggaagagagacggcccttctctctcctcactcacccttgttctaaaggttacagggttcaaacatacctgattcttgttgttattgttgttgaatttttattttaaccaaaggttatcagagccagttgggcttggacctcagctgctaaaaagattttccgtttcctcgagggcaggaaaacatccaccctcgtgggtctcctccgtccagggccgagggaggcattggacaatgtggtatgggagtttcgtgggcagcgtggaagccggccctgggttgttccccaaggtggtgggagggtgacagatatatctttagacttaagactgtaaggcagcagtgttagcatgggagtaactaaggttactgtggttatcggtgtccggcggtattatttttactttcctccttgtatacataggtcatttgtctttgaggactagggtactctagggagtttgaaaactgcaggagccagaaagagatcctggcctgagagtcccttctggctggcttttaatatctgctctcctcttgggagtgaggacttggggcaggtgggtaggagagggaaagccagagtgtgatgggcctgcctcctgggctggttcctgggtccggcctgcctgcctgcctgcctgcctctccaccacatgcttttttcagttaatgtcagtgggccctgcttgtcccctcaccatgagcccacagcttgccaagaaagaccccaacgctcgctggggcagcaccagtcctagctgggacgaattggtccatcctttgtaaagctgtaaatacttaattttgactttctatttctaagcccagtgtcatattgacactggtattttagaattttctcagatgggctctcctgcgctgccctctgtctcctgtttttgggggttttatacaaacagaggattggggagggataggaagactagcatccttttggctccctggttggttgtgaaatacacacacacacacacacacacacacacacactcgcactcctctgagactccgaacagagaaaaaaattattggcaaatcaacacatttttctttctcgtcttgagaaaatgtcttgaggtccctgaagggccaaatccatcgtggactaactctgtgggtagagctcagatgacctagggagaattaaaccacttaagcttggagtgggaggagagggggtggggtgggggagaatataagatgtaacttaagctaaatgtaatctatttataaagcaagagactctcatctatttttatgaaaggaagggttttttaatctagggtaggcagttgtggtagcccagcattttcctgtggacgagacatggtgcatgttgttgctggattgaatggaacccattcctgtcccccggcctcgtcttctgtcctcacttttggtcatccacacccatgagcagcttcagcagagtgtaggtcccacttcaccccattctcctctcctctgacccctcagctccttggaagtcttggggtggggatctgagggggtgggtgggctgcaggaaattcagaaatgtggtgggtgggggaagggacaaggcgcattagggagggaacaagctgggctctggggataggctctgattaattagttactctgactctggtctgccgagatccatttccaacccagttgcgttgggagagggttgggaggcagcagagcatgggtgacagtgggagcacacgacttccttggagcctgggcctttgcgggtcccaggtggtcaggcagctggagcagaagtggaaatggcttaagatgctcatagcccagccccggctgtgtctactccaggccaagcctgggctgcagtccttgctatgttccccccagggccctggggggagggatcagggtgctgggggtttcctaggacaggggtcttcccccttgagacaccaagctctggctctagaagagctctctcctggagtggggagtctggaggggactgggtgggtgcaggtaaagccagattctctctggaagggaattttctatgaatggatgatttccaggctcagggtgggctgtgtgttagttctgagcaaatccctcaccaagacccttccctcccaagccctcaaagaaatgaggcaaagcccttccctgcaagaccccttgtggatgtttttgcatctacctgatttttagccccacccagggagactttataccccatgatcctgccccaccgttgctgttgtctgccagctgggtctagcatcacagggaagggggggatttatactcatggaaagactactgatcctaccggaaaccaacctgtttactgtactgttgtaaatatcatgccctttatatcctgtatattggcttcttttaaataaagtgaaatgtcttagaactga

SEQ ID NO: 4291 - DNA, 6188 bp, Homo sapiens
cagaaggggcagtgccggccgagagtcctctgcgtgcggctgccgcggcccctccacagcgtctctgacagcccgggcggtgagacccgcgacccttctggccccgcgcagataccgcggcctccaccgcgtcccgaggagcggccgagtgccctctctcgcctcggcgcccgcatccggggccatccgtcctgccgtctctgcggaggccgcatctggcgcgcatctggaaccgcccggccggccgcgctggagcccgcgcccaccctggcccggccgcgccgggagccctgcccggagctggagccgcacctggagccgcgggcccggggccctgagccgcgcagccggcgcatggtgaactcgctgctgttcggggagatggccttggccttcggctgcccgccgggcggcggcggcgggggctgccctggcgggggcggcggcggcggcggggcagggccgggtccgtcgccggtgacggcggcgctgcgggacgacctgggctccaacatccacctcttgaaggggctcaacgtgcgcttccgctgcttcctggctaaggtgcacgagctggagcggcgcaaccggctgctggagaagcagctggagcagcagcagagcgagcgcgagcggcggctgcgctacaagaccttctcccgcgagcaggccgtgcagaccgggcccgagttgctgcggcccccggcgcccggcggcgggcacggcctcagcagtggcgcggcggccggcgccaacgccaatgccgtggccctgggcggcctgccccccggcggcggctcgcacccgcagcactacggccgcctgcccgggaccatctggagctacacgcaggtgcggcgcacgggcggcggcggcgtggagaccgtgcagggccccggcgtgtcgtgggtgcaccccgacggcgtgggcgtgcagatcgacaccatcacgccggagatccgcgcgctctacaacgtgctggccaaggtgaagcgcgagcgcgacgagtataagcggaggtgggaggaggagctcgccaagcgcatgaaccttcagaccatggtggacacgctgcaggaggcagcacaggaggctgatgccatccaggaggagatgaatgagaagatcgagcggctcaaggccgagctggtggtgtttaaggggcttatgagtgaccccatgacagacctggacacaaagatccaagaaaaggccatgaaggtggacatggacatctgccgccgaatcgatatcacggccaagctgtgcgatgtcgcacagcagcggaactcagaagacgtgtccaagatcttccaggtggtccccaaaaagaaagagcgtaaggtggcttccgatgatgacatctctgagcaggacggggaggtgaaccggttctcggacgatgaggtcggctccatgaacatcaccgatgagatgaagcgcatgtttaaccagctgcgggagacctttgactttgacgacgactgtgacagcctgacgtgggaagagaatgaagacacgctgctgctctgggaggatttcaccaactgcaatccgaccatcgacctgcagggcgagcaagaggaaaacttgggcaacttgatccatgagaccgaatccttcttcaagacgagagacaaggagtaccaggaaacgataggtcagatcgagctcgagctggccacagccaaaagtgacatgaaccgacacctgcacgagtacatggagatgtgcagcatgaagcgaggcctggacgtgcagatggagacctgccgccggctcatcaaaggctccgcagacaggaattcaccgtcccccagctccgtggccagcagcgactcaggaagtacagatgagatccaggatgagttcgagcgcgaggcggatgtggagcccatggtcagctgatgactgaggccctgcgagcctggtggtcttggtgatggggccctgccacctctcctcatggggccaggaaggcccctcggagtggggttcgaagccacaccacacagactttctctgccctcccttctctggaggccctgagggactgctgcttccttccttccttccacaccaccaacgggtgccccgtctccatcccccacccacccaaggaatggtgctgtcaatttctattgttctccacattacaaatgcagacttctgtgcggactttgcagtgttaactgtgccttctcccttaagctgagccactttgagctccaaagaattattcctagcaggtgtttttatacagaactctaagctgagggccgggccaaccggccgtggtgtaatgtggtttctgccgtccgtcccacctgctcctctgattggccatgggctatgccctcccttcctcctgagccagcccagactcggcctggagcttggggtgctctgccaacccccaggaaggagccgcttgcctctgtgagctttctaggcctgggtagggaccaccccaattttctcactccctgaaggagagaaaggtggaaggaagggaaggaggacacattttaattttttggggggatcgagtggcaaagttgaagggacaaggcactgtgaggggaaggcagagcctcactgtgtttaaactactatgcaaaaaacaaaacaaacaacaaaagcagcttgccttatatcattgtggaaggcaggacctctcctgggctcctggcttccccctggagctgggagagaggccggggttagggtgatctgtgtggcagcactgactgggtagtgtgggtttggccgaggttggtcatgaggctggggttcccgcaaggcactggcctccctgaccgcttgcttccttccggacctctgggttcagggcgggggcggagggatccttgatttccctgataacttgatgttcttccctccctcgccagccaacaatagaggcttagagatctgtaatttctctgtgagaaagtctgaaggggccaggcctggtctctgctcccttctacccgccttgggttaggactgtccggcagttgcctgcttttggctgctggcaggagagaagcagggtgggctgctggcagtgcaggagctggagtgagggccatcctctttctgctcctcgacacacgcaagccgctctcagcagttccctcgactggccagtcggggtattgatctgagccagcatcccccaagacttgaatggcttgagtgggactgcgttgaagggcactgtgtggcccccttccaaatctcagcttggagccagctgagcaggctttgctttattattattttttaagcctactgcagtgggtctgttgccaattttaattttttattgtcccaggagctccctctagtggtcaaggtagcaaaatgtgcccaaggactagaacttgggtccctctgccttgcctggaggcagaaggagggggctctgggtttgactgggattgtggtccccaggggtccgtggcctttaaggctcttctctcttttctgtttcccccacctgtgttacagtcttaaaaatactgtacataaaagatatatgtagagagagagagagagcgtgagaatgtgttagtgactatgtgtgatgtaatttatcacgatttggtggccttcgtcatgagttttttcctttgttttcttttgctgggggcacctcccacgggtcccctgtggcagtctggctgtgacacttccatagtcagcatctcttgttagccaaacagttccctttgacaggtacttggagggacaatggttttggaagagagacggcccttctctctcctcactcacccttgttctaaaggttacagggttcaaacatacctgattcttgttgttattgttgttgaatttttattttaaccaaaggttatcagagccagttgggcttggacctcagctgctaaaaagattttccgtttcctcgagggcaggaaaacatccaccctcgtgggtctcctccgtccagggccgagggaggcattggacaatgtggtatgggagtttcgtgggcagcgtggaagccggccctgggttgttccccaaggtggtgggagggtgacagatatatctttagacttaagactgtaaggcagcagtgttagcatgggagtaactaaggttactgtggttatcggtgtccggcggtattatttttactttcctccttgtatacataggtcatttgtctttgaggactagggtactctagggagtttgaaaactgcaggagccagaaagagatcctggcctgagagtcccttctggctggcttttaatatctgctctcctcttgggagtgaggacttggggcaggtgggtaggagagggaaagccagagtgtgatgggcctgcctcctgggctggttcctgggtccggcctgcctgcctgcctgcctgcctctccaccacatgcttttttcagttaatgtcagtgggccctgcttgtcccctcaccatgagcccacagcttgccaagaaagaccccaacgctcgctggggcagcaccagtcctagctgggacgaattggtccatcctttgtaaagctgtaaatacttaattttgactttctatttctaagcccagtgtcatattgacactggtattttagaattttctcagatgggctctcctgcgctgccctctgtctcctgtttttgggggttttatacaaacagaggattggggagggataggaagactagcatccttttggctccctggttggttgtgaaatacacacacacacacacacacacacacacacactcgcactcctctgagactccgaacagagaaaaaaattattggcaaatcaacacatttttctttctcgtcttgagaaaatgtcttgaggtccctgaagggccaaatccatcgtggactaactctgtgggtagagctcagatgacctagggagaattaaaccacttaagcttggagtgggaggagagggggtggggtgggggagaatataagatgtaacttaagctaaatgtaatctatttataaagcaagagactctcatctatttttatgaaaggaagggttttttaatctagggtaggcagttgtggtagcccagcattttcctgtggacgagacatggtgcatgttgttgctggattgaatggaacccattcctgtcccccggcctcgtcttctgtcctcacttttggtcatccacacccatgagcagcttcagcagagtgtaggtcccacttcaccccattctcctctcctctgacccctcagctccttggaagtcttggggtggggatctgagggggtgggtgggctgcaggaaattcagaaatgtggtgggtgggggaagggacaaggcgcattagggagggaacaagctgggctctggggataggctctgattaattagttactctgactctggtctgccgagatccatttccaacccagttgcgttgggagagggttgggaggcagcagagcatgggtgacagtgggagcacacgacttccttggagcctgggcctttgcgggtcccaggtggtcaggcagctggagcagaagtggaaatggcttaagatgctcatagcccagccccggctgtgtctactccaggccaagcctgggctgcagtccttgctatgttccccccagggccctggggggagggatcagggtgctgggggtttcctaggacaggggtcttcccccttgagacaccaagctctggctctagaagagctctctcctggagtggggagtctggaggggactgggtgggtgcaggtaaagccagattctctctggaagggaattttctatgaatggatgatttccaggctcagggtgggctgtgtgttagttctgagcaaatccctcaccaagacccttccctcccaagccctcaaagaaatgaggcaaagcccttccctgcaagaccccttgtggatgtttttgcatctacctgatttttagccccacccagggagactttataccccatgatcctgccccaccgttgctgttgtctgccagctgggtctagcatcacagggaagggggggatttatactcatggaaagactactgatcctaccggaaaccaacctgtttactgtactgttgtaaatatcatgccctttatatcctgtatattggcttcttttaaataaagtgaaatgtcttagaactg

SEQ ID NO: 4292 - DNA, 2984 bp, Homo sapiens
gtcccagaggagaggccagggatgccgggtgcgggacagatccctcgtctcgcctgttgcttttaagcctggtggcccccggggcctggaggctggtactgagcgactattgcctgccctggggacttcacaccccccagccatccagttgcccccaggaccataggtacccccaggaccataggaaccacaagcctccccccgcccgtgtgttccaggcctgcccccgccacgggaatgctgccctcaaaaggggggcagatatcacaggattgctgggaaggggagagacccgtgtgcctggagggagcaagttcacccagacctgcagggccagggacctgtacttggaggacctcggggccagggacctgtacttggagggccttggggccagggacctgtacttggaggacctcggggccagggacctgtacttggaggacctcgaggccaggtcattcttaggtggcaagaaggtgaggccgtctgggagaacatggcgcgcatgtgcgtgaagacccagcggctggacgtggccaaggtgtgcctggggaacatgggccatgcccgcggggcccgagcgctgcgtgaggcggagcaggagccggagctagaggcccgcgtggccgtgctggccacgcagctgggcatgctggaggacgccgagcagctgtacaggaagtgcaagcgccacgacctcctgaacaagttctaccaggctgcgggccggtggcaggaggccctccaggtagccgagcaccacgatcgcgtgcacctgcgcagcacctaccaccgctatgccgggcacctggaggccagcgccgactgcagccgggccctcagttactacgagaagtcggacacgcaccgcttcgaggtgcccaggatgctgtcggaggacctgccgtccctggagctctacgtgaataaaatgaaggataagaccctgtggcggtggtgggcgcagtacctggagagccagggcgagatggacgccgcgctgcactactacgagctggcccgggaccacttctccctggtccgcatccactgcttccagggcaatgtccagaaggctgcgcaaatagccaacgagacaggaaacctggcggcctcctaccacctcgcccgccagtacgagagccaggaggaggtcgggcaggcggtgcacttctacacccgggcacaggccttcaagaatgccatccgcctgtgcaaggagaacggcctggacgaccagctcatgaacttggccctgctgagctcccccgaggacatgatcgaggcggcccgatactacgaggagaagggcgtgcagatggacagggcggtcatgctgtaccacaaggctggccacttctccaaggccctggagctggcctttgccacccagcagtttgtggccctacagctcatagcagaggacctggatgagacgtcagaccctgcgctcctggcccgctgctccgacttcttcatcgagcacagtcagtacgagagggcggtagagctgctgctggctgccaggaagtatcaggaagccctgcagctgtgcctggggcagaacatgagcatcaccgaggagatggcggaaaagatgaccgtggccaaggactcctcggacctgcctgaggagtcgcggcgggagctgctggagcagatagcagactgctgcatgcgccagggcagctaccacctggccaccaagaagtacacgcaggccggcaacaagctgaaggccatgagggcgctgctcaaatccggagacacggagaaaatcacgttcttcgcgagcgtgtccaggcagaaggaaatctacatcatggctgctaactacctgcagtccctggactggcggaaggagccggagatcatgaagaacatcatcggcttctacaccaaggggcgggccctggacctcctggctggcttttatgacgcttgtgcccaggtggagattgatgaataccagaactacgacaaagcccacggggcgctgaccgaggcctacaagtgcctggccaaggccaaggccaagagccccctggaccaggagaccaggctggcgcagctgcagagcaggatggcactggtgaagaggttcatccaggcccgcaggacgtacacagaggaccccaaggagtccatcaagcagtgtgagctgctcctggaggaaccagacctggacagcaccatccgcatcggggacgtctatggcttcctggtggagcactacgtgcggaaggaggaataccagacggcctacagattcctggaggagatgcggcggcggcttcccttggccaacatgtcctactacgtgagcccgcaggccgtggacgccgtgcaccgggggctgggtctcccactgccacgcaccgtccccgagcaggtccgccacaacagcatggaggacgccagggagctggacgaggaggtggtggaagaggcagatgacgacccctgaggggcctgggccccaggaccagcgtgctgctgcagaaaggcatcttctggaatttttttgtcagctgtggcaaagccagcatttttgctgggaaaaaacatgtctgtgttggaatacgcgacagagctgggcgagaacgcagcggcccgggccggcggagggtgtgacccgtctgcaccttgctctgtcccacctgcctctgggtgcccggcagctccactagatttttggattcattcctttgaagggagtcgggttcacccttccatcgtattctcccaactacacattgtaaagcctgagaaacttctagaacctcaggaagctgcagctggagggctggggcacctgcccccctgctccccacacatcatatcctccccatactcctgcagggcccacggctcctgagcaacagctgggacacccgggccttggcggctgcaccccctgctaggctctgcccaccggccaccaacactcctgtaattccaataaagcagtttattttctg

SEQ ID NO: 4293 - DNA, 5131 bp, Homo sapiens
gcagagcggaataacctggcccccgacgctcgggcctcggagctgcacgtgcgtgcccgatcgccttcggctctttccggccgctcggggcgcttcgggagtcctcggggccgcctcgctcaccttcggctatttccgcgttcctggcgcgccgttgtcccggcaacgcgcggcggctcagcggcctggcagaggtttcagcgctgaggaggcctgagttccgtcatggccctctattatgaccaccagatagaagccccggatgcagcagggtcaccctcatttatcagctggcaccctgtccatccattcttggcagttgcttacatcagcacaacctcaacaggcagcgtggatatttacctggagcaaggggagtgcgtgccagatacacacgtcgagaggccgttccgggttgcttccctgtgctggcacccgacgcggctggtgctggctgtgggctgggagactggagaagtgacggtgtttaacaagcaggacaaggagcagcacacgatgcccctgacacacacagccgacatcaccgtgctccgttggagccccagtggaaactgcctgctgtctggggacaggcttggtgtcttgctcttgtggaggttggaccaaaggggccgagtgcaagggacgcctctgctgaaacacgagtatgggaaacacctcacgcactgcatcttccggctcccccctcctggcgaggacctggttcagttggcaaaggcagctgtgagcggtgatgagaaagccctggacatgtttaactggaagaagagcagttctggaagtttgctgaagatggggtctcacgaggggctgttgttctttgtcagtctgatggacgggacagtgcactatgtggatgagaagggcaagaccactcaggtggtgtccgcagacagcacgattcagatgctgttctacatggagaagagggaggcactggtggtggtcacagagaacctccggctgtccctgtacacggtgcctcctgagggcaaagcagaagaagtgatgaaggtcaagctgagcgggaaaaccggccgccgggcagacatcgctttgattgaaggcagccttctcgtgatggccgtcggggaggctgccctcagattctgggacatagaacgaggagagaattatatactgagtccagatgagaagtttggctttgagaaaggagagaatatgaactgtgtgtgttactgtaaagtcaaaggtcttctggccgctggtaccgacagagggcgagtagccatgtggaggaaagtaccagacttcctgggcagccccggggcagagggcaaggacaggtgggcccttcagacccctaccgagctccaaggaaacatcacgcaaatccagtggggttccaggaagaacctgctggcagtgaacagcgtcatctccgtggccatcctcagcgagcgggccatgtcgtcacacttccaccagcaagtggccgccatgcaggtctccccgagtctgctgaatgtgtgcttcctgtccacgggggtcgcacacagcctgcgcaccgacatgcacatcagtggagtgtttgccaccaaggatgctgtcgcagtctggaacggaaggcaggtggcgatcttcgagctttctggagccgcgatacggagtgcagggaccttcttgtgtgagacgcctgtgttagcaatgcatgaagaaaacgtttacacggtggagtcaaaccgagttcaagttcgaacctggcaggggactgtcaaacaactcctccttttctcggagactgaggggaatccctgcttcttggacatctgtgggaatttcctggttgtagggacagacttggctcactttaaaagctttgatctttcccgaagagaggccaaagcacactgtagctgcaggagcctggcggagctggtccctggggtggggggcatcgcttctctgcggtgcagcagcagcgggagcaccatcagcatcctccccagcaaggctgacaacagccctgattccaaaatctgcttctacgatgttgaaatggacacagtgaccgtctttgacttcaagactggacaaattgatcggagagagacgctgtcctttaatgagcaagagactaataagagccacctctttgtggatgagggactgaaaaattatgttcccgtgaaccacttctgggaccagagtgagccccggctgtttgtatgcgaagccgtgcaggagacgccgcgctcccagcctcagtctgcaaacgggcagccccaagatgggcgcgctggccctgcggcagatgttttgatcctgtccttcttcatttccgaagagcacggcttcctgcttcatgagagcttcccccggcctgccacctcccacagtctcctggggatggaagtgccttattactacttcacaagaaagcccgaagaagcagacagagaagacgaggtggagcctgggtgccaccacatccctcagatggtgtccaggagacccctgcgagactttgtggggctggaggactgcgacaaggccacccgggacgccatgctccacttcagcttctttgtcaccataggagacatggacgaagccttcaaatccatcaagctcatcaaaagtgaggccgtctgggagaacatggcgcgcatgtgcgtgaagacccagcggctggacgtggccaaggtgtgcctggggaacatgggccatgcccgcggggcccgagcgctgcgtgaggcggagcaggagccggagctagaggcccgcgtggccgtgctggccacgcagctgggcatgctggaggacgccgagcagctgtacaggaagtgcaagcgccacgacctcctgaacaagttctaccaggctgcgggccggtggcaggaggccctccaggtagccgagcaccacgatcgcgtgcacctgcgcagcacctaccaccgctatgccgggcacctggaggccagcgccgactgcagccgggccctcagttactacgagaagtcggacacgcaccgcttcgaggtgcccaggatgctgtcggaggacctgccgtccctggagctctacgtgaataaaatgaaggataagaccctgtggcggtggtgggcgcagtacctggagagccagggcgagatggacgccgcgctgcactactacgagctggcccgggaccacttctccctggtccgcatccactgcttccagggcaatgtccagaaggctgcgcaaatagccaacgagacaggaaacctggcggcctcctaccacctcgcccgccagtacgagagccaggaggaggtcgggcaggcggtgcacttctacacccgggcacaggccttcaagaatgccatccgcctgtgcaaggagaacggcctggacgaccagctcatgaacttggccctgctgagctcccccgaggacatgatcgaggcggcccgatactacgaggagaagggcgtgcagatggacagggcggtcatgctgtaccacaaggctggccacttctccaaggccctggagctggcctttgccacccagcagtttgtggccctacagctcatagcagaggacctggatgagacgtcagaccctgcgctcctggcccgctgctccgacttcttcatcgagcacagtcagtacgagagggcggtagagctgctgctggctgccaggaagtatcaggaagccctgcagctgtgcctggggcagaacatgagcatcaccgaggagatggcggaaaagatgaccgtggccaaggactcctcggacctgcctgaggagtcgcggcgggagctgctggagcagatagcagactgctgcatgcgccagggcagctaccacctggccaccaagaagtacacgcaggccggcaacaagctgaaggccatgagggcgctgctcaaatccggagacacggagaaaatcacgttcttcgcgagcgtgtccaggcagaaggaaatctacatcatggctgctaactacctgcagtccctggactggcggaaggagccggagatcatgaagaacatcatcggcttctacaccaaggggcgggccctggacctcctggctggcttttatgacgcttgtgcccaggtggagattgatgaataccagaactacgacaaagcccacggggcgctgaccgaggcctacaagtgcctggccaaggccaaggccaagagccccctggaccaggagaccaggctggcgcagctgcagagcaggatggcactggtgaagaggttcatccaggcccgcaggacgtacacagaggaccccaaggagtccatcaagcagtgtgagctgctcctggaggaaccagacctggacagcaccatccgcatcggggacgtctatggcttcctggtggagcactacgtgcggaaggaggaataccagacggcctacagattcctggaggagatgcggcggcggcttcccttggccaacatgtcctactacgtgagcccgcaggccgtggacgccgtgcaccgggggctgggtctcccactgccacgcaccgtccccgagcaggtccgccacaacagcatggaggacgccagggagctggacgaggaggtggtggaagaggcagatgacgacccctgaggggcctgggccccaggaccagcgtgctgctgcagaaaggcatcttctggaatttttttgtcagctgtggcaaagccagcatttttgctgggaaaaaacatgtctgtgttggaatacgcgacagagctgggcgagaacgcagcggcccgggccggcggagggtgtgacccgtctgcaccttgctctgtcccacctgcctctgggtgcccggcagctccactagatttttggattcattcctttgaagggagtcgggttcacccttccatcgtattctcccaactacacattgtaaagcctgagaaacttctagaacctcaggaagctgcagctggagggctggggcacctgcccccctgctccccacacatcatatcctccccatactcctgcagggcccacggctcctgagcaacagctgggacacccgggccttggcggctgcaccccctgctaggctctgcccaccggccaccaacactcctgtaattccaataaagcagtttattttctgaga

SEQ ID NO: 4294 - DNA, 5265 bp, Homo sapiens
acagccaataggccagggcccgtgctgtgattggccgcagcagtgttgacggatacgtgagaagaaaacggcgtggtagctcggagtgtggaatcgggcgcgaacctgagttctgagaagtgtggaagcacgtctgaggcaagcggaataacctggcccccgacgctcgggcctcggagctgcacgtgcgtgcccgatcgccttcggctctttccggccgctcggggcgcttcgggagtcctcggggccgcctcgctcaccttcggctatttccgcgttcctggcgcgccgttgtcccggcaacgcgcggcggctcagcggcctggcagaggtttcagcgctgaggaggcctgagttccgtcatggccctctattatgaccaccagatagaagccccggatgcagcagggtcaccctcatttatcagctggcaccctgtccatccattcttggcagttgcttacatcagcacaacctcaacaggcagcgtggatatttacctggagcaaggggagtgcgtgccagatacacacgtcgagaggccgttccgggttgcttccctgtgctggcacccgacgcggctggtgctggctgtgggctgggagactggagaagtgacggtgtttaacaagcaggacaaggagcagcacacgatgcccctgacacacacagccgacatcaccgtgctccgttggagccccagtggaaactgcctgctgtctggggacaggcttggtgtcttgctcttgtggaggttggaccaaaggggccgagtgcaagggacgcctctgctgaaacacgagtatgggaaacacctcacgcactgcatcttccggctcccccctcctggcgaggacctggttcagttggcaaaggcagctgtgagcggtgatgagaaagccctggacatgtttaactggaagaagagcagttctggaagtttgctgaagatggggtctcacgaggggctgttgttctttgtcagtctgatggacgggacagtgcactatgtggatgagaagggcaagaccactcaggtggtgtccgcagacagcacgattcagatgctgttctacatggagaagagggaggcactggtggtggtcacagagaacctccggctgtccctgtacacggtgcctcctgagggcaaagcagaagaagtgatgaaggtcaagctgagcgggaaaaccggccgccgggcagacatcgctttgattgaaggcagccttctcgtgatggccgtcggggaggctgccctcagattctgggacatagaacgaggagagaattatatactgagtccagatgagaagtttggctttgagaaaggagagaatatgaactgtgtgtgttactgtaaagtcaaaggtcttctggccgctggtaccgacagagggcgagtagccatgtggaggaaagtaccagacttcctgggcagccccggggcagagggcaaggacaggtgggcccttcagacccctaccgagctccaaggaaacatcacgcaaatccagtggggttccaggaagaacctgctggcagtgaacagcgtcatctccgtggccatcctcagcgagcgggccatgtcgtcacacttccaccagcaagtggccgccatgcaggtctccccgagtctgctgaatgtgtgcttcctgtccacgggggtcgcacacagcctgcgcaccgacatgcacatcagtggagtgtttgccaccaaggatgctgtcgcagtctggaacggaaggcaggtggcgatcttcgagctttctggagccgcgatacggagtgcagggaccttcttgtgtgagacgcctgtgttagcaatgcatgaagaaaacgtttacacggtggagtcaaaccgagttcaagttcgaacctggcaggggactgtcaaacaactcctccttttctcggagactgaggggaatccctgcttcttggacatctgtgggaatttcctggttgtagggacagacttggctcactttaaaagctttgatctttcccgaagagaggccaaagcacactgtagctgcaggagcctggcggagctggtccctggggtggggggcatcgcttctctgcggtgcagcagcagcgggagcaccatcagcatcctccccagcaaggctgacaacagccctgattccaaaatctgcttctacgatgttgaaatggacacagtgaccgtctttgacttcaagactggacaaattgatcggagagagacgctgtcctttaatgagcaagagactaataagagccacctctttgtggatgagggactgaaaaattatgttcccgtgaaccacttctgggaccagagtgagccccggctgtttgtatgcgaagccgtgcaggagacgccgcgctcccagcctcagtctgcaaacgggcagccccaagatgggcgcgctggccctgcggcagatgttttgatcctgtccttcttcatttccgaagagcacggcttcctgcttcatgagagcttcccccggcctgccacctcccacagtctcctggggatggaagtgccttattactacttcacaagaaagcccgaagaagcagacagagaagacgaggtggagcctgggtgccaccacatccctcagatggtgtccaggagacccctgcgagactttgtggggctggaggactgcgacaaggccacccgggacgccatgctccacttcagcttctttgtcaccataggagacatggacgaagccttcaaatccatcaagctcatcaaaagtgaggccgtctgggagaacatggcgcgcatgtgcgtgaagacccagcggctggacgtggccaaggtgtgcctggggaacatgggccatgcccgcggggcccgagcgctgcgtgaggcggagcaggagccggagctagaggcccgcgtggccgtgctggccacgcagctgggcatgctggaggacgccgagcagctgtacaggaagtgcaagcgccacgacctcctgaacaagttctaccaggctgcgggccggtggcaggaggccctccaggtagccgagcaccacgatcgcgtgcacctgcgcagcacctaccaccgctatgccgggcacctggaggccagcgccgactgcagccgggccctcagttactacgagaagtcggacacgcaccgcttcgaggtgcccaggatgctgtcggaggacctgccgtccctggagctctacgtgaataaaatgaaggataagaccctgtggcggtggtgggcgcagtacctggagagccagggcgagatggacgccgcgctgcactactacgagctggcccgggaccacttctccctggtccgcatccactgcttccagggcaatgtccagaaggctgcgcaaatagccaacgagacaggaaacctggcggcctcctaccacctcgcccgccagtacgagagccaggaggaggtcgggcaggcggtgcacttctacacccgggcacaggccttcaagaatgccatccgcctgtgcaaggagaacggcctggacgaccagctcatgaacttggccctgctgagctcccccgaggacatgatcgaggcggcccgatactacgaggagaagggcgtgcagatggacagggcggtcatgctgtaccacaaggctggccacttctccaaggccctggagctggcctttgccacccagcagtttgtggccctacagctcatagcagaggacctggatgagacgtcagaccctgcgctcctggcccgctgctccgacttcttcatcgagcacagtcagtacgagagggcggtagagctgctgctggctgccaggaagtatcaggaagccctgcagctgtgcctggggcagaacatgagcatcaccgaggagatggcggaaaagatgaccgtggccaaggactcctcggacctgcctgaggagtcgcggcgggagctgctggagcagatagcagactgctgcatgcgccagggcagctaccacctggccaccaagaagtacacgcaggccggcaacaagctgaaggccatgagggcgctgctcaaatccggagacacggagaaaatcacgttcttcgcgagcgtgtccaggcagaaggaaatctacatcatggctgctaactacctgcagtccctggactggcggaaggagccggagatcatgaagaacatcatcggcttctacaccaaggggcgggccctggacctcctggctggcttttatgacgcttgtgcccaggtggagattgatgaataccagaactacgacaaagcccacggggcgctgaccgaggcctacaagtgcctggccaaggccaaggccaagagccccctggaccaggagaccaggctggcgcagctgcagagcaggatggcactggtgaagaggttcatccaggcccgcaggacgtacacagaggaccccaaggagtccatcaagcagtgtgagctgctcctggaggaaccagacctggacagcaccatccgcatcggggacgtctatggcttcctggtggagcactacgtgcggaaggaggaataccagacggcctacagattcctggaggagatgcggcggcggcttcccttggccaacatgtcctactacgtgagcccgcaggccgtggacgccgtgcaccgggggctgggtctcccactgccacgcaccgtccccgagcaggtccgccacaacagcatggaggacgccagggagctggacgaggaggtggtggaagaggcagatgacgacccctgaggggcctgggccccaggaccagcgtgctgctgcagaaaggcatcttctggaatttttttgtcagctgtggcaaagccagcatttttgctgggaaaaaacatgtctgtgttggaatacgcgacagagctgggcgagaacgcagcggcccgggccggcggagggtgtgacccgtctgcaccttgctctgtcccacctgcctctgggtgcccggcagctccactagatttttggattcattcctttgaagggagtcgggttcacccttccatcgtattctcccaactacacattgtaaagcctgagaaacttctagaacctcaggaagctgcagctggagggctggggcacctgcccccctgctccccacacatcatatcctccccatactcctgcagggcccacggctcctgagcaacagctgggacacccgggccttggcggctgcaccccctgctaggctctgcccaccggccaccaacactcctgtaattccaataaagcagtttattttctg

SEQ ID NO: 4295 - DNA, 2580 bp, Homo sapiens
aacgcgcggcggctcagcggcctggcagaggtttcagcgctgaggaggcctgagttccgtcatggccctctattatgaccaccagatagaagccccggatgcagcagggtcaccctcatttatcagctggcaccctgtccatccattcttggcagttgcttacatcagcacaacctcaacaggcagcgtggatatttacctggagcaaggggagtgcgtgccagatacacacgtcgagaggccgttccgggttgcttccctgtgctggcacccgacgcggctggtgctggctgtgggctgggagactggagaagtgacggtgtttaacaagcaggacaaggagcagcacacgatgcccctgacacacacagccgacatcaccgtgctccgttggagccccagtggaaactgcctgctgtctggggacaggcttggtgtcttgctcttgtggaggttggaccaaaggggccgagtgcaagggacgcctctgctgaaacacgagtatgggaaacacctcacgcactgcatcttccggctcccccctcctggcgaggacctggttcagttggcaaaggcagctgtgagcggtgatgagaaagccctggacatgtttaactggaagaagagcagttctggaagtttgctgaagatggggtctcacgaggggctgttgttctttgtcagtctgatggacgggacagtgcactatgtggatgagaagggcaagaccactcaggtggtgtccgcagacagcacgattcagatgctgttctacatggagaagagggaggcactggtggtggtcacagagaacctccggctgtccctgtacacggtgcctcctgagggcaaagcagaagaagtgatgaaggtcaagctgagcgggaaaaccggccgccgggcagacatcgctttgattgaaggcagccttctcgtgatggccgtcggggaggctgccctcagattctgggacatagaacgaggagagaattatatactgagtccagatgagaagtttggctttgagaaaggagagaatatgaactgtgtgtgttactgtaaagtcaaaggtcttctggccgctggtaccgacagagggcgagtagccatgtggaggaaagtaccagacttcctgggcagccccggggcagagggcaaggacaggtgggcccttcagacccctaccgagctccaaggaaacatcacgcaaatccagtggggttccaggaagaacctgctggcagtgaacagcgtcatctccgtggccatcctcagcgagcgggccatgtcgtcacacttccaccagcaagtggccgccatgcaggtctccccgagtctgctgaatgtgtgcttcctgtccacgggggtcgcacacagcctgcgcaccgacatgcacatcagtggagtgtttgccaccaaggatgctgtcgcagtctggaacggaaggcaggtggcgatcttcgagctttctggagccgcgatacggagtgcagggaccttcttgtgtgagacgcctgtgttagcaatgcatgaagaaaacgtttacacggtggagtcaaaccgagttcaagttcgaacctggcaggggactgtcaaacaactcctccttttctcggagactgaggggaatccctgcttcttggacatctgtgggaatttcctggttgtagggacagacttggctcactttaaaagctttgatctttcccgaagagaggccaaagcacactgtagctgcaggagcctggcggagctggtccctggggtggggggcatcgcttctctgcggtgcagcagcagcgggagcaccatcagcatcctccccagcaaggctgacaacagccctgattccaaaatctgcttctacgatgttgaaatggacacagtgaccgtctttgacttcaagactggacaaattgatcggagagagacgctgtcctttaatgagcaagagactaataagagccacctctttgtggatgagggactgaaaaattatgttcccgtgaaccacttctgggaccagagtgagccccggctgtttgtatgcgaagccgtgcaggagacgccgcgctcccagcctcagtctgcaaacgggcagccccaagatgggcgcgctggccctgcggcagatgttttgatcctgtccttcttcatttccgaagagcacggcttcctgcttcatgagagcttcccccggcctgccacctcccacagtctcctggggatggaagtgccttattactacttcacaagaaagcccgaagaagcagacagagaagacgaggtggagcctgggtgccaccacatccctcagatggtgtccaggagacccctgcgagactttgtggggctggaggactgcgacaaggccacccgggacgccatgctccacttcagcttctttgtcaccataggagacatggacgaagccttcaaatccatcaagctcatcaaaagagcctgaaaccagagaaggagaggtgggccgtgagcaacccttggttggcgcagcttgttcccgtctagttagtcgctgatgctacagtttcacttacagttttatctttgaggagctcc

SEQ ID NO: 4296 - DNA, 825 bp, Homo sapiens
gccgtggcaggctggctgggtaccggctgtcgctgacccaggagaagctgcctgtctacatcagcctgggctgcagcgcgctgccgccgcggggccggcagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaa

SEQ ID NO: 4297 - DNA, 1071 bp, Homo sapiens
gtggcagcggccgtggcaggctggctgggtaccggctgtcgctgacccaggagaagctgcctgtctacatcagcctgggctgcagcgcgctgccgccgcggggccggcagctgaactatgtgctcttcagggcgggcaccgtgttgcattcatctttgtacccccagcatctagcagtgttggcatgtagtaggcactcaagaaatgtgtgttgaatgaacgatgcctgtgacaagcaagcggactttattctttcctgacccttgctcctatgacacacctcctcctgactgccactgtcactccttcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaa

SEQ ID NO: 4298 - DNA, 787 bp, Homo sapiens
ccgtggcaggctggctgggtaccggctgtcgctgacccaggagaagctgcctgtctacatcagcctgggctgcagcgcgctgccgccgcggggccggcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatgg

SEQ ID NO: 4299 - DNA, 852 bp, Homo sapiens
ccgtggcaggctggctgggtaccggctgtcgctgacccaggagaagctgcctgtctacatcagcctgggctgcagcgcgctgccgccgcggggccggcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttg

SEQ ID NO: 4300 - DNA, 611 bp, Homo sapiens
gacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatg

SEQ ID NO: 4301 - DNA, 1113 bp, Homo sapiens
aatcgagggtcagcgaggaggaggaggaggcggggcaggtgggctatggttgcttggagagtgcatccggcccggtacttgtgatcggaggagagccggatcgtccttccttgaaccctctgggtagggctgtgctgaggggctgggcggggagcacaggccgtgtccgctcgcttgcaccttttcagactgccgtgtcaggcctcgagccgggcccacctggagccctcccctgcccacccgcccccagcgcccgatatccgcccccggcccagaagggccgggctcggtcatccccagtcccgtcgcggccactgacccttgagatcagccctcccctccccaccttcccgtcccaggccagcccagggcccgaagcccacccactcgcgtctctagcagccgctcttgtcctctgggtacggctcgcgggagtgttggttaccatggtgaagctggcagccaaatgcatcctggcagacccagcagtgggcaagaccgccctggcacagatcttccgcagtgatggagcccatttccagaaaagctacaccctgacaacaggaatggatttggtggtgaagacagtgccagttcctgacacgggagacagtgtggaactcttcatttttgactctgctggcaaggagctgttttcggaaatgctggataaattgtgggagagtcccaatgtcttatgtctcgtctatgatgtgaccaatgaagaatccttcaacaactgcagcaagtggctggagaaggctcggtcacaggctccaggcatctctctcccaggtgttttagttgggaacaagacagacctggccggcagacgagcagtggactcagctgaggcccgggcatgggcgctgggccagggcctggaatgttttgaaacatccgtgaaagagatggaaaacttcgaagcccctttccactgccttgccaagcagttccaccagctgtaccgggagaaggtggaggttttccgggccctggcatgacgagctggagcagatcgtgctgcacaaccggagaagacagaattacctctgctcttttaatatataatgatggctttaaataaaattaggagaaaatgtcgaagcagca

SEQ ID NO: 4302 - DNA, 660 bp, Homo sapiens
cagtgatggagcccatttccagaaaagctacaccctgacaacaggaatggatttggtggtgaagacagtgccagttcctgacacgggagacagtgtggaactcttcatttttgactctgctggcaaggagctgttttcggaaatgctggataaattgtgggagagtcccaatgtcttatgtctcgtctatgatgtgaccaatgaagaatccttcaacaactgcagcaagtggctggagaaggctcggtcacaggctccaggcatctctctcccaggtgttttagttgggaacaagacagacctggccggcagacgagcagtggactcagctgaggcccgggcatgggcgctgggccagggcctggaatgttttgaaacatccgtgtgaccatcctgcctacccaaaggaggtccctacaaacaagtgcaagaacaatccgcgctgatcactgccctcccagaaagagatggaaaacttcgaagcccctttccactgccttgccaagcagttccaccagctgtaccgggagaaggtggaggttttccgggccctggcatgacgagctggagcagatcgtgctgcacaaccggagaagacagaattacctctgctcttttaatatataatgatggctttaaataaaattaggagaaaatgtc

SEQ ID NO: 4303 - DNA, 946 bp, Homo sapiens
tgcttggagagtgcatccggcccggtacttgtgatcggaggagagccggatcgtccttccttgaaccctctgggtagggctgtgctgaggggctgggcggggagcacaggccgtgtccgctcgcttgcaccttttcagactgccgtgtcaggcctcgagccgggcccacctggagccctcccctgcccacccgcccccagcgcccgatatccgcccccggcccagaagggccgggctcggtcatccccagtcccgtcgcggccactgacccttgagatcagccctcccctccccaccttcccgtcccaggccagcccagggcccgaagcccacccactcgcgtctctagcagccgctcttgtcctctgggtacggctcgcgggagtgttggttaccatggtgaagctggcagccaaatgcatcctggcagttcctgtggataaaaggcttagccgtgcagaagtgtgctctggctgttgtgaggtttgcagatcagtctcatggacctgtgccctgcccgcggcctcagaacaagttcccgtgagaggagacccagcagtgggcaagaccgccctggcacagatcttccgcagtgatggagcccatttccagaaaagctacaccctgacaacaggaatggatttggtggtgaagacagtgccagttcctgacacgggagacagtgtggaactcttcatttttgactctgctggcaaggagctgttttcggaaatgctggataaattgtgggagagtcccaatgtcttatgtctcgtctatgatgtgaccaatgaagaatccttcaacaactgcagcaagtggctggagaaggctcggtcacaggctccaggcatctctctcccaggtgttttagttgggaacaagacagacctggccggcagacgagcagtggactcagctgaggcccgggcatgggcgctgggcc

SEQ ID NO: 4304 - DNA, 531 bp, Homo sapiens
ggcggggcaggtgggctatggttgcttggagagtgcatccggcccggtacttgtgatcggaggagagccggatcgtccttccttgaaccctctgggccagcccagggcccgaagcccacccactcgcgtctctagcagccgctcttgtcctctgggtacggctcgcgggagtgttggttaccatggtgaagctggcagccaaatgcatcctggcagacccagcagtgggcaagaccgccctggcacagatcttccgcagtgatggagcccatttccagaaaagctacaccctgacaacaggaatggatttggtggtgaagacagtgccagttcctgacacgggagacagtgtggaactcttcatttttgactctgctggcaaggagctgttttcggaaatgctggataaattgtgggagagtcccaatgtcttatgtctcgtctatgatgtgaccaatgaagaatccttcaacaactgcagcaagtggctggagaaggctcggtcacaggctccaggcatctctctcccag

SEQ ID NO: 4305 - DNA, 1090 bp, Homo sapiens
ggaggcggggcaggtgggctatggttgcttggagagtgcatccggcccggtacttgtgatcggaggagagccggatcgtccttccttgaaccctctgggtagggctgtgctgaggggctgggcggggagcacaggccgtgtccgctcgcttgcaccttttcagactgccgtgtcaggcctcgagccgggcccacctggagccctcccctgcccacccgcccccagcgcccgatatccgcccccggcccagaagggccgggctcggtcatccccagtcccgtcgcggccactgacccttgagatcagccctcccctccccaccttcccgtcccaggccagcccagggcccgaagcccacccactcgcgtctctagcagccgctcttgtcctctgggtacggctcgcgggagtgttggttaccatggtgaagctggcagccaaatgcatcctggcaggagacccagcagtgggcaagaccgccctggcacagatcttccgcagtgatggagcccatttccagaaaagctacaccctgacaacaggaatggatttggtggtgaagacagtgccagttcctgacacgggagacagtgtggaactcttcatttttgactctgctggcaaggagctgttttcggaaatgctggataaattgtgggagagtcccaatgtcttatgtctcgtctatgatgtgaccaatgaagaatccttcaacaactgcagcaagtggctggagaaggctcggtcacaggctccaggcatctctctcccaggtgttttagttgggaacaagacagacctggccggcagacgagcagtggactcagctgaggcccgggcatgggcgctgggccagggcctggaatgttttgaaacatccgtgaaagagatggaaaacttcgaagcccctttccactgccttgccaagcagttccaccagctgtaccgggagaaggtggaggttttccgggccctggcatgacgagctggagcagatcgtgctgcacaaccggagaagacagaattacctctgctcttttaatatataatgatggctttaaataaaattaggagaaaatgtcgaagcagc

SEQ ID NO: 4306 - DNA, 813 bp, Homo sapiens
gaggagagggagataaagccagtaggtgagagatgagcttggaggaggtgactgctattgcagatagaattggtggagaggcccctgggaagaagaatccttgggtcacagacaggtattctgcgatggagatggagcatagcatttggaaagagatttcagaatgatgaacacagcctcagacttcttgcttcccacaaatgcagagacccttccaccccccacgccccacacaaaaaagtattcaggtggaagctgtcaacccaggttgggtcagttggacaggtgactctgcctgtcagtgccagtcacacttctttaccttcaagacttcaaagtaaattccagtttggaagtgacagcttttccccatagggcgtgtttcagtggaagagcgtcagttccgtttccagggccccaaagccctctgtaagttctgttaccttctgggtcagttcctgtggataaaaggcttagccgtgcagaagtgtgctctggctgttgtgaggtttgcagatcagtctcatggacctgtgccctgcccgcggcctcagaacaagttcccgtgagaggagacccagcagtgggcaagaccgccctggcacagatcttccgcagtgatggagcccatttccagaaaagctacaccctgacaacaggaatggatttggtggtgaagacagtgccagttcctgacacgggagacagtgtggaactcttcatttttgactctgctggcaaggagctgttttcggaaatgctggataaattgtgggagagtcccaatgtcttatgtctcgtctatgatgtgac

SEQ ID NO: 4307 - DNA, 683 bp, Homo sapiens
catggacctgtgccctgcccgcggcctcagaacaagttcccgtgagaggagacccagcagtgggcaagaccgccctggcacagatcttccgcagtgatggagcccatttccagaaaagctacaccctgacaacaggaatggatttggtggtgaagacagtgccagttcctgacacgggagacagtgtggaactcttcatttttgactctgctggcaaggagctgttttcggaaatgctggataaattgtgggagagtcccaatgtcttatgtctcgtctatgatgtgaccaatgaagaatccttcaacaactgcagcaagtggctggagaaggctcggtcacaggctccaggcatctctctcccaggtgttttagttgggaacaagacagacctggccggcagacgagcagtggactcagctgaggcccgggcatgggcgctgggccagggcctggaatgttttgaaacatccgtgaaagagatggaaaacttcgaagcccctttccactgccttgccaagcagttccaccagctgtaccgggagaaggtggaggttttccgggccctggcatgacgagctggagcagatcgtgctgcacaaccggagaagacagaattacctctgctcttttaatatataatgatggctttaaataaaattaggagaaaatgtcgaagcagc

SEQ ID NO: 4308 - DNA, 1757 bp, Homo sapiens
agcgctgcgtcctgggccacgcctcccggcgcaccgacgcgcctctccggttactaagcggccttggatacctggccgcgggatgctgggcggcgtcaggtgagcggtggtcgctgggcctcaggtaaccatggagaaagagctgcggagcaccattcttttcaatgcctacaaaaaggagatatttaccaccaacaatggctacaaatccatgcagaaaaaacttcggagtaattggaagattcagagcttaaaagatgaaatcacatctgagaagttaaatggagtgaaactgtggattacagctgggccaagggaaaaatttactgcagctgagtttgaaatcctgaagaaatatcttgacactggtggagatgtctttgtgatgctaggagaaggtggagaatccagatttgacaccaatattaactttttactagaagaatatggaatcatggttaataatgatgctgtggttagaaatgtatatcacaaatatttccatcctaaagaagctctagtttccagtggagtcttgaacagggaaattagccgagctgcaggaaaggctgtgcctgggatcattgatgaggaaagcagtggaaacaatgcccaggctctcacctttgtgtatccttttggtgccacattgagtgtcatgaaaccagcagtggcggttctgtctacaggttctgtctgcttcccacttaacagacccattttggctttctatcactcaaagaaccaaggtgggaagctggcagtgcttggttcatgtcacatgttcagtgatcaatatttggacaaagaagaaaacagcaaaatcatggatgttgttttccagtggctcacgacaggagacatccacctaaaccagattgatgctgaggacccagagatttctgactacatgatgctgccctacacagccaccctatcaaagcggaatcgagagtgtctccaggagagtgatgagatcccaagggactttaccaccctcttcgacctgtccatcttccagctggataccacctccttccacagcgtcatcgaggctcacgagcagctaaatgtgaaacatgaaccactccagctcatccagcctcagtttgagacgccgctgccaacccttcagcctgcggtttttcctcccagtttccgggagttaccacctcctcctctggagctatttgatttagatgaaacgttctcctctgagaaggcacggctggctcagattaccaataagtgtactgaagaagacctggaattttatgtcaggaagtgtggtgatattcttggagtaaccagtaaactaccaaaggaccaacaggatgccaaacatatccttgagcacgtcttcttccaagtggtggagttcaagaaattgaaccaggaacatgacatcgatacaagtgaaacagcattccagaacaatttctgaagaccatgcctcttgaagctttttctgcctcctgattctctctttgtaaactattttcaaattgtttttcaactccttatcaaaattgtttatacactctttcctccatgagctctggaaggtatatgcatcttctgtaatactcagataggtataagatttttcacaaaatccttatgtaagatacattccatttttaaaaattaaatgtatggttgcatctgtctttttataccctatgaaacagtcttgatttttttttctcaaccccagttctggatttgagtcttttatcaaagacataattaactct

SEQ ID NO: 4309 - DNA, 1599 bp, Homo sapiens
ggccttggatacctggccgcgggatgctgggcggcgtcaggtaaccatggagaaagagctgcggagcaccattcttttcaatgcctacaaaaaggagatatttaccaccaacaatggctacaaatccatgcagaaaaaacttcggagtaattggaagattcagagcttaaaagatgaaatcacatctgagaagttaaatggagtgaaactgtggattacagctgggccaagggaaaaatttactgcagctgagtttgaaatcctgaagaaatatcttgacactggtggagatgtctttgtgatgctaggagaaggtggagaatccagatttgacaccaatattaactttttactagaagaatatggaatcatggttaataatgatgctgtggttagaaatgtatatcacaaatatttccatcctaaagaagctctagtttccagtggagtcttgaacagggaaattagccgagctgcaggaaaggctgtgcctgggatcattgatgaggaaagcagtggaaacaatgcccaggctctcacctttgtgtatccttttggtgccacattgagtgtcatgaaaccagcagtggcggttctgtctacaggttctgtctgcttcccacttaacagacccattttggctttctatcactcaaagaaccaaggtgggaagctggcagtgcttggttcatgtcacatgttcagtgatcaatatttggacaaagaagaaaacagcaaaatcatggatgttgttttccagtggctcacgacaggagacatccacctaaaccagattgatgctgaggacccagagatttctgactacatgatgctgccctacacagccaccctatcaaagcggaatcgagagtgtctccaggagagtgatgagatcccaagggactttaccaccctcttcgacctgtccatcttccagctggataccacctccttccacagcgtcatcgaggctcacgagcagctaaatgtgaaacatgaaccactccagctcatccagcctcagtttgagacgccgctgccaacccttcagcctgcggtttttcctcccagtttccgggagttaccacctcctcctctggagctatttgatttagatgaaacgttctcctctgagaaggcacggctggctcagattaccaataagtgtactgaagaagacctggaattttatgtcaggaagtgtggtgatattcttggagtaaccagtaaactaccaaaggaccaacaggatgccaaacatatccttgagcacgtcttcttccaagtggtggagttcaagaaattgaaccaggaacatgacatcgatacaagtgaaacagcattccagaacaatttctgaagaccatgcctcttgaagctttttctgcctcctgattctctctttgtaaactattttcaaattgtttttcaactccttatcaaaattgtttatacactctttcctccatgagctctggaaggtatatgcatcttctgtaatactcagataggtataagatttttcacaaaatccttatgtaagatacattccatttttaaaaattaaatgtatggttgcatctgtctttttatacccta

SEQ ID NO: 4310 - DNA, 2027 bp, Homo sapiens
cgggcctggcagttggcgcccatggagccagagctgctggttcggaaggtgtctgcattgcaggcctgcgtccggggcttcttggtccgacgccagttccagagcctgcgagctgagtatgaggcgattgtacgagaggtcgagggcgacctgggcacgcttcagtggaccgagggccgcattcccaggccgcgattcctcccagagaaggcaaaatcccatcagacctggaaagcaggagacagggtagcaaatccagagcaggggctgtggaaccacttcccatgtgaagagtctgagggagaggccacctgggaggagatggtgctgaagaagtcaggagagagctcagcaaatcaaggaagcctctgcagagatcacagctcctggcttcagatgaagcagaacaggaaacccagccaagagaagaccagagacacgacaaggatggagaatccagaagccacagatcaaagactgccccacagccaacctcagcttcaagagcttcagtaccaccgcagccacttggccatggaattgctgtggctgcaacaggccatcaatagccgtaaggagtacctacttcttaaacaaacactgagatccccagaggcgggcccgatcagagaggaaccccgcgtgttcctagaacatggggaacaggcctgtgagagggaccagtcacaaccaagcgcaccactggaggaccagtcctacagagacaggaccactggagagctagaacaggaggatgactcctgtcacagggtcaaatcaccccacagatccccaggaagtttggccactacacaaaaaaacattgctggggctaagtgcagagaaccatgctacagcaagtctggaccaccgtcgtctataccatcaaacagccaggccttgggggacaggctcaccaaagggccagacgatggaagacagacctttggagggacctgcctgctgcagatgaaaatcctggaggaccagacccccagaggtttaaaacctaggaaccattgtcccaggaagtccaggacacagctgtctgcactctatgaggactcaaatattaaggagatgtctcccagaaaactagaccacaaagagcctgactgccgaacagtcaggacacaagagttgggcctctcagaggaccacatcatctgggatggtaccttgggggggccagagcatagtgtcctcgatctctggaggactaaaccacccaaaggccaggcccccactgatagaagctccagagatggaacctccaatgagcctagtcatgaaggacagaaaaagcagaggactataccatggagatcaaagtcacctgagattctgtcttctacaaaggcaggctgtacaggagaggaacagtggaggggcaggccatggaaaacagaaccacctggctagaccctaggaagccaggagaggatcaggttccaaaggggaatgctatgaaagggcagtgagacaagacctcatcctacctccctgaccagctctggcttctgctcctgcccctggccattggtgactagtggggccaagagaagctggagcagagagctggcatgagtatagggaaggaggaaggacacattttcaatcctctgcctgtagctcaatccaaatttgtggataaggggccgggtgcagtggctcacacctgtaatcccagcactttgggaggccaaggtgagtggatcacctgaggtcagaagtttgagaccagcctgaccaacatggtgaaatgaaaccccatctcaactaaaaatataaaaattagccaggcgtggtggtgcatgcctgtagtcccagttactcgggaggctgagacaggagaatcgcttgaacccaggagatggagattgcagtaggccaagatgatgccactgcactccagcctgggctacagagcgagacacggtctcaaaaaacaaatgtgtggctaaggagttacctgggggaagtagaatgagaggtctgttgggaataaaggtttttcttagattctg

SEQ ID NO: 4311 - DNA, 2293 bp, Homo sapiens
aatgacgtacttcgcaggcgcgcgggcgggcctggcagttggcgcccatggagccagagctgctggttcggaaggtgtctgcattgcaggtgcgggggcgggcgcggggttcacaggatttttcctttagggaaatcatggggtctcgtacctggacctcccagcgagatgctaccacgttcagtcccctaactgcgcgccaacctctggagataccggctgtccccaaccgcgctgaggaaagctgggacccacggactccctgccctgcgcgtccccactcccaccacacgctcgcgccggatcagggaaacgggaagagccttaaggcctgcgtccggggcttcttggtccgacgccagttccagagcctgcgagctgagtatgaggcgattgtacgagaggtcgagggcgacctgggcacgcttcagtggaccgagggccgcattcccaggccgcgattcctcccagagaaggcaaaatcccatcagacctggaaagcaggagacagggtagcaaatccagagcaggggctgtggaaccacttcccatgtgaagagtctgagggagaggccacctgggaggagatggtgctgaagaagtcaggagagagctcagcaaatcaaggaagcctctgcagagatcacagctcctggcttcagatgaagcagaacaggaaacccagccaagagaagaccagagacacgacaaggatggagaatccagaagccacagatcaaagactgccccacagccaacctcagcttcaagagcttcagtaccaccgcagccacttggccatggaattgctgtggctgcaacaggccatcaatagccgtaaggagtacctacttcttaaacaaacactgagatccccagaggcgggcccgatcagagaggaaccccgcgtgttcctagaacatggggaacaggcctgtgagagggaccagtcacaaccaagcgcaccactggaggaccagtcctacagagacaggaccactggagagctagaacaggaggatgactcctgtcacagggtcaaatcaccccacagatccccaggaagtttggccactacacaaaaaaacattgctggggctaagtgcagagaaccatgctacagcaagtctggaccaccgtcgtctataccatcaaacagccaggccttgggggacaggctcaccaaagggccagacgatggaagacagacctttggagggacctgcctgctgcagatgaaaatcctggaggaccagacccccagaggtttaaaacctaggaaccattgtcccaggaagtccaggacacagctgtctgcactctatgaggactcaaatattaaggagatgtctcccagaaaactagaccacaaagagcctgactgccgaacagtcaggacacaagagttgggcctctcagaggaccacatcatctgggatggtaccttgggggggccagagcatagtgtcctcgatctctggaggactaaaccacccaaaggccaggcccccactgatagaagctccagagatggaacctccaatgagcctagtcatgaaggacagaaaaagcagaggactataccatggagatcaaagtcacctgagattctgtcttctacaaaggcaggctgtacaggagaggaacagtggaggggcaggccatggaaaacagaaccacctggctagaccctaggaagccaggagaggatcaggttccaaaggggaatgctatgaaagggcagtgagacaagacctcatcctacctccctgaccagctctggcttctgctcctgcccctggccattggtgactagtggggccaagagaagctggagcagagagctggcatgagtatagggaaggaggaaggacacattttcaatcctctgcctgtagctcaatccaaatttgtggataaggggccgggtgcagtggctcacacctgtaatcccagcactttgggaggccaaggtgagtggatcacctgaggtcagaagtttgagaccagcctgaccaacatggtgaaatgaaaccccatctcaactaaaaatataaaaattagccaggcgtggtggtgcatgcctgtagtcccagttactcgggaggctgagacaggagaatcgcttgaacccaggagatggagattgcagtaggccaagatgatgccactgcactccagcctgggctacagagcgagacacggtctcaaaaaacaaatgtgtggctaaggagttacctgggggaagtagaatgagaggtctgttgggaataaaggtttttcttagattctg

SEQ ID NO: 4312 - DNA, 1369 bp, Homo sapiens
agacaccgagtctcgccttctgagattggcgggtaacctagcaacgcagggaccgcggcggtaactgtggctagggaaacctggagcggtcagagcaggatggccagagacaataaaagcacgagacccaagtagtctaccgaagtctccatctctgtggacctacagaggcacagagggctgctcacaagatggctttagacattctcgccatggcccctttgtatcaggcccctgccatcaacagaatagggccaaagacagacccatctaaaaggccagctgatccactaaaacccttggttctctctaggaccaaactcaccaccattgaggccaaaaggatcatgtccatcctggatgaggcgatctacaaggtggagctggtgaccttgctgtcgtatgtggcatccaacagagaggatatggaggggatgctgggggaggacgtcatgagggcagtgagagagcatgaggatctctgccaggtcctccttgaaaacgtcaggtgcctgaaagagaaagaaaggcaattgcaggagcagaaagaggctgaggaggaagggtggctcagagaccgcctcctttccatagagctgcagaaatccagcctctcaccacttatgcagcagatcaaagactccaccaagaacgtccttagactcttgctcagcaacccccaggctgctaggctcctgcagatgcagacacagggtagaagtgcagaagcccagaattttattgacagcctgatagagctccgtggtttcctgtttgaaaaactactcactagtcccatggaagcgagggataaggcccagttcttacaggatatcagtagacagaatagtaataaccaacaaatcattgatactcttgaaaaggaattggcggagagaatgaagaacaggaatgcagaggaggagttggaggatctggacgctgttcacagggaggagaagatctcgctggaggagctcaggcggaggcacaaagtgctggtgggagagtttgcgcagatccgggaagagcgggagatcaactccaagaaaaggatggaggcagagcaggagatggtgcgcatggtacgggcggccacgctcatccaggccctatggaagggctatctggtgcgctccctgctcagatccaagaagaagcggggcaagggcaaagcaaaggacaaggagaagggcaagcagaaaggcaaggagaagggcaagggcaagaaatgagctctccacccagcccgctcctgacccttatcttcccagagaccaggccaggaaggcccgagatggagagcactaaattcacggctttcatgtttttatttaataaattaaaaagtatttgaagccacattgaa

SEQ ID NO: 4313 - DNA, 2030 bp, Homo sapiens
agacaccgagtctcgccttctgagattggcgggtaacctagcaacgcagggaccgcggcggtaactgtggctagggaaacctggagcggtcagagcaggatggccagagacaataaaagcacgagacccaagtagtctaccgaagtctccatctctgtggacctacagaggcacagagggctgctcacaagatggctttagacattctcgccatggcccctttgtatcaggcccctgccatcaacagaatagggccaaagacagacccatctaaaaggccagctgatccactaaaacccttggttctctctaggaccaaactcaccaccattgaggccaaaaggatcatgtccatcctggatgaggcgatctacaaggtggagctggtgaccttgctgtcgtatgtggcatccaacagagaggatatggaggggatgctgggggaggacgtcatgagggcagtgagagagcatgaggatctctgccaggtcctccttgaaaacgtcaggtgcctgaaagagaaagaaaggcaattgcaggagcagaaagaggctgaggaggaagggtggctcagagaccgcctcctttccatagagctgcagaaatccagcctctcaccacttatgcagcagatcaaagactccaccaagaacgtccttagactcttgctcagcaacccccaggctgctaggctcctgcagatgcagacacagggtagaagtgcagaagcccagaattttattgacagcctgatagagctccgtggtttcctgtttgaaaaactactcactagtcccatggaagcgagggataaggcccagttcttacaggatatcagtagacagaatagtaataaccaacaaatcattgatactcttgaaaaggaattggcggagagaatgaagaacaggaatgcagaggtattgtttcatagtattgctgaaattactgaagaagccacacaaatcttttgttggttgggtttttcctcaatgattgattttttttttaagatggagtctcgctctgttgtccagactagagtgcagtggtgtaatctcgactcactgcaacctctgcctcccaggttcaagcgattctcccaccacagcctcccaagtagttgggattacaggcgtatgccaccacgcccggctaatttttgtatttttagtagagacagggtcacaccattctcctgcctcagcctcccgagtagctgggactacaggtgcccaccactgtactccagcctggctgcagagcaagaccctgtctcaaaaaaaaaagggaaacagtagcatgatcccaaaccctaataataattgtcatattgcacacatacagtgtatttagtttaacatacattttctctctaaatctttacaaaaaccctgtgagatggtgtatgagtacagatttggctgctataacagagacacccaaaatagctgtggcttagtcaagatggcagtgtatttctctgtagtggaaacaccggagctggtgtggcatctctgctccccaacttgtcagaggtctggtttcttctatgtgacttccctgctgtccccaacatgggacttctgcttgtgggccaagatggctgctccagctttccccatcatgtggcccccagtctagccagcaggaaggaggaaaggggaggagagggcttggttctgccccttaaggacacgtgtggaggtggcacacagaacttccatgcatatcttgtagccacacccagcagagagaagtgctaggaaggaccgaccacccgtcactggggctgtgttatgctccacattctaccccacagcctctctggggagagcagacatgggggtagccaggctgcactgccacaggcccttctgtttctatcccccaccactgatgaaaggttcaaggccctgggaaactattcacagccccctccctggtgctgggttgggcacttctcactgaatttgtcctttaaagcattcacctgactttgtggataacattcacctgactttgtggat

SEQ ID NO: 4314 - DNA, 1673 bp, Homo sapiens
agacaccgagtctcgccttctgagattggcgggtaacctagcaacgcagggaccgcggcggtaactgtggctagggaaacctggagcggtcagagcaggatggccagagacaataaaagcacgagacccaagtagtctaccgaagtctccatctctgtggacctacagaggcacagagggctgctcacaagatggctttagacattctcgccatggcccctttgtatcaggcccctgccatcaacagaatagggccaaagacagacccatctaaaaggccagctgatccactaaaacccttggttctctctaggaccaaactcaccaccattgaggccaaaaggatcatgtccatcctggatgaggcgatctacaaggtggagctggtgaccttgctgtcgtatgtggcatccaacagagaggatatggaggggatgctgggggaggacgtcatgagggcagtgagagagcatgaggatctctgccaggtcctccttgaaaacgtcaggtgcctgaaagagaaagaaaggcaattgcaggagcagaaagaggctgaggaggaagggtggctcagagaccgcctcctttccatagagctgcagaaatccagcctctcaccacttatgcagcagatcaaagactccaccaagaacgtccttagactcttgctcagcaacccccaggctgctaggctcctgcagatgcagacacagggtagaagtgcagaagcccagaattttattgacagcctgatagagctccgtggtttcctgtttgaaaaactactcactagtcccatggaagcgagggataaggcccagttcttacaggatatcagtagacagaatagtaataaccaacaaatcattgatactcttgaaaaggaattggcggagagaatgaagaacaggaatgcagaggtggaaaaggagaactttgtgatccaagaactgaaaaaccacctgcaccaggtgctcaagttctcagagaacagcctcgttcgcactaagcaggaggctgagaagcagcagaaggccgatttccgggcatcacaggccagggtggccaagatccagcaggagatcctgcagctgcagtcacagttttacaacctggtcatggagaaccgggaggcagagcaggcgctgaggaagaagaaatataaagtggaaacggaaatcgagaactggatccagaaatatgatacagagatgggtgagaagcaggaggagttggaggatctggacgctgttcacagggaggagaagatctcgctggaggagctcaggcggaggcacaaagtgctggtgggagagtttgcgcagatccgggaagagcgggagatcaactccaagaaaaggatggaggcagagcaggagatggtgcgcatggtacgggcggccacgctcatccaggccctatggaagggctatctggtgcgctccctgctcagatccaagaagaagcggggcaagggcaaagcaaaggacaaggagaagggcaagcagaaaggcaaggagaagggcaagggcaagaaatgagctctccacccagcccgctcctgacccttatcttcccagagaccaggccaggaaggcccgagatggagagcactaaattcacggctttcatgtttttatttaataaattaaaaagtatttgaagccacattg

SEQ ID NO: 4315 - DNA, 695 bp, Homo sapiens
atggctggatgaacacagatgtgaggggatttgaaccatctacaatcaatccatatgtgaccaatggaggagaagcagccccaaaagacgaaggaaccctcaaaagaagatgagcctcagcagaaggagatgccaacccatttgtccttaggagcagagtcaaaggcagaggctaaaactccagttctggttgagacacagacagtggacaatgccaatgagaaatcagaaaaacccccagaaaaccaaaagaagctctctgacaaagatacggtagccaccaagatccaggcctggtggcggggcaccctggtgcgtcgggcactgttgcacgcagccctcagtgcctgcatcattcagtgctggtggcggctgatactgtccaagattctgaagaagaggcggcaggcagcgctagaggccttctcccggaaggagtgggcagcagtcacactgcagtcccaggcccgcatgtggcgcatccgcagacgctattgccaggtgctcaatgctgttcgcatcatccaggcttactggaggtgccgctcctgtgcttcccgggggttcatcaagggccagtacagagtcacagccaaccagctgcatctccagctggagatcttgctggactcagggccttgcattgtgacagagtgtattcccttctcaataaaggaatgaagtggtcttttcca

SEQ ID NO: 4316 - DNA, 347 bp, Homo sapiens
caggcctttcttcctccacccttcctgcctatgctatggctggatgaacacagatgtgaggggatttgaaccatctacaatcaatccatatgtgaccaatggaggagaagcagccccaaaagacgaaggaaccctcaaaagaagatgagcctcagcagaaggagatgccaacccatttgtccttaggagcagagtcaaaggcagaggctaaaactccagttctggttgagacacagacagtggacaatgccaatgagaaatcagaaaaaagagtgtgtcagtggaatatggtcatcgtcagcatggattggaagtccttggagtctgaagacttgaggaatttgtga

SEQ ID NO: 4317 - DNA, 578 bp, Homo sapiens
agggctaatgaaccatctaaggacaggccatgagggttcgattttgtaccaaaggcaatttaattttggttataattgaggatgttgaagaaagcattgaatggaagacattgcagaagaagaaacagcagaaaatcaaggaaaaacttagaataagaacaaaagcagctgtaaagatccaggcctggtggcggggcaccctggtgcgcaggacactgctgcatgcagccctcagggcctggataattcagtgctggtggcggatgacgctgtcgagggtgctggagaagaaacggcaggcagctctgatcgcctacgcaaccagagagagggcagtgatcaagctccagtctttggtccgtatgtggcgtgtccgctggcgatactgccaggtgctcaatgccatctacatcatccagggccactggcaatgccacaactgccagacctgcgctctcctccagggccactgtgtggtcacagccactcacctgcagttccacattgagatcatcaactcctaagggctggcaagaagggcactgtgtctactgtccctattaaaggtctaacctggt

SEQ ID NO: 4318 - DNA, 1270 bp, Homo sapiens
tggctctgcatccccagtaaaactgtgcctgcaacacgtgggatccagtaagtaggagagtcctcacagggaagaagggaaagaaattcctaggatgctggggtgagggtaccccagaagaatgaccaggcagcaggcttgaagagcagctacccagattacacagtggtgcagcggtccatgaaaaaagcagagttgacggattatccaagttttggtggaaagtttgggataaattagtacaaaccatggcaatcaagagctccaggaaaaacagacaggaaatgcatgaaaggctatgtcacagcaatatgccatgttgctaagccatggacaggatataatcacaatgatggaagccctgaatgcttattgaaccaaaaactgtgatgctataatcatatagagaggagagcagaaggatgggaacaggtaaatcttcacttcatgaaaagaagtcaagaggatcttctttttccttgatgttctgaagctacaagatgacttccaataccatgttgaataggagtggttttggtatcaggatgatgctggcctcatagaatgagctggggaggggcctttcctcctcaattttttggaatagtttcagtaggaatgggaccagctcttctttgttcatctgatagaattcagctgtggatccttcttgtcctgcgctttattttgttgagagttgcccaaggaagtcaacaggagagccagatcaggaaacagcaaccagagggagatgatcacctgaaccactgctccaaaccatgggcagtaaatgctgtaaaggtggtccagatgaagatgcagtagaaagacagaggcggcagaagttgcttcttgcacaactgcatcacagaaaaagggtgaaggcagctgggcagatccaggcctggtggcgtggggtcctggtgcgcaggaccctgctggttgctgccctcagggcctggatgattcagtgctggtggaggacgttggtgcagagacggatccgtcagcggcggcaggccctgttgagggtctacgtcatccaggagcaggcgacggtcaagctccagtcctgcatccgcatgtggcagtgccggcaatgttaccgccaaatgtgcaatgctctctgcttgttccaggtcccagagagcagccttgccttccagactgatggctttttacaggtccaatatgcaatcccttcaaagcagccagagttccacattgaaatcctatcaatctgaaaggcctggggcatggagaacaggct

SEQ ID NO: 4319 - DNA, 865 bp, Homo sapiens
atgaactgctggattcagtttgcaagtactttgttaaggatttttgcataaatgtttgtcaaggatattgacctaaagttttgttgttgccaggttttggtatcaggatgatgctggcctcatagaatgagctggggaggggcctttcctcctcaattttttggaatagtttcagtaggaatgggaccagctcttctttgttcatctgatagaattcagctgtggatccttcttgtcctgcgctttattttgttgagagttgcccaaggaagtcaacaggagagccagatcaggaaacagcaaccagagggagatgatcacctgaaccactgctccaaaccatgggcagtaaatgctgtaaaggtggtccagatgaagatgcagtagaaagacagaggcggcagaagttgcttcttgcacaactgcatcacagaaaaagggtgaaggcagctgggcagatccaggcctggtggcgtggggtcctggtgcgcaggaccctgctggttgctgccctcagggcctggatgattcagtgctggtggaggacgttggtgcagagacggatccgtcagcggcggcaggccctgttgagggtctacgtcatccaggagcaggcgacggtcaagctccagtcctgcatccgcatgtggcagtgccggcaatgttaccgccaaatgtgcaatgctctctgcttgttccaggtcccagagagcagccttgccttccagactgatggctttttacaggtccaatatgcaatcccttcaaagcagccagagttccacattgaaatcctatcaatctgaaaggcctggggcatggagaacaggctgcactaccctaataaatgtctgaccaggttgtg

SEQ ID NO: 4320 - DNA, 1241 bp, Homo sapiens
tggctctgcatccccagtaaaactgtgcctgcaacacgtgggatccagtaagtaggagagtcctcacagggaagaagggaaagaaattcctaggatgctggggtgagggtaccccagaagaatgaccaggcagcaggcttgaagagcagctacccagattacacagtggtgcagcggtccatgaaaaaagcagagttgacggattatccaagttttggtggaaagtttgggataaattagtacaaaccatggcaatcaagagctccaggaaaaacagacaggaaatgcatgaaaggctatgtcacagcaatatgccatgttgctaagccatggacaggatataatcacaatgatggaagccctgaatgcttattgaaccaaaaactgtgatgctataatcatatagagaggagagcagaaggatgggaacaggatcttctttttccttgatgttctgaagctacaagatgacttccaataccatgttgaataggagtggttttggtatcaggatgatgctggcctcatagaatgagctggggaggggcctttcctcctcaattttttggaatagtttcagtaggaatgggaccagctcttctttgttcatctgatagaattcagctgtggatccttcttgtcctgcgctttattttgttgagagttgcccaaggaagtcaacaggagagccagatcaggaaacagcaaccagagggagatgatcacctgaaccactgctccaaaccatgggcagtaaatgctgtaaaggtggtccagatgaagatgcagtagaaagacagaggcggcagaagttgcttcttgcacaactgcatcacagaaaaagggtgaaggcagctgggcagatccaggcctggtggcgtggggtcctggtgcgcaggaccctgctggttgctgccctcagggcctggatgattcagtgctggtggaggacgttggtgcagagacggatccgtcagcggcggcaggccctgttgagggtctacgtcatccaggagcaggcgacggtcaagctccagtcctgcatccgcatgtggcagtgccggcaatgttaccgccaaatgtgcaatgctctctgcttgttccaggtcccagagagcagccttgccttccagactgatggctttttacaggtccaatatgcaatcccttcaaagcagccagagttccacattgaaatcctatcaatctgaaaggcctggggcatggagaacaggctgcac

SEQ ID NO: 4321 - DNA, 1685 bp, Homo sapiens
agaagtacagacctgagtataatggagacctctagcctctaatcatgggcactaaaggggattgcagacttgaagggattgaaccaactactgcaagtcatgggcattcaatgttttgtaagagacaaccagtcaattcaaagatgcaggcaggcggagaaggatggccatgttcgccaaagcataatggaagatgttgatgaaaccgcactgttgaaacaaatggagcgggagaaaatgcctcctcctccaaagccaaagcatccagagtggctctgcatccccagtaaaactgtgcctgcaacacgtgggatccagtaagtaggagagtcctcacagggaagaagggaaagaaattcctaggatgctggggtgagggtaccccagaagaatgaccaggcagcaggcttgaagagcagctacccagattacacagtggtgcagcggtccatgaaaaaagcagagttgacggattatccaagttttggtggaaagtttgggataaattagtacaaaccatggcaatcaagagctccaggaaaaacagacaggaaatgcatgaaaggctatgtcacagcaatatgccatgttgctaagccatggacaggatataatcacaatgatggaagccctgaatgcttattgaaccaaaaactgtgatgctataatcatatagagaggagagcagaaggatgggaacaggtaaatcttcacttcatgaaaagaagtcaagaggatcttctttttccttgatgttctgaagctacaagatgacttccaataccatgttgaataggagtggttttggtatcaggatgatgctggcctcatagaatgagctggggaggggcctttcctcctcaattttttggaatagtttcagtaggaatgggaccagctcttctttgttcatctgatagaattcagctgtggatccttcttgtcctgcgctttattttgttgagagttgcccaaggaagtcaacaggagagccaggtattttctctttatccatcaactttgagcctggaaaaggcactgtggcccctggtcatagttgcctttgtgacatcacggccatctctttctccacctttcctgcccctgccaagatcaggaaacagcaaccagagggagatgatcacctgaaccactgctccaaaccatgggcagtaaatgctgtaaaggtggtccagatgaagatgcagtagaaagacagaggcggcagaagttgcttcttgcacaactgcatcacagaaaaagggtgaaggcagctgggcagatccaggcctggtggcgtggggtcctggtgcgcaggaccctgctggttgctgccctcagggcctggatgattcagtgctggtggaggacgttggtgcagagacggatccgtcagcggcggcaggccctgttgagggtctacgtcatccaggagcaggcgacggtcaagctccagtcctgcatccgcatgtggcagtgccggcaatgttaccgccaaatgtgcaatgctctctgcttgttccaggtcccagagagcagccttgccttccagactgatggctttttacaggtccaatatgcaatcccttcaaagcagccagagttccacattgaaatcctatcaatctgaaaggcctggggcatggagaacaggctgcactaccctaataaatgtctgaccaggt

SEQ ID NO: 4322 - DNA, 363 bp, Homo sapiens
acgaaaaaaaaaaaaaaaaaaaagaaaagaaaagaaaaaaaactcagagaaaggtctgcagctgttttcatccaggcctggtggcggggcatgctggtgcgacgcacactgctgcatgcagccctcagggcttggatcattcagtgctggtggaggcaggtgctggagaagctgctggcaaagaggcggaggatggtgttggagttctatgtgcagcaggaatgggcagcagtcaggctgcagtcctgggtccgcatgtggtgtgtccgccagcgttactgtcgtttgctcaacgctgtccgcatcatccaggtctattggcgctggcacagctgccattcccgtgtctttattgagggccac

SEQ ID NO: 4323 - DNA, 512 bp, Homo sapiens
cctgatcggaggagtgcgggccggagggtgatgggaccatctagcccctaaccatgggcccagaagagaagaccatcatgacagaaaggtctgcagctgttttcatccaggcctggtggcggggcatgctggtgcgacgcacactgctgcatgcagccctcagggcttggatcattcagtgctggtggaggcaggtgctggagaagctgctggcaaagaggcggaggatggtgttggagttctatgtgcagcaggaatgggcagcagtcaggctgcagtcctgggtccgcatgtggtgtgtccgccagcgttactgtcgtttgctcaacgctgtccgcatcatccaggtctattggcgctggcacagctgccattcccgtgtctttattgagggccactatgaactcaaagaaaaccaacttaatattcaacttgaaatctctttgggcttacaggcttgtaaggtgcaacaatgcataccccttccattaaaagaatgaccaggtctgcta

SEQ ID NO: 4324 - DNA, 430 bp, Homo sapiens
agttagagaagacagccataaagattcagtcatggtggcgtggaaacatggtgcgccggacgttactgcaggcagcactcagagcctgggtcatccagtgctggtggaggtcaatgcaggccaagatgttggagcaaagacggcgcctggcactaagactctatacctgccaggagtgggcggtggtgaaggtgcaggcacaggttcgaatgtggcaggcccgcaggcggttcctccaggcacgccaagcggcctgcatcatccagtctcactggcgctggcatgccagccaaacccgaggcctgatccggggccactatgaggtcagagccagccggctggagcttgacatcgaaatcctcatgacctagggcgctgacagagccaaggaggctggatctctcttccaataaagacccttactgaccat

SEQ ID NO: 4325 - DNA, 2419 bp, Homo sapiens
attaatccctgagacaaaggtactgaaggcaagtggctgaagaacaggcttgattggacagatgacttggagatgttcactggacagggacagccttgtgaagatctttgtgaatacccgacctcgcaagctccagagactacaataattcacttgccctaggttccaaagccagcaagtggaaaacggagactggaattccgcccacaggactccaaagcctgtgcagcaacaccccactcccccggcaggatcaccagcaggacgcgcgggagccaggaagtaagatccgtacctccaaggctcccatgggcccaagcctccgcatcaacagactgggagggattacgtggggtcccagggccggctctgaggcgggaaaactttctggaggcggcggcctcaggccggagcgggcgcacaccgactggaggggtcggattcagggatgtgggtggaccgcatttccccatcttccccgccgcgcacttcctctggtgcaatctccacaccccgcgccggcccgcctgcaacgcgccctggcactcaccggtgggcgaaatttccccgcctccacgtgagagccagctccgccgtgacccggaagtccacttcgagtcgccggcccaccctctcgggttccggcttcttccgggtcgcggccttccggcgaacgcggttaccgtggaaaccgcggccatggcggcaccgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaaggagtatgaagctgagcagcctccctttccagaaggatataaagtcaaacaggagcctgtgattacggttgcgccagtagaggaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgagcccacggccgccaatcccactctcgctcctgctgacagaagaggaagcagccctctacattcaatccttctggagagcctgtgtggttcgctgtgatcctgagattcaagaactgcgtcagtggcagaagaaacttcgcgaggccaagcacattcaccagcaagtcaaaattttctgggccaagcaagaacaaaaagtgaaatgcaaaatggaggacgatgcagtacctgcagccaagatgaaaattccatcatcttaaccatagctaagacgtatctttgcccattcgagcacaagttaccttgtgcaaggaaaatgtccaaatgatgctctctctcttgtgatttctttaacaagacttggaacatgtgcaaatggaatcttttctgtacaagataggattcattgcaaacaagctttaatgcaaatagtttagaaaagaaaggaccagtcttcactttctgcattatccccacattttattcattcatccagattacttcttcagtgcctcaggagtattcttctacaccagctgctgttaaaatgtacaatgaactctagtcccaaggaatacagaagtgctcttattaccagttttcccacttgtggccgcctttgcaaagatccatattctaatttaagtccccaacctctgaatttggttttaagtttacctagtgactgactactctctttataaaaaagaccttatacttaatgatcatttccaaaggagaccactccttaacttttactgcaaacccaacaagatgagacacttaaacccagacagatgtaacaaaggatttttgttgtctaagtcccaaagtattatatagaaagttcctgcttttatgggtaaacttattaccttaatatgttctgtggtttgctgttaaccaagattctcccatttaaaatgccacagaccgaccctcaaggcagatccgaaagcctagtagttagttgcactgggttgttttgacaagctaccacacgtcttaagtaaatagtaaagcctttatttttgtgttaagaacagcattttgaaaataaaacctatctgcccatggtttacagccttttaaatttgtaatatttatatagtcgtttatggtacatattgattgtcttgaaatttctttaacttcttttttataagtatgcaacagtcagccgggggaagataaaggtacattataaaacacacattaatgcatttaataaatatatattatctatc

SEQ ID NO: 4326 - DNA, 2600 bp, Homo sapiens
attaatccctgagacaaaggtactgaaggcaagtggctgaagaacaggcttgattggacagatgacttggagatgttcactggacagggacagccttgtgaagatctttgtgaatacccgacctcgcaagctccagagactacaataattcacttgccctaggttccaaagccagcaagtggaaaacggagactggaattccgcccacaggactccaaagcctgtgcagcaacaccccactcccccggcaggatcaccagcaggacgcgcgggagccaggaagtaagatccgtacctccaaggctcccatgggcccaagcctccgcatcaacagactgggagggattacgtggggtcccagggccggctctgaggcgggaaaactttctggaggcggcggcctcaggccggagcgggcgcacaccgactggaggggtcggattcagggatgtgggtggaccgcatttccccatcttccccgccgcgcacttcctctggtgcaatctccacaccccgcgccggcccgcctgcaacgcgccctggcactcaccggtgggcgaaatttccccgcctccacgtgagagccagctccgccgtgacccggaagtccacttcgagtcgccggcccaccctctcgggttccggcttcttccgggtcgcggccttccggcgaacgcggttaccgtggaaaccgcggccatggcggcaccgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaaggagtatgaagctgagcagcctccctttccagaaggatataaagtcaaacaggagcctgtgattacggttgcgccagtagaggaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgagaggaaaagaaccaaattcattgcctgtgattttctgactgagtggttatacaaccaaaatccaaagagggcaggggagccattcacagaatttttctccattccatttgtggaggagcggctaaagcaacacccacggccgccaatcccactctcgctcctgctgacagaagaggaagcagccctctacattcaatccttctggagagcctgtgtggttcgctgtgatcctgagattcaagaactgcgtcagtggcagaagaaacttcgcgaggccaagcacattcaccagcaagtcaaaattttctgggccaagcaagaacaaaaagtgaaatgcaaaatggaggacgatgcagtacctgcagccaagatgaaaattccatcatcttaaccatagctaagacgtatctttgcccattcgagcacaagttaccttgtgcaaggaaaatgtccaaatgatgctctctctcttgtgatttctttaacaagacttggaacatgtgcaaatggaatcttttctgtacaagataggattcattgcaaacaagctttaatgcaaatagtttagaaaagaaaggaccagtcttcactttctgcattatccccacattttattcattcatccagattacttcttcagtgcctcaggagtattcttctacaccagctgctgttaaaatgtacaatgaactctagtcccaaggaatacagaagtgctcttattaccagttttcccacttgtggccgcctttgcaaagatccatattctaatttaagtccccaacctctgaatttggttttaagtttacctagtgactgactactctctttataaaaaagaccttatacttaatgatcatttccaaaggagaccactccttaacttttactgcaaacccaacaagatgagacacttaaacccagacagatgtaacaaaggatttttgttgtctaagtcccaaagtattatatagaaagttcctgcttttatgggtaaacttattaccttaatatgttctgtggtttgctgttaaccaagattctcccatttaaaatgccacagaccgaccctcaaggcagatccgaaagcctagtagttagttgcactgggttgttttgacaagctaccacacgtcttaagtaaatagtaaagcctttatttttgtgttaagaacagcattttgaaaataaaacctatctgcccatggtttacagccttttaaatttgtaatatttatatagtcgtttatggtacatattgattgtcttgaaatttctttaacttcttttttataagtatgcaacagtcagccgggggaagataaaggtacattataaaacacacattaatgcatttaataaatatatattatctatcaaaagtgagccttagctcttcatcagttaataaaaagcacctgctgagaa

SEQ ID NO: 4327 - DNA, 884 bp, Homo sapiens
accgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaagggttgcgccagtagaggaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgagaggaaaagaaccaaattcattgcctgtgattttctgactgagtggttatacaaccaaaatccaaagagggcaggggagccattcacagaatttttctccattccatttgtggaggagcggctaaagcaacacccacggccgccaatcccactctcgctcctgctgacagaagaggaagcagccctctacattcaatccttctggagagcctgtgtggttcgctgtgatcctgagattcaagaactgcgtcagtggcagaagaaacttcgcgaggccaagcacattcaccagcaagtcaaaattttctgggccaagcaagaacaaaaagtgaaatgcaaaatggaggacgatgcagtacctgcagccaagatgaaaattccatcatcttaaccatagctaagacgtatctttgcccattcgagcacaagttaccttgtgcaaggaaaatgtccaaatgatgctctctctcttgtgatttcttta

SEQ ID NO: 4328 - DNA, 940 bp, Homo sapiens
ggttaccgtggaaaccgcggccatggcggcaccgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaaggagtatgaagctgagcagcctccctttccagaaggatataaagtcaaacaggagcctgtgattacggttgcgccagtagaggaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgagaggaaaagaaccaaattcattgcctgtgattttctgactgagtggttatacaaccaaaatccaaagagggcaggggagccattcacagaatttttctccattccatttgtggaggagcggctaaagcaacagttcgctgtgatcctgagattcaagaactgcgtcagtggcagaagaaacttcgcgaggccaagcacattcaccagcaagtcaaaattttctgggccaagcaagaacaaaaagtgaaatgcaaaatggaggacgatgcagtacctgcagccaagatgaaaattccatcatcttaaccatagctaagacgtatctttgcccattcgagcacaagttaccttgtgcaaggaaaatgtccaaatgatgctctctctcttgtgatttctttaacaagacttggaacatgtgcaaatggaatcttttctgtacaagata

SEQ ID NO: 4329 - DNA, 3189 bp, Homo sapiens
cggcctcaccttttcctgcccgaagcagaagattctcgcagtcctggtttctccctccagaagaccccccacccaaatcctctgtagctcctggtagtgccctgacccctgctgccaccgtccttcagagagcaacggaagagcttcccggagggcgaggaaaagagggaaagtagccagcaatgtcgaacgcaatgtataataagatgtggcatcagacccaagaagccctcggtgctttactcgataaagagcctcagaagatgattgaaccacaaagaaatcaggttttcatctttcaaacattagccaccttctacgtaaagtatgtgcagatctttagaaacctagagaatgtctacgaccagttcgtccacccccagaaacgaatactgatcaggaaagtcctggacggggtgatgggccgcatcctggagctgaagaacgagatggtggagctggaactcacggagttccattatttcgatgatatcctgcaggatctcaagctggccccccaacaattagatattcccatacccaagtattttttgaaggagaagttggaagtaataaaaggaagagagaaaattcttgctcaaatattagcggacagcggaatagatacatctgacatgaaataccctgtaaagagtatccctttcgatgaggctgttaaattaatccagattgctgagagggcacggcaaggtcgcctaagggctttattcatgaagcaaatctatctgcaagaatatagagcaaagcaatccaagatgcttggcaagaaagtgacagatacctgggctgctgcactccgcattcagaaggtttggcgacgtttccatcaacgtaaggaaactgaaaaactgagagaagaggagatgatcttcctgggtatgaatccacctcctctctttaatgaagtcagtgctacagtaatccaggctgaaaaggtggaccgcctgcggaatgaggtgcagataaagcatgaagaggactacagggaagccctggttaccatcaagaatgacctaaagttgatagaaggcgtggatatcaaggagaaccttcaagaccagatccggcattggttcatcgaatgcagaaatttaaccgggacatttcctgactaccctgacgttgaagaaggagggtcagctattattttttctgacaagaccatacaacaggttattgaggatatcatagcaaaccaagaggaagaagaaaaaaacaaaaagaagaagaagaaaaaggaaaaacaacccaagaaagccaaaaaacaaaagaaaggaacaaaggagaaaaataaggaagaagacgaaaaatggaaaatgtcaccaagtctttttcttcctgcaatgaaggaaggatgtaacgcatacaaagaaatctggatgaaaaaagatgagtcttggaatttctctcaggactatgatccagaactgatcaaagaggagaaacgaaaagaattacagtcagagatcaggatacaggttgatgagttgatgagacaggaacttaaaaacttaaagctagctgtggacagagaaagggagcgcccagtgaaagcaggaaagaaaaaggacaagaagaaaggaaagaaaggcaaaaagaaagagaagaaggcaaagaaggataaagatctgacagctgacaggaccatcgagtctctgtataaggaactggtggaagaaggattactgatccaggctctgaaagtcaacctctctgattacattggtgagtacagctacctggggactactcttcgccaggtgtccatagaacccatgccctccctcctggatgtcagacagctcatcacattgtacggaatctggccattaggttctgcagcagtgcatgagaaagctcctttggtgaaatcgctactgttagccgggccgtctggggtagggaagaaaatgctggtccatgccatctgcaccgaaacgggagccaacctcttcaacttgtcctcctctaacattgctgggaaataccctggcaaaaatggcctccaaatgatgctgcatgcagtcttcaaggtggctcgacagctccagccctccgtggtgtggattgaagacacagaaaaaaccttctacaaaaaagttcccaacgcagaaaagatgaatgaacctaaacgcctgaaaaaacaccttccccaaatcctgaaactcctgaaaccagatgaccggattctgattgtggggaccacacggcgtcccttcgatgctgaactccaatctttctgcaaagtttaccagaaaattattttggtgcccagaccagactatgcttccagatacgttctgtggaagcaaatcattgaacgcaatggaggagtcctcaccagtgccttgaatgtcagctgcctggcgaaggtcactgacggcttcacccaaggacatatagtcgaagtggttaaaggcgtgctcacagatcagagaatccggcggcaaattcataaacctctcactgcagttgagtttattacggcgataaccagcatgaatccagtgtacaaagaggaagaagagagctttaagaactggtatgccaaaactcctctgggtaaaaaacgtgccttggcgataacaggaggcagcacagaaaaggcaaaggacaaagggaaaaggaaataaaagaaagagaaaaaggcaaaaaagaaaaagtaatgcctttctgaagaaccatgcttgagtctctctgggatggagaggaccccaactcgccaaagaaaagattcaccattgcccgcctgaagaagccctcaggggaaggaacttagcagtgtgcaggtgagctgatgccgcaaacccgctaaccactgcatgtgctgttatgcctttcccaggctggacacctagctgggtgttcatcataactttccacagctttaatccacgccaagtttgtatataactgaaattcactcttgacaccctccacagtctttccaagttggactcttcctctcatcagtactagttgtcaaatttaaaatgtgacagttaaagaatattctagtttgacaattagtaagcaatgagtatatcatcagtacactagctttttattaatccatgtacactgtatagtatcttgcatctattttaataaattaattctttgctctagtaatagattttatataatgaaataaaggtgttgtccttg

SEQ ID NO: 4330 - DNA, 3281 bp, Homo sapiens
tggccgaagtgaggttcgcgagtctctgggtcgcgacgggaaggagtgaaacacctctctgcgcctgcgcgctccgtgcctgcgaagcaaacccggcctcaccttttcctgcccgaagcagaagattctcgcagtcctggtttctccctccagaagaccccccacccaaatcctctgtagctcctggtagtgccctgacccctgctgccaccgtccttcagagagcaacggaagagcttcccggagggcgaggaaaagagggaaagtagccagcaatgtcgaacgcaatgtataataagatgtggcatcagacccaagaagccctcggtgctttactcgataaagagcctcagaagatgattgaaccacaaagaaatcaggttttcatctttcaaacattagccaccttctacgtaaagtatgtgcagatctttagaaacctagagaatgtctacgaccagttcgtccacccccagaaacgaatactgatcaggaaagtcctggacggggtgatgggccgcatcctggagctgaagaacgagatggtggagctggaactcacggagttccattatttcgatgatatcctgcaggatctcaagctggccccccaacaattagatattcccatacccaagtattttttgaaggagaagttggaagtaataaaaggaagagagaaaattcttgctcaaatattagcggacagcggaatagatacatctgacatgaaataccctgtaaagagtatccctttcgatgaggctgttaaattaatccagattgctgagagggcacggcaaggtcgcctaagggctttattcatgaagcaaatctatctgcaagaatatagagcaaagcaatccaagatgcttggcaagaaagtgacagatacctgggctgctgcactccgcattcagaaggtttggcgacgtttccatcaacgtaaggaaactgaaaaactgagagaagaggagatgatcttcctgggtatgaatccacctcctctctttaatgaagtcagtgctacagtaatccaggctgaaaaggtggaccgcctgcggaatgaggtgcagataaagcatgaagaggactacagggaagccctggttaccatcaagaatgacctaaagttgatagaaggcgtggatatcaaggagaaccttcaagaccagatccggcattggttcatcgaatgcagaaatttaaccgggacatttcctgactaccctgacgttgaagaaggagggtcagctattattttttctgacaagaccatacaacaggttattgaggatatcatagcaaaccaagaggaagaagaaaaaaacaaaaagaagaagaagaaaaaggaaaaacaacccaagaaagccaaaaaacaaaagaaaggaacaaaggagaaaaataaggaagaagacgaaaaatggaaaatgtcaccaagtctttttcttcctgcaatgaaggaaggatgtaacgcatacaaagaaatctggatgaaaaaagatgagtcttggaatttctctcaggactatgatccagaactgatcaaagaggagaaacgaaaagaattacagtcagagatcaggatacaggttgatgagttgatgagacaggaacttaaaaacttaaagctagctgtggacagagaaagggagcgcccagtgaaagcaggaaagaaaaaggacaagaaaggaaagaaaggcaaaaagaaagagaagaaggcaaagaaggataaagatctgacagctgacaggaccatcgagtctctgtataaggaactggtggaagaaggattactgatccaggctctgaaagtcaacctctctgattacattggtgagtacagctacctggggactactcttcgccaggtgtccatagaacccatgccctccctcctggatgtcagacagctcatcacattgtacggaatctggccattaggttctgcagcagtgcatgagaaagctcctttggtgaaatcgctactgttagccgggccgtctggggtagggaagaaaatgctggtccatgccatctgcaccgaaacgggagccaacctcttcaacttgtcctcctctaacattgctgggaaataccctggcaaaaatggcctccaaatgatgctgcatgcagtcttcaaggtggctcgacagctccagccctccgtggtgtggattgaagacacagaaaaaaccttctacaaaaaagttcccaacgcagaaaagatgaatgaacctaaacgcctgaaaaaacaccttccccaaatcctgaaactcctgaaaccagatgaccggattctgattgtggggaccacacggcgtcccttcgatgctgaactccaatctttctgcaaagtttaccagaaaattattttggtgcccagaccagactatgcttccagatacgttctgtggaagcaaatcattgaacgcaatggaggagtcctcaccagtgccttgaatgtcagctgcctggcgaaggtcactgacggcttcacccaaggacatatagtcgaagtggttaaaggcgtgctcacagatcagagaatccggcggcaaattcataaacctctcactgcagttgagtttattacggcgataaccagcatgaatccagtgtacaaagaggaagaagagagctttaagaactggtatgccaaaactcctctgggtaaaaaacgtgccttggcgataacaggaggcagcacagaaaaggcaaaggacaaagggaaaaggaaataaaagaaagagaaaaaggcaaaaaagaaaaagtaatgcctttctgaagaaccatgcttgagtctctctgggatggagaggaccccaactcgccaaagaaaagattcaccattgcccgcctgaagaagccctcaggggaaggaacttagcagtgtgcaggtgagctgatgccgcaaacccgctaaccactgcatgtgctgttatgcctttcccaggctggacacctagctgggtgttcatcataactttccacagctttaatccacgccaagtttgtatataactgaaattcactcttgacaccctccacagtctttccaagttggactcttcctctcatcagtactagttgtcaaatttaaaatgtgacagttaaagaatattctagtttgacaattagtaagcaatgagtatatcatcagtacactagctttttattaatccatgtacactgtatagtatcttgcatctattttaataaattaattctttgctctagtaatagattttatataatgaaataaaggtgttgtccttgaa

SEQ ID NO: 4331 - DNA, 2204 bp, Homo sapiens
cggcctcaccttttcctgcccgaagcagaagattctcgcagtcctggtttctccctccagaagaccccccacccaaatcctctgtagctcctggtagtgccctgacccctgctgccaccgtccttcagagagcaacggaagagcttcccggagggcgaggaaaagagggaaagtagccagcaatgtcgaacgcaatgtataataagatgtggcatcagacccaagaagccctcggtgctttactcgataaagagcctcagaagatgattgaaccacaaagaaatcaggttttcatctttcaaacattagccaccttctacgtaaagtatgtgcagatctttagaaacctagagaatgtctacgaccagttcgtccacccccagaaacgaatactgatcaggaaagtcctggacggggtgatgggccgcatcctggagctgaagaacgagatggtggagctggaactcacggagttccattatttcgatgatatcctgcaggatctcaagctggccccccaacaattagatattcccatacccaagtattttttgaaggagaagttggaagtaataaaaggaagagagaaaattcttgctcaaatattagcggacagcggaatagatacatctgacatgaaataccctgtaaagagtatccctttcgatgaggctgttaaattaatccagattgctgagagggcacggcaaggtcgcctaagggctttattcatgaagcaaatctatctgcaagaatatagagcaaagcaatccaagatgcttggcaagaaagtgacagatacctgggctgctgcactccgcattcagaaggtttggcgacgtttccatcaacgtaaggaaactgaaaaactgagagaagaggagatgatcttcctgggtatgaatccacctcctctctttaatgaagtcagtgctacagtaatccaggctgaaaaggtggaccgcctgcggaatgaggtgcagataaagcatgaagaggactacagggaagccctggttaccatcaagaatgacctaaagttgatagaaggcgtggatatcaaggagaaccttcaagaccagatccggcattggttcatcgaatgcagaaatttaaccgggacatttcctgactaccctgacgttgaagaaggagggtcagctattattttttctgacaagaccatacaacaggttattgaggatatcatagcaaaccaagaggaagaagaaaaaaacaaaaagaagaagaagaaaaaggaaaaacaacccaagaaagccaaaaaacaaaagaaaggaacaaaggagaaaaataaggaagaagacgaaaaatggaaaatgtcaccaagtctttttcttcctgcaatgaaggaaggatgtaacgcatacaaagaaatctggatgaaaaaagatgagtcttggaatttctctcaggactatgatccagaactgatcaaagaggagaaacgaaaagaattacagtcagagatcaggatacaggttgatgagttgatgagacaggaacttaaaaacttaaagctagctgtggacagagaaagggagcgcccagtgaaagcaggaaagaaaaaggacaagaagaaaggaaagaaaggcaaaaagaaagagaagaaggcaaagaaggataaagatctgacagctgacaggaccatcgagtctctgtataaggaactggtggaagaaggattactgatccaggctctgaaagtcaacctctctgattacattggtgagtacagctacctggggactactcttcgccaggtgtccatagaacccatgccctccctcctggatgtcagacagctcatcacattgtacggaatctggccattaggttctgcagcagtgcatgagaaagctcctttggtgaaatcgctactgttagccgggccgtctggggtagggaagaaaatgctggtccatgccatctgcaccgaaacgggagccaacctcttcaacttgtcctcctctaacattgctgggaaataccctggcaaaaatggcctccaaatgatgctgcatgcagtcttcaaggtggctcgacagctccagccctccgtggtgtggattgaagacacagaaaaaaccttctacaaaaaagttcccaacgcagaaaagatgttcactccctctgctggcgaagttgctgcattgcagaaaaacttgaaaaggtccacaagtagg

SEQ ID NO: 4332 - DNA, 2627 bp, Homo sapiens
agcaaacccggcctcaccttttcctgcccgaagcagaagattctcgcagtcctggtttctccctccagaagaccccccacccaaatcctctgtagctcctggtagtgccctgacccctgctgccaccgtccttcagagagcaacggaagagcttcccggagggcgaggaaaagagggaaagtagccagcaatgtcgaacgcaatgtataataagatgtggcatcagacccaagaagccctcggtgctttactcgataaagagcctcagaagatgattgaaccacaaagaaatcaggttttcatctttcaaacattagccaccttctacgtaaagtatgtgcagatctttagaaacctagagaatgtctacgaccagttcgtccacccccagaaacgaatactgatcaggaaagtcctggacggggtgatgggccgcatcctggagctgaagaacgagatggtggagctggaactcacggagttccattatttcgatgatatcctgcaggatctcaagctggccccccaacaattagatattcccatacccaagtattttttgaaggagaagttggaagtaataaaaggaagagagaaaattcttgctcaaatattagcggacagcggaatagatacatctgacatgaaataccctgtaaagagtatccctttcgatgaggctgttaaattaatccagattgctgagagggcacggcaaggtcgcctaagggctttattcatgaagcaaatctatctgcaagaatatagagcaaagcaatccaagatgcttggcaagaaagtgacagatacctgggctgctgcactccgcattcagaaggtttggcgacgtttccatcaacgtaaggaaactgaaaaactgagagaagaggagatgatcttcctgggtatgaatccacctcctctctttaatgaagtcagtgctacagtaatccaggctgaaaaggtggaccgcctgcggaatgaggtgcagataaagcatgaagaggactacagggaagccctggttaccatcaagaatgacctaaagttgatagaaggcgtggatatcaaggagaaccttcaagaccagatccggcattggttcatcgaatgcagaaatttaaccgggacatttcctgactaccctgacgttgaagaaggagggtcagctattattttttctgacaagaccatacaacaggaagaagacgaaaaatggaaaatgtcaccaagtctttttcttcctgcaatgaaggaaggatgtaacgcatacaaagaaatctggatgaaaaaagatgagtcttggaatttctctcaggactatgatccagaactgatcaaagaggagaaacgaaaagaattacagtcagagatcaggatacaggttgatgagttgatgagacaggaacttaaaaacttaaagctagctgtggacagagaaagggagcgcccagtgaaagcaggaaagaaaaaggacaagaaaggaaagaaaggcaaaaagaaagagaagaaggcaaagaaggataaagatctgacagctgacaggaccatcgagtctctgtataaggaactggtggaagaaggattactgatccaggctctgaaagtcaacctctctgattacattggtgagtacagctacctggggactactcttcgccaggtgtccatagaacccatgccctccctcctggatgtcagacagctcatcacattgtacggaatctggccattaggttctgcagcagtgcatgagaaagctcctttggtgaaatcgctactgttagccgggccgtctggggtagggaagaaaatgctggtccatgccatctgcaccgaaacgggagccaacctcttcaacttgtcctcctctaacattgctgggaaataccctggcaaaaatggcctccaaatgatgctgcatgcagtcttcaaggtggctcgacagctccagccctccgtggtgtggattgaagacacagaaaaaaccttctacaaaaaagttcccaacgcagaaaagatgaatgaacctaaacgcctgaaaaaacaccttccccaaatcctgaaactcctgaaaccagatgaccggattctgattgtggggaccacacggcgtcccttcgatgctgaactccaatctttctgcaaagtttaccagaaaattattttggtgcccagaccagactatgcttccagatacgttctgtggaagcaaatcattgaacgcaatggaggagtcctcaccagtgccttgaatgtcagctgcctggcgaaggtcactgacggcttcacccaaggacatatagtcgaagtggttaaaggcgtgctcacagatcagagaatccggcggcaaattcataaacctctcactgcagttgagtttattacggcgataaccagcatgaatccagtgtacaaagaggaagaagagagctttaagaactggtatgccaaaactcctctgggtaaaaaacgtgccttggcgataacaggaggcagcacagaaaaggcaaaggacaaagggaaaaggaaataaaagaaagagaaaaaggcaaaaaagaaaaagtaatgcctttctgaagaaccatgcttgagtctctctgggatggagaggaccccaactcgcc

SEQ ID NO: 4333 - DNA, 3028 bp, Homo sapiens
atgacgccgtctctcagcgctgaggaaaacagaatgtataataagatgtggcatcagacccaagaagccctcggtgctttactcgataaagagcctcagaagatgattgaaccacaaagaaatcaggttttcatctttcaaacattagccaccttctacgtaaagtatgtgcagatctttagaaacctagagaatgtctacgaccagttcgtccacccccagaaacgaatactgatcaggaaagtcctggacggggtgatgggccgcatcctggagctgaagaacgagatggtggagctggaactcacggagttccattatttcgatgatatcctgcaggatctcaagctggccccccaacaattagatattcccatacccaagtattttttgaaggagaagttggaagtaataaaaggaagagagaaaattcttgctcaaatattagcggacagcggaatagatacatctgacatgaaataccctgtaaagagtatccctttcgatgaggctgttaaattaatccagattgctgagagggcacggcaaggtcgcctaagggctttattcatgaagcaaatctatctgcaagaatatagagcaaagcaatccaagatgcttggcaagaaagtgacagatacctgggctgctgcactccgcattcagaaggtttggcgacgtttccatcaacgtaaggaaactgaaaaactgagagaagaggagatgatcttcctgggtatgaatccacctcctctctttaatgaagtcagtgctacagtaatccaggctgaaaaggtggaccgcctgcggaatgaggtgcagataaagcatgaagaggactacagggaagccctggttaccatcaagaatgacctaaagttgatagaaggcgtggatatcaaggagaaccttcaagaccagatccggcattggttcatcgaatgcagaaatttaaccgggacatttcctgactaccctgacgttgaagaaggagggtcagctattattttttctgacaagaccatacaacaggttattgaggatatcatagcaaaccaagaggaagaagaaaaaaacaaaaagaagaagaagaaaaaggaaaaacaacccaagaaagccaaaaaacaaaagaaaggaacaaaggagaaaaataaggaagaagacgaaaaatggaaaatgtcaccaagtctttttcttcctgcaatgaaggaaggatgtaacgcatacaaagaaatctggatgaaaaaagatgagtcttggaatttctctcaggactatgatccagaactgatcaaagaggagaaacgaaaagaattacagtcagagatcaggatacaggttgatgagttgatgagacaggaacttaaaaacttaaagctagctgtggacagagaaagggagcgcccagtgaaagcaggaaagaaaaaggacaagaagaaaggaaagaaaggcaaaaagaaagagaagaaggcaaagaaggataaagatctgacagctgacaggaccatcgagtctctgtataaggaactggtggaagaaggattactgatccaggctctgaaagtcaacctctctgattacattggtgagtacagctacctggggactactcttcgccaggtgtccatagaacccatgccctccctcctggatgtcagacagctcatcacattgtacggaatctggccattaggttctgcagcagtgcatgagaaagctcctttggtgaaatcgctactgttagccgggccgtctggggtagggaagaaaatgctggtccatgccatctgcaccgaaacgggagccaacctcttcaacttgtcctcctctaacattgctgggaaataccctggcaaaaatggcctccaaatgatgctgcatgcagtcttcaaggtggctcgacagctccagccctccgtggtgtggattgaagacacagaaaaaaccttctacaaaaaagttcccaacgcagaaaagatgaatgaacctaaacgcctgaaaaaacaccttccccaaatcctgaaactcctgaaaccagatgaccggattctgattgtggggaccacacggcgtcccttcgatgctgaactccaatctttctgcaaagtttaccagaaaattattttggtgcccagaccagactatgcttccagatacgttctgtggaagcaaatcattgaacgcaatggaggagtcctcaccagtgccttgaatgtcagctgcctggcgaaggtcactgacggcttcacccaaggacatatagtcgaagtggttaaaggcgtgctcacagatcagagaatccggcggcaaattcataaacctctcactgcagttgagtttattacggcgataaccagcatgaatccagtgtacaaagaggaagaagagagctttaagaactggtatgccaaaactcctctgggtaaaaaacgtgccttggcgataacaggaggcagcacagaaaaggcaaaggacaaagggaaaaggaaataaaagaaagagaaaaaggcaaaaaagaaaaagtaatgcctttctgaagaaccatgcttgagtctctctgggatggagaggaccccaactcgccaaagaaaagattcaccattgcccgcctgaagaagccctcaggggaaggaacttagcagtgtgcaggtgagctgatgccgcaaacccgctaaccactgcatgtgctgttatgcctttcccaggctggacacctagctgggtgttcatcataactttccacagctttaatccacgccaagtttgtatataactgaaattcactcttgacaccctccacagtctttccaagttggactcttcctctcatcagtactagttgtcaaatttaaaatgtgacagttaaagaatattctagtttgacaattagtaagcaatgagtatatcatcagtacactagctttttattaatccatgtacactgtatagtatcttgcatctattttaataaattaattctttgctctagtaatagattttatataatgaaataaaggtgttgtccttg

SEQ ID NO: 4334 - DNA, 3457 bp, Homo sapiens
aatgttctgaccggtttggtgtttgtcatttcactttattaagtaaagaggaaatcgggaaaggaggaatagagagggtccccgagttcattcaagagcagaccgagagatgctccgatcccgagtcgggccggtggcggggtcaggccggcgcccgaggggggcgaacgcggacgccaggtcgcgcggtttaaatctcccgcctcccgcagcgggagcctgacacctccacgcactggtgcggaggggcactggctgccggagggccgggagtcggcgcggggctcgcgggcggtggccggaacgggtgccgggacggatcaccgtacggccgaacgcgacccgaggaggcggaagagcggcgccgtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaagattggccctgtgtactcctctgtctcgtctgaagcaagaagtagcaacattcagtcaaagggcagtatctgataccttgatgacaattaatcggatggagcaggcacgcacagaatacagaggagctctactgtggatgaaagatgtatcccaagagctggacccagacaccttaaagcaaatggaaaagtttagaaaagtacagatgcaagtgagaaatagcaaagcttcttttgacaagttaaagatggatgtttgtcagaaagtggatttacttggagctagtcgctgcaatatgctatctcattcgctcactacctaccagagaacactgcttggattctggaagaaaacagctcgaatgatgtcccaaattcatgaagcctgtattggctttcatccgtatgattttgtagctctcaagcaactacaagacacgccaagcaagattagtgaagacaataaagatgaacaaataggcggttttcttactgaacagctcaataagctagttttgtctgatgaggaagcaagctttgagagtgaacaagcaaacaaagatcacaatgaaaaacattctcaaatgagagaatttggagcacctcagttttctaactctgaaaatgttgcaaaagatctacctgtagattcattggaaggagaagattttgagaaggaattctcatttctgaacaacctcctaagttctggttcttcaagtactagtgaatttacccaagaatgccagactgcctttgggagccccagtgccagtctcacatcccaggagccttccatggggtctgagcccctcgctcattcttctcgattccttccttcacaactctttgaccttggctttcatgtggctggagcgttcaacaactgggtctcccaagaggaatcagaactttgtctttcacacactgataaccagccagtgccttcacagagtccaaagaaattaacaagatcccccaacaatggcaaccaagacatgtcagcctggttcaatctgtttgcagacttggatccactttcaaacccagatgctattggacactcagatgatgaacttcttaatgcttgactgaagttataatgtcacttcagtggccttgagacatcaattttgcaacgtatttccttcgtggaaaggatttagattgtaacccgcacacaaaagcacggtgtttgtgaatataacacctgtcagccaactttagacagatggtaaagaccacatttgaataagtacacatctttcatatcttggatttgcagctgttggtactatgtggaaaatattagaaacttctatgtggaaaatattagaaactacagagtttgcgatatttagatactgaaatttatgtcaaaataacggctaggaataattctgtcaatatggagttgagcttatttctttggaaacccttttaagttgccttgctggctgtgagaattttatatgtggataacaaagatagatagatagcatgtaaattgggttgtggtttggggtcagtttttaaatgaaatagtagcgaggaggattttctgttttggaaaacaccattagaaccagaccagctttgttttgggttagagagagtaagatttgagaactcagtttgctttaatgaaatcacagagaaacttggtacttgtttttcttcatttggaggctaaaatgtaatgttttttcattcatacaaaataatggacactccctaattccattattaaatcttgaaggggaagtagcaggataattaatttgctaagcccatcctctgcagaaacagaaaaatctatcttcccatctcctaaaactcagaatgcacagtaatacttaaggcttgtacaagtgtcttcagacccactttttcatacacttgctatatagtagtatgcagtatttatattattcctgaaaataaaatgaggggagaatattccctaagcaactggcaatagtattcctgaaatacctagaaatttctatctgaatgagggagacacttatgaacaccttatccttacatatatttgcatacttatctcatattttgtgacataattatttaacccagaatactttctggcagacatacagaaagctctgtgtgatcaataagggagtgtctcatttttctacttccctctttctgtgggtgacatgatctgaggttctatttgattactaagcaaaatctgttacccctacagggtttagaacctaagtattagagaggaaggctatttaatggaagttagtgtaagctgataaaaacgtagctaccgtacacacacatcaatcactcaatttcctgtccttttaaattgcccaccctttaattttgaagcaatttcccaagtgtgtgtttgttttatatttgtcatccagtccattgcatttccataagaagacattttgactggctgggtgcggtggctcacgcttgtaatcccagcactttgggaggctgaggcaggcggatcacgaggtcaggagatggagaccatcctggctaacatggtgaaaccccgtctctactaaaaatacaaaaaattagccaggcgtggtggcacgtgcctgtagtcccagctactccggaggctgaggcaggagaatggcgtgaacccgggaggcggagcttgcagtgagctgagatggcgccactgcactccagcctaggcaacagagcaagactccgtctc

SEQ ID NO: 4335 - DNA, 5173 bp, Homo sapiens
cgaggaggcggaagagcggcgccggcgacgtactgtaagacgatattactttaatcatcttcacatcagtatttatggaatagccacaggtgcctcatcctttagtaggagttaattatacatttactggccgagtaaacatctccgaatgtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaagattggccctgtgtactcctctgtctcgtctgaagcaagaagtagcaacattcagtcaaagggcagtatctgataccttgatgacaattaatcggatggagcaggcacgcacagaatacagaggagctctactgtggatgaaagatgtatcccaagagctggacccagacaccttaaagcaaatggaaaagtttagaaaagtacagatgcaagtgagaaatagcaaagcttcttttgacaagttaaagatggatgtttgtcagaaagtggatttacttggagctagtcgctgcaatatgctatctcattcgctcactacctaccagagaacactgcttggattctggaagaaaacagctcgaatgatgtcccaaattcatgaagcctgtattggctttcatccgtatgattttgtagctctcaagcaactacaagacacgccaagcaagattagtgaagacaataaagatgaacaaataggcggttttcttactgaacagctcaataagctagttttgtctgatgaggaagcaagctttgagagtgaacaagcaaacaaagatcacaatgaaaaacattctcaaatgagagaatttggagcacctcagttttctaactctgaaaatgttgcaaaagatctacctgtagattcattggaaggagaagattttgagaaggaattctcatttctgaacaacctcctaagttctggttcttcaagtactagtgaatttacccaagaatgccagactgcctttgggagccccagtgccagtctcacatcccaggagccttccatggggtctgagcccctcgctcattcttctcgattccttccttcacaactctttgaccttggctttcatgtggctggagcgttcaacaactgggtctcccaagaggaatcagaactttgtctttcacacactgataaccagccagtgccttcacagagtccaaagaaattaacaagatcccccaacaatggcaaccaagacatgtcagcctggttcaatctgtttgcagacttggatccactttcaaacccagatgctattggacactcagatgatgaacttcttaatgcttgactgaagttataatgtcacttcagtggccttgagacatcaattttgcaacgtatttccttcgtggaaaggatttagattgtaacccgcacacaaaagcacggtgtttgtgaatataacacctgtcagccaactttagacagatggtaaagaccacatttgaataagtacacatctttcatatcttggatttgcagctgttggtactatgtggaaaatattagaaacttctatgtggaaaatattagaaactacagagtttgcgatatttagatactgaaatttatgtcaaaataacggctaggaataattctgtcaatatggagttgagcttatttctttggaaacccttttaagttgccttgctggctgtgagaattttatatgtggataacaaagatagatagatagcatgtaaattgggttgtggtttggggtcagtttttaaatgaaatagtagcgaggaggattttctgttttggaaaacaccattagaaccagaccagctttgttttgggttagagagagtaagatttgagaactcagtttgctttaatgaaatcacagagaaacttggtacttgtttttcttcatttggaggctaaaatgtaatgttttttcattcatacaaaataatggacactccctaattccattattaaatcttgaaggggaagtagcaggataattaatttgctaagcccatcctctgcagaaacagaaaaatctatcttcccatctcctaaaactcagaatgcacagtaatacttaaggcttgtacaagtgtcttcagacccactttttcatacacttgctatatagtagtatgcagtatttatattattcctgaaaataaaatgaggggagaatattccctaagcaactggcaatagtattcctgaaatacctagaaatttctatctgaatgagggagacacttatgaacaccttatccttacatatatttgcatacttatctcatattttgtgacataattatttaacccagaatactttctggcagacatacagaaagctctgtgtgatcaataagggagtgtctcatttttctacttccctctttctgtgggtgacatgatctgaggttctatttgattactaagcaaaatctgttacccctacagggtttagaacctaagtattagagaggaaggctatttaatggaagttagtgtaagctgataaaaacgtagctaccgtacacacacatcaatcactcaatttcctgtccttttaaattgcccaccctttaattttgaagcaatttcccaagtgtgtgtttgttttatatttgtcatccagtccattgcatttccataagaagacattttgactggctgggtgcggtggctcacgcttgtaatcccagcactttgggaggctgaggcaggcggatcacgaggtcaggagatggagaccatcctggctaacatggtgaaaccccgtctctactaaaaatacaaaaaattagccaggcgtggtggcacgtgcctgtagtcccagctactccggaggctgaggcaggagaatggcgtgaacccgggaggcggagcttgcagtgagctgagatggcgccactgcactccagcctaggcaacagagcaagactccgtctcaaaaaaaaaaaaaaaaaaaaaagacattttaactaagttattcacagtagcttccatgtgctcttagttctattctaaacaggcttatttagaaaaggattgcttgtaatgtttgtcatggtacatagaaaacattggaccagagtaggtaaaatgcagtccatgtcccatccatagccatctacaatagtaactgcccacaggctctccagaaaactactacaatggccaagtacagtataggctggaaagaccttatctgaaggtcagaaacattgactcagaaaaaaggtatgaagtctttccataaaatcttttcacaatattactcctatttcttttagattttaatgagccattacttatctcttcagaagacttaagtcttcctttatactcagtgaaatttcccagaatgtaatactgtcactgttctgccaagttccaatcaccaagatcatgattacgaatcccaatctgaattctatacccatggtgactctgatgctctcaacttttgagtgcctcaaaaaatgctaaaactttggctgggcatggtggctcacgcctgtaatcccagcactttgggaggccatggcgggtggaacatttgagggcatgagttcgagaccagcctggccaacatggtgaaaccctgtctctactaaaaatacaaaaattagccaggtgtggaggtacatgcctgtaatcccagctactcaggaggctgaggcagaagaattgcttgaacccaggcggcagaggttgcagtgagtcgagattgcaccactacactccagcctgggcaacagagagcgactctctcaaaaaaaaaaaaaaaaaaaaaaaaaaaagctaactttatgtcttgagagtttgtaccatttttctttgtagtggtcaccttgctaatgcattagttctgagatatttatctccctcacatgtgtgcaaggaagtccctgttatcgaatacagatactttaacaagcagacaaagcagaaacccaaagtccatactaggaacaccctaaattttccaaaagcaaaagttctcccgaaatggagacatacaagggacttttattattctgttactagtttctataacatttcttctttcaacagagtatatgtttcccatttaacccagagcaacattaacttccttagcaagtccagttctaacttccaacaagtccaaccactgtttttgaagagcatatcagtaactatattaagatgaaggtaaccacattcgtattttctcaagattagttatttgaagctcagcagtttttgtggtcagaaagaaattttgctctattaaaccaatactgctaatataaaaaaccaccacactgaagaaacgagggaaaggacgggataagcacagaacagagaatgactggttgctttttgtctcaatctagataatccattcaataagaagtaaattaattatccttaaccaatggtaggctgagaacaaccctcaaaatagatattttttatgttaaatggggagaaatatctatactttatgttatactggataaaaatgtgttttaagtctaaaaaaaaccagacgagctaaactttgcctagtgtgtctacaaccattttttaggagacgcaggaataccagggcataataagatcagattggtgtaattttgtatgtttttgaaatccttcattaattgtagaaccttgatatgattagaaacaaactgtatttcaacaaacaggtttcagtatttgcacactgaaaaagtgttttgtattttaactataaatatttcacgtatctgtatagaccatctagaaatgtagaggtcttacagcattagaacgaaggaagtttacatgtgctctatctatttttctgagcctcttttaataaagattgcaagaaggcataaaacaaga

SEQ ID NO: 4336 - DNA, 556 bp, Homo sapiens
agaatgcacgggcccgcgaggggctccgcgcacagatcctgctccttaggccggcaacccgaccccacggcacagatatggctcctggaaacgcgcgtcagctggtcaggtgcccaggcgacgtactgtaagacgatattactttaatcatcttcacatcagtatttatggaatagccacaggtgcctcatcctttagtaggagttaattatacatttactggccgagtaaacatctccgaatgtatttttttagataaggaaataaaacatttccaataaagctgaagtctcatcccacccatccgttatcagtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatg

SEQ ID NO: 4337 - DNA, 595 bp, Homo sapiens
aacgcgacccgaggaggcggaagagcggcgccggcgacgtactgtaagacgatattactttaatcatcttcacatcagtatttatggaatagccacaggtgcctcatcctttagtaggagttaattatacatttactggccgagtaaacatctccgaatgtatttttttagataaggaaataaaacatttccaataaagctgaagtctcatcccacccatccgttatcagtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaa

SEQ ID NO: 4338 - DNA, 562 bp, Homo sapiens
gacccgaggaggcggaagagcggcgccgggaagcctctggtgattcagttacctctgactggcttgttgaatttaattttagtgctcggttatgaagattatttggctctcacaattttttgagatggggtctcactgtgtccctctggctgtagtgcagtggcacattcatagctcactacagcctcaaactcctgggctcaagtgatcctcccacttcagcatcccaggtagctgggactacaggcatatgccacaattcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatg

SEQ ID NO: 4339 - DNA, 566 bp, Homo sapiens
actggctgccggagggccgggagtcggcgcggggctcgcgggcggtggccggaacgggtgccgggacggatcaccgtacggccgaacgcgacccgaggaggcggaagagcggcgccgtatttttttagataaggaaataaaacatttccaataaagctgaagtctcatcccacccatccgttatcagtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaagattggccctgtgt

SEQ ID NO: 4340 - DNA, 799 bp, Homo sapiens
cttgctggcctcctcggttctctgggggaccccggccgctgcctgcggccttcttccaggcgaggccctgctcggggttcttccggcctccccccaggcaaaacccgcaaggagcggtttctggcgtggctgggtcccctgcggcggaagggcgcctcccggccacgctcgctgtagtgaaggagcgcggcagcctggggctcgtttgggtgatttccctcggcggtggaggtcgctcctaatagaggcggcggcggatcacccgaacagccttcaggtgcttccctgctgacctctttttaacgtggtgcttatttttatttcgctattattttgtaatgggaatgtcttccttagaaactaattggcaaccgatggataaaaacaaaacatagtaaatgtgcagtttgagctgaactgcagaatgcacgggcccgcgaggggctccgcgcacagatcctgctccttaggccggcaacccgaccccacggcacagatatggctcctggaaacgcgcgtcagctggtcaggtgcccaggcgacgtactgtaagacgatattactttaatcatcttcacatcagtatttatggaatagccacaggtgcctcatcctttagtaggagttaattatacatttactggccgagtaaacatctccgaatgtcactccatggattcctttgggcaacccagaccagaagataatcagtcagtagtcagaagaatgcaaaagaaatactggaaaactaaacaggtctttatcaaagcaacaggaaaaaaagaggatgagcacttgg

SEQ ID NO: 4341 - DNA, 689 bp, Homo sapiens
agatacctgatgctctaaggaagacggagaggggaaagcggggagtccatcctggcagctcacccgcgatgctggggcgttgccagtagagggggtggaatcatttttcgtgtaatagatgatcttgatgcacacagcataaaagctgttataaactatgggtctctgtaaaatagattgttgggaaggtaacatttttccatggttttgatttttcccaaaagtatttatgtattgatttatttggttctgactcaggcgacgtactgtaagacgatattactttaatcatcttcacatcagtatttatggaatagccacaggtgcctcatcctttagtaggagttaattatacatttactggccgagtaaacatctccgaatgtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgca

SEQ ID NO: 4342 - DNA, 515 bp, Homo sapiens
tcgtttgggtgatttccctcggcggtggaggtcgctcctaatagaggcggcggcggatcacccgaacagccttcaggtgcttccctgctgacctctttttaacgtgtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaagattggccctgtgtactcctctgtctcgtctgaagcaagaagta

SEQ ID NO: 4343 - DNA, 526 bp, Homo sapiens
tagataaggaaataaaacatttccaataaagctgaagtctcatcccacccatccgttatcaggctggagtgcagtggcatgatcgtagtttactgtaaccttgaactcctgggctcaagcaatcttcccccatcagcctcctgagtagctaggactacagtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaag

SEQ ID NO: 4344 - DNA, 576 bp, Homo sapiens
agaatgcacgggcccgcgaggggctccgcgcacagatcctgctccttaggccggcaacccgaccccacggcacagatatggctcctggaaacgcgcgtcagctggtcaggtgcccagtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaagattggccctgtgtactcctctgtctcgtctgaagcaagaagtagcaacattcagtcaaagggcagtatctgataccttgatgacaattaatcg

SEQ ID NO: 4345 - DNA, 714 bp, Homo sapiens
cggggagtccatcctggcagctcacccgcgatgctggggcgttgccagtagagggggtggaatcatttttcgtgtaatagatgatcttgatgcacacagcataaaagctgttataaactatgggtctctgtaaaatagattgttgggaaggtaacatttttccatggttttgatttttcccaaaagtatttatgtattgatttatttggttctgactcaggcgacgtactgtaagacgatattactttaatcatcttcacatcagtatttatggaatagccacaggtgcctcatcctttagtaggagttaattatacatttactggccgagtaaacatctccgaatgtatttttttagataaggaaataaaacatttccaataaagctgaagtctcatcccacccatccgttatcagtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacg

SEQ ID NO: 4346 - DNA, 559 bp, Homo sapiens
gggaccccggccgctgcctgcggccttcttccaggcgaggccctgctcggggttcttccggcctccccccaggcaaaacccgcaaggagcggtttctggcgtggctgggtcccctgcggcggaagggcgcctcccggccacgctcgctgtagtgaaggagcgcggcagcctggggctcgtttgggtgatttccctcggcggtggaggtcgctcctaatagaggcggcggcggatcacccgaacagccttcagtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaact

SEQ ID NO: 4347 - DNA, 863 bp, Homo sapiens
catctacagctccgtgatttcaaggcatccttcccacccgttcgtttttagctcggctgccgaacttcattgcacagttgagttttccttccagcagggtggatggggagcatcgctggctgacaggctggtcagaaaatgtgatgttctgaatcgtggattttcaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtgaatatgccaatgcgtgtttacaagtggcccaagactgtgggactgacgtacttgacctgtggaccctgatgcaggacagccaggacttctcatcttatttatcagatggactacatttgtctccaaaggggaatgaatttttgttctcgcatctctggcctttgatagagaaaaaggtctcttctctacctttgctgcttccttactggcgggatgtagcagaagcaaaacctgaattaagtctgctgggagatggagaccattagccaatcacaggagacccaaatctgcttgttatctacagaactcaaagttgtcaatacgtagaggtacgcttttttcctcaggcttaaacctttgccactgatattaataataaaa

SEQ ID NO: 4348 - DNA, 1266 bp, Homo sapiens
tggctggcggccccgccccgccccgcccggctgctccatggcgctgtgcgaggccgcgggctgcgggagtgccctgctctggcctcgcttgttgctcttcggggactccatcacccagttttccttccagcagggtggatggggagcatcgctggctgacaggctggtcagaaaatgtgatgttctgaatcgtggattttcaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtgaatatgccaatgcgtgtttacaagtggcccaagactgtgggactgacgtacttgacctgtggaccctgatgcaggacagccaggacttctcatcttatttatcagatggactacatttgtctccaaaggggaatgaatttttgttctcgcatctctggcctttgatagagaaaaaggtctcttctctacctttgctgcttccttactggcgggatgtagcagaagcaaaacctgaattaagtctgctgggagatggagaccattagccaatcacaggagacccaaatctgcttgttatctacagaactcaaagttgtcaatacgtagaggtacgcttttttcctcaggcttaaacctttgccactgatattaataataaaagtattagatgatttttcagggaagttttatacttaggtccattgtgtttcgacagtatttattaatgcagatatcagtgctacagctataaaatataccctgagcagcttgttaattctataaatgacaaagactatgtttttaaaaagtcacaattttataaaaatggtttttcttacattcttttgagaactgtttcactcatacatacacccacacaccccactcaaccttgtatcaaattccaaaagtgtaactaaagtataagaatatcatgactagttaaaagatagcaaataccataaggtacaagttcaagtattagtataacaagtatctgagtaacaaatgtccttggaaatggggg

SEQ ID NO: 4349 - DNA, 1137 bp, Homo sapiens
gtgcgaggccgcgggctgcgggagtgccctgctctggcctcgcttgttgctcttcggggactccatcacccagaaaatgtgatgttctgaatcgtggattttcaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtgaatatgccaatgcgtgtttacaagtggcccaagactgtgggactgacgtacttgacctgtggaccctgatgcaggacagccaggacttctcatcttatttatcagatggactacatttgtctccaaaggggaatgaatttttgttctcgcatctctggcctttgatagagaaaaaggtctcttctctacctttgctgcttccttactggcgggatgtagcagaagcaaaacctgaattaagtctgctgggagatggagaccattagccaatcacaggagacccaaatctgcttgttatctacagaactcaaagttgtcaatacgtagagcatcgacatagggcacacagcggccagaaaggtccctgcagcacaccttgcaggagttgtcagtttctggaacagagaacacgcattgacagctggattgttctgagacctgcctctcctcctgcctcctctttcctccctgaccatgctcccaaagagagacagcgttttgccatgttgaccaagctgctctcaaactcctgacctcaagtgatctgcccacctcggcctcccaaagtgatgggattacaggtgtgagtcaccacacctggctctctgtctattttgaaagcaagagaactccctcatcgactcccatggtttaagtggggtgggaagcagagtccagccagtccctgaccagtccatgaggatgccctcaaaccca

SEQ ID NO: 4350 - DNA, 1859 bp, Homo sapiens
atggaggccgggccgccgggcagcgccaggccggcggagccgggtccttgcctgagtggtcagcgcggcgcggaccacacggcttccgcctccctgcagagcgtggccgggaccgagcccgggcgccacccgcaagccgtggcagctgtgttgcctgccggggggtgcggggagaggatgggggtccccaccccgaagcaattctgccccatcctggagaggccgctcatcagctacaccctacaggccctggagagagtatgttggataaaggacattgttgtggcagtaactggagagaacatggaagtaatgaaaagtattattcagaagtatcagcataaacgcatctcactggtcgaagctggagtgacccgccacaggtcaattttcaatggactaaaagcactggcagaagatcagatcaactctaaactctctaagccagaagtagtgattatccatgatgctgtgagaccatttgttgaggaaggtgtccttcttaaagttgtcacagctgctaaggaacacggggcagcaggagccattcgacctcttgtatctactgtcgtcagtccatctgctgatggttgcttagactactcgctagaacgtgccagacacagagcaagtgaaatgccccaagcttttctatttgatgtgatttatgaagcatatcagcagtgtagtgactatgacttggaatttggaactgagtgtttgcaattggccctaaaatactgttgcactaaagccaaacttgtagaaggatcacctgacctctggaaggtgacctacaaacgagatctctatgcggctgaatcgattattaaggagagaatttcccaagagatttgtgtagttatggatacagaagaagataacaaacatgtaggtcatcttcttgaagaagtgctgaaaagtgaattaaatcatgtaaaagtcacatctgaggctctgggtcatgctggcagacatcttcagcaaatcatcttagatcaatgctacaattttgtttgtgtgaatgttacaacctctgattttcaagaaacccagaagttactgagcatgcttgaagagagtagtctttgcattttatatcctgttgttgttgtttcagttcattttcttgattttaaattagtacctcccagtcagaaaatggaaaacctaatgcagattagagaatttgcaaaggaagtaaaagaaagaaatattttgttatatgggcttctcatatcttacccacaggatgatcagaagctacaggagagtttaaggcaaggtgctatcattattgcttcattaatcaaggaaagaaattctggactcattggtcagcttctgatagcatgaagaacacaaaaaattacctattttctaaaacatctatttgcgtatcttaattgtgctttgtgcccccgctgctgtgtgtggtagaatgtttcagttgtcttttatatcttctctataatttgtaggatgtgatgcttagattataaagcagattaatgtttatatctgtgaaataaagaatacttttgtgtatgacaaatattaattgcctgaaccagaaaaaaatagtagataagtggaaaataatagccttcaaatgaatctttccacagagacatgaacggtcaaatagaaataatgatggggtgagctattctttcaaggaatgagaatttagaaaacttcagttattatcctaactgttaattaataatttacactattatgaagctaatggataaacttcagaattattctcacttctataattgtcctgtcaccaggtgatattttgtctttttgtcttgtgttaaaaatgtctacactttaataaaaaagggtga

SEQ ID NO: 4351 - DNA, 4868 bp, Homo sapiens
ggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctgggctgcagatctgggacacggccggccaggagcggttccgcaccatcacccagagctactaccgcagtgccaatggggccatccttgcctacgacatcaccaagaggagctccttcctgtcggtgcctcactggattgaggatgtgaggaagtatgcgggctccaacattgtgcagctgctgatcgggaacaagtcagacctcagcgagcttcgggaggtctccttggctgaggcacagagcctggctgagcactatgacatcctgtgtgccattgagacgtctgccaaggactcgagcaacgtggaggaggccttcctgagggtggccacggagctcatcatgcggcacgggggccccttgttcagcgagaagagccccgaccacatccagctgaacagcaaggacatcggagaaggctggggctgcgggtgctgaccaggggccgggccggcagactgggggttccccacctccttgctctccccagcctgccaagcccagccctccagagccagccctcctgggtaccggcaactacagcagccgggtgaagctctggagctctgcatcctgtggcctggctgcgggatggaggctctccttgaggaaggggaagcaggataccctggcgggccaccctgccagccagcagctggccctccaccatcttcacattccaagactggcctgaacccgccggtgtgggccacagtaggaggggccagcagtcctccctgtcccatgcctgctggctctgaccgtttcctctcatgggtttgctttacctgtggcagcaggttgctgctttccagggatgtgtccagtgccctgggttcttcccggtcatcctggggctctgcacagagcagcagagctagagccatgagacccacagacttggtgcctgagcgcagctccagggaagccccagccccttccaggcggggaacctgcttcctgccttcactgcccccgcagcactcacagacatctccctggggtctggctcactgccttatcaggacctctgagttttctgactttctgtgtagcttctcattttcatcagcacagcatggggtcacggcccacagctaggtggggtcacggcccacagctaggtggggactgtctgctggctcagggcccagtgttttgccactcaggttgcaaaattagctaatccttcagtgccagcactcagaagtctggcaggtgggggaatgagatgagaaagtggacatttaaggtccaagtagaagcttgcatccttgaggctcagggatgagagggcaccgcaaggcacccagccttaccccacaagcaggaatcctgccagccgagcgtgggtcccagtctatggaatcgagtctcccagacaaaaaaggagaggccctggcggtccttggcctggcccattttattccctggacccttaactgcctcaccctgagctgggcaccaaggttagaaggcaaaagtggggtagggggatgtgggaagcagcattgtcctctgggcatgtggctcagaggtatcacagtgacaaaagagccagggctagggctggaggggccaggtgatcttccttagccaatcccagtccgtctgtgtcagcccagctctgcctcgcagccccctcagcatgggtgcccccagaagtaagcagctcttggacccacgagcagggctgcgtcggtttgtggtctagctcccaggggcaggccaggcatggctcagtgcagtccctgggccagtgagaggcctcccccatgcctccctgccctctgcactaagcactttccaggcaggcctggccatagggcaagagcaggccttacagcagtgccacggtgacccaagaggcagggttggggcctggacagggtttcctctgctgagactgagacaagcagggcttgatgctggtggtggagccagcatctcacctgccaggcttccttttgggcagggaggctacctgtggaatggctgagcctggttctgcaggggaggaaggctgccaggagctgaggggctagcacctgcattgaggggagtctgggtgcatcagattggggggcgccagaggcgaggctgcctggctccctttctcagcagctttgcttgtggcaggggtgagagtggagctgagtggggtctgggctctgcccctgcgcctccactgcagtgcctgggctccccttgcagggcagacagtgcctggcactgaggggtgcccccagaccccgctgggactggatgtgccgtgggcagtgccttcctccagcctcacaacctttctgctggggctgaagtttctggggtcacatggtcagaaggggctgagctggtctttcactgcaggcccactctgaaagagaaatcccatgaagcctgtccttgcagagcccctctgtttttgggggaacagggagcattcacagggtcttgggaacaaaggcctgggcctccccgtttgaatttcagccccagttccagggcaagtcccagccacccaagcatacttaccagtactgcccaccaccacccactgcccacctctaagaagcccggctctcctactctgcttccaggctggggcctcacaggtggggctgttaccttcctcagggcttagggagggagggaggacatggacagggccttccaccctggctccttcacagggatggtagctgaccggtgatgggttcatttgtcaccttggactgtgagccacttccacttctcgccccccaggcaggagcaccctcactccaagggcttggcctggaaaggcaggctcacctgggactcaacgttccttcccccgccgccactgtgccccccgtccctccaccccagaagccctgacctcatttgggcaccttgctgtcctctgggcttctcctctgcccaggtcaccctgtggcaggcctgggccctcaggatgtttcaaaggctccacagctccaccgctccacctggcttcactccagcaccctgtccctggagcacctctgtcctgtctgggccaacctggtctccctgccccatgccctcccctggctcttagcaacctgcccttttattcatgccatttggggtcacagatgcctagctggacacagctcccagaactggctccaccctggggccttgcccctagtaccccctggcaggagcaacccaccccatggtcgaggttcccctacccctggatcctggactgaagccatttcctacagagaagcgttcccaccccctctcaggcacaaaagccggtgtccagggactcaagacctgtacctggggttgcaggggctcctgccctgctgtatcccaccaggagggggccccactgcccttccggcccttaaaactgggctgggagagaagacggggaagtgtgtgagacaaaacaaagccggcttgtttcctccccttggcaggctaagctctcccggcagcccgggctctggggcggaaggagaacagtgtcatctcttcctttgttgataaattgccaaagagtgggaacaggtggggtcaggggccagagtgcaggggagggggcaatggtggaggtggcggggggaagcagagggaggtgggctgaggcctcggtggggccagtgcgacgctggcttaaggagctggaggggttcctaatacacatttaattcagtttctcttccctaagaggctgccggagttggggcctcctccagcagagaccctcggacccctgcagggcctggacttggggtgaacagggcttcagtcagcgcaagtattccatttgcatttggtaatttttcatgccacctatttatgaatatataaatctttataccaaatctattttttaaaacatggaaaagttgcctttatggaaacttggcagagccagagtgtacacattcctaaaccattaaacagatttctataac

SEQ ID NO: 4352 - DNA, 2686 bp, Homo sapiens
ggactggaggagaaccgagtggccggcacttccggccggcggcggctgctccgggtgagcaggcccctgaagtgctgtgcctggagataccattgtggaccctggagaggcacctgctgcttatgcggtaaaacctctaccaccccaaacctggtcagtttgaggggagccgctgccatagtatccacagagaaggccggagttccagccgtgtggagcagcagaggggagtctgacagggtcacctcctccacagagagaattggcagctgactgcactgccaggagccaaggcctaggtgtgtggagcctggaagaccagggatacctgaggcaggaggtgcagcgtgtggagtgagaaacccgagagggactggggcctgtgctcaggatcagcagagcaggcaggcagagtggagagggagagacggagccccagaaggggagcaggaggagagggaagtagtggcagcagcccaggccaggcgtgtgtcctgcaagtgctaggaccagccacccctccccatggcctccaagccggctgccgggaagagcagaggggagaagcggaagagggtggtgctgacactgaaggagaagattgacatctgcacgcgcctggagaagggcgagagccggaaggcactgatgcaggagtacaatgtgggcatgtccaccctctacgacatcagggcccacaaggcgcagctgctccggttcttcgccagctccgactccaacaaggcgctggagcagcggcgcacgctgcacacgcccaagctggagcacctggaccgcgtcctgtacgagtggttcctggggaagcgctccgagggcgtccccgtgtcaggccccatgctcatcgagaaggccaaggacttctacgagcagatgcagctcactgagccctgcgtgttctccggagggtggctttggcgctttaaggccagacacggcattaaaaagctagatgcatccagtgaaaagcagtcagccgaccaccaggccgcggagcagttctgtgcgtttttcaggagcttggctgctgagcacgggctgtccgccgagcaggtttacaacgctgatgagaccggccttttctggcggtgcctgccaaatcccactccggaaggcggggctgtgcctggccccaagcagggcaaggaccggctgaccgtgctgatgtgtgccaacgccacgggctcccacaggctcaagcccttggccatcgggaagtgcagcggtcccagggctttcaaaggcatccagcacctgcccgtcgcctataaggcccaggggaacgcctgggtggacaaggagattttttccgattggttccatcatatctttgtgccctcggtgagagagcacttcagaaccataggtttgccggaagacagcaaagccgttctcttgctggacagctcccgggctcacccgcaggaggccgagctggtgtccagtaacgttttcaccatcttcctgcctgccagcgtggcctcattggtgcagcccatggagcagggcattcggagagatttcatgaggaacttcattaaccctccggtccccctgcagggcccccacgcccgctacaacatgaacgatgccatattcagcgtggcctgtgcctggaacgcagtccctagccacgtcttcaggcgggcctggaggaagctgtggccgtcggttgcgtttgccgaaggctcctcctctgaggaggagttggaggcagagtgcttcccagtgaagccccacaacaagtcctttgcacacatcctggagcttgtgaaggaaggctcctcctgcccgggccagcttcgccagcgccaggccgccagctggggggtagcgggaagggaggcagaagggggacggccccctgctgccacgtcgccagcagaggttgtgtggagttcagaaaagactccgaaagctgaccaggacggcagaggagatcctggtgagggcgaggaggtggcctgggagcaggcggccgtggcctttgacgcagtcctgcgctttgcggagcggcagccatgcttcagtgcgcaggaagtggggcagctgcgggcgctgcgtgccgtgttccggagccagcagcaggagactgtgggccttgaggatgtggtagtgacctcaccagaggagttggcaattcctaagtgctgcctggaggcctctacagagacataatgttggagaacttctgccacatggcagtgctgggtaagacccctctgtccccaccagtgcccttgaggttatgggtgttggtaggtctgtggcctccatctccatgacgatggtgttaaggactgcatgtttgtgtccccccccaaagtttatatgttgaaaccctgacccccaggagggtggtattaggaggtggggcctttgggaggtgactaggcttaggtgagatcgtgagggtggggctcgccgatgagatcgagtccttataagaaaaggaaggaactagagcgaggtcactttgtgctgtgtgagcatacaagaaaactgccatcttcaagctgggtgcagtggctcacgcctgtaatcccagcactggaaggccaaggcattaggattgcatgagtccaggagttcgagaccagcctaggcatgataagaccttattgctaaaaaaaaaaaaaaaggaaataaaatagaaaattgccatctg

SEQ ID NO: 4353 - DNA, 8010 bp, Homo sapiens
cccctgaagtgctgtgcctggagataccattgtggaccctggagaggcacctgctgcttatgcgagagaattggcagctgactgcactgccaggagccaaggcctaggtgtgtggagcctggaagaccagggatacctgaggcaggaggtgcagcgtgtggagtgagaaacccgagagggactggggcctgtgctcaggatcagcagagcaggcaggcagagtggagagggagagacggagccccagaaggggagcaggaggagagggaagtagtggcagcagcccaggccaggcgtgtgtcctgcaagtgctaggaccagccacccctccccatggcctccaagccggctgccgggaagagcagaggggagaagcggaagagggtggtgctgacactgaaggagaagattgacatctgcacgcgcctggagaagggcgagagccggaaggcactgatgcaggagtacaatgtgggcatgtccaccctctacgacatcagggcccacaaggcgcagctgctccggttcttcgccagctccgactccaacaaggcgctggagcagcggcgcacgctgcacacgcccaagctggagcacctggaccgcgtcctgtacgagtggttcctggggaagcgctccgagggcgtccccgtgtcaggccccatgctcatcgagaaggccaaggacttctacgagcagatgcagctcactgagccctgcgtgttctccggagggtggctttggcgctttaaggccagacacggcattaaaaagctagatgcatccagtgaaaagcagtcagccgaccaccaggccgcggagcagttctgtgcgtttttcaggagcttggctgctgagcacgggctgtccgccgagcaggtttacaacgctgatgagaccggccttttctggcggtgcctgccaaatcccactccggaaggcggggctgtgcctggccccaagcagggcaaggaccggctgaccgtgctgatgtgtgccaacgccacgggctcccacaggctcaagcccttggccatcgggaagtgcagcggtcccagggctttcaaaggcatccagcacctgcccgtcgcctataaggcccaggggaacgcctgggtggacaaggagattttttccgattggttccatcatatctttgtgccctcggtgagagagcacttcagaaccataggtttgccggaagacagcaaagccgttctcttgctggacagctcccgggctcacccgcaggaggccgagctggtgtccagtaacgttttcaccatcttcctgcctgccagcgtggcctcattggtgcagcccatggagcagggcattcggagagatttcatgaggaacttcattaaccctccggtccccctgcagggcccccacgcccgctacaacatgaacgatgccatattcagcgtggcctgtgcctggaacgcagtccctagccacgtcttcaggcgggcctggaggaagctgtggccgtcggttgcgtttgccgaaggctcctcctctgaggaggagttggaggcagagtgcttcccagtgaagccccacaacaagtcctttgcacacatcctggagcttgtgaaggaaggctcctcctgcccgggccagcttcgccagcgccaggccgccagctggggggtagcgggaagggaggcagaagggggacggccccctgctgccacgtcgccagcagaggttgtgtggagttcagaaaagactccgaaagctgaccaggacggcagaggagatcctggtgagggcgaggaggtggcctgggagcaggcggccgtggcctttgacgcagtcctgcgctttgcggagcggcagccatgcttcagtgcgcaggaagtggggcagctgcgggcgctgcgtgccgtgttccggagccagcagcaggtgaggaggcggcgtggtgccctcggggctgtggtcaaggttgaagccctccaggagggccctggtggctgtggggccacagctcagtctcccttgccctgctcatccacagcaggtgacaactgatggcttctctgccctgccctggccactggccctgtttctccccacaccctggagtggcatggtcctgtgccccgaccccacctgaggcaggagggcatgtgcagacactcaagagcccttccaggagtgggtcgcccacgggtgtggctcgggtgcccaggacggtctgtgcccgaggttcctgtcaatacaggttttattttatcacttgccgtgtcatccgaaagtgaggaaatgttttggaagggtccaccctagcctagaacaagccagagccgcaccctggctggaatgggggccaggctgagccgatctggtctcgtgttcgctggctgatcattgcagtatcagagggtggagatgtcagtctgtccacgtggagagaagttgccctccaggccgacaggaggccatgcccaccgcccctggacaggcttcgtctcagaaggctctatctgctgggctggcggccatccccgtgttgggtggaccccgagcacggttgcctgaggtccgatggcccgagagctgggactcagttcttggcctgctagcggctgaacaggccgcacatctcacttcagttgtggcctcattcagcagaatgactctggaaccatcctctgttacccgcagatcctgtcccatgggctctggccccaagatgttggggggccccacggagagttgacttggtagagttcctttctgggaagaaagtaggagtggctgaccaggccctgctcatcacccggatagaggacacggaccctgtgtggtattttggcattttggctcagagtccaatgtaccatgttgcccagaatttcatacttatggcctttacatgaatacgtcttgatcagacattcagagattagtcttaggtttgcacgtaagtcactgaaaacagtaaaacaggctgcttagatttctagcagtatgtgtgctcttatccccagctgttagcacgttagtaatacttttggggaggagttgtctgtcctggtcagttttcacagaggcggttgtaagaggatgtggttattttctccatgtctgtagttgctttgcggcatctccatttcacgggcaacactcactgcctgcagctgagattccagaacgccctgtgtccacagtgattagcctcgtctttcagcgagcataaaataggtgcattgtccttttcttttcttgaggcagggtctcactctgttgaccaggctggagtgaagtggtgtgatcccagctcactgcagcctcgacctccctggcttgagtgatcctcccgccccagcctcctgagtagctgggactagaggcacgcaccaccgcgcctttttattttttttgtagagacagggtctcactgtgttgcccaggctggtcttgaactcttggcctcaagcgatcctccttcctcatccttctaaagtgctgggattacaggtgtgagccacagcactcggcctaaataggtttttcttgctatgttattttcagtgctttgcccttgaattcttttcctctcttaaattcatatcatttggccgagtcagcacgtagtttgcattccagcgtctgctgttgattccactgaaacctctgttctcatgaaggagaggatttggctcgctgtggtttctcgtactttcacatctctgtagatacaggggcaaaagtcattgctgacagagccctatctatgtcctggaagtgtgtgtttcttgctttgaatgcatgtgtgaagattataaaagccaaatagtttttaaagatctcggtgctgaacgacagtcccagttcccatttgtgtcccattgtctttgtggtgtcacccgcactgtttgcttcattgtctggggaacttctgcacatcatgtactttgtgccatttctgggctcacgtgtcactcctaatagagcctcttaaccaagactgctggattgcagctgcttgaggcaacacaggaggttagaacatgtcccgagggctctgaaacagtaggacatcctgggtgggtggagctggggagggcatgggcaggccagctggccgagctcctggctggctctcctgagtcctctggacatggcttgtccctgtcagactgtagctcttcaggacctgagctcttcccgttcttgatctgctcttgtgctgactgtgctgggctgatgggtaggcgcttgtccccagtgagtggctgtgtcctcagggtgcccctcttccagaccaactgcagcaaggcctggagcctgactctaggtgcagcccttgtggctggaatcccttgtgccacccaggggactcgggccctgctcctcctgcagcccctcctcacctgggctcgctgctggagtgaggtttttagggagcccagagcgtactcatctctgagctgctgggcccagctgcctggtgcatacctcttgcctcggtcctgtcccccagaacgctttatggagactgccgtgtcctccgagcactttgttttcacttcctgacccgtctcagaagctcaagtggttgaatgttttagcctcagaatctttttccccaagccctctcaggtggagccccgctgtaccagacaccacagcacagctctgtgaggctgtgtctcttcactctgtttctggggctgctgaggcccctgggaagccctggagcttgccagagcagagcgagaaagtctctggtcctgtttaaatgcctccgcgttttatctgtgagcaccaggctggagccactccctgtcttctcacagtgcccctgcaagttgcagcctcagttttccagtggctcgtggggtagcaggtgctgcgtcatatggtttgggacctctgtggctgcttccagcctgctaatagaacctctttccaccactgccttcatctttggggtggcacccctgagtgctcaggcctgagggcgctcctgtgtcctcactcgggacaggcagcctccactctgggagctcccatccctcgggatgcccaggagaggccatactttcagggtggcatggtgaattcaggggttaggatgggtaggtggtctttcagccccttctacgttggggttggtttacagaacacctgtcctgcctgtgccagcctggccttctgcgagcaccccaggcacgctgtcctggaagttgtctgtctcctgcataggagggtctagagcagaccttgccctgggcctgtctgtgcgtgacttccatatgcttcattcgtgctcagccatggctgagcatgcgatggagagcacctggactgcccctgacgtcgcaggccactgttcttatccagtgggccaagtgattgattgctagtggtggagttgattggaagaaaggaagtcgcagcccctgcccacggcttccccagctcgctggggttggaggactgtcatcagttgtccccagttaaagtccatttggaggaggttcagggtcccagtggctggatgtgcttgtggagggacacggtttgaggcaggggtttgcagaaggtgtagactgcatccattcttgggaggctgtggcacagggcagcgacaacttgggacaaatcaagacccgtccacactgcacctcagggacctcacctcacgccccacataaatgtgcttattggggatccgggtgtggtggcttctgcctgaaatcccagtactctggaaggccacggcaggaggatcactttagttcaggagtttgaaaccagcctgggcaacatagggagaccccatctctacagaaagtaaaagaaaatgagccaggtgtggtggcatgtgcctgtaaccccagctactcaggaggccgaggcgggaggatccccaagcccaggagtttgaggctgcagtgagttatggcctctgcactccagcctgggtgacagagtgagagacctaatctctaaaaacaaaaaataacaaaatgtgctttggggtcaggtgtggagatcagggtcggggaggtcatgaggtaggtaggggtcaggatgtggacagtcatgggctggtgggtgtggcagccgtgaggggtgggtggtggcctgggaggcagggcctgggcagggcttctgcacttctgctgcttacccagccccctctgggttcgaggactctccttgacaagggctgagctctcgggcactgcgttggactcagctgcctactgggaggctggggagaatggacctgtgagaccttgtttgtcctcttccctgcccagctcttgtagaccccaggcctggctgtccgcagggccaggagctgcagccatggcagccaccagcctcccacatgagccccagctcccagccccacacgcccactcctttgcccatgtggtgtcagctctggcctctgcttctacacatggaccctcagaccttgcacatctgttgtttcccttgcagggcagtgatgatgacatgaaatgaggtggggtcactcctgtttagggatgagactggggcccagggaggggcaggtgtgaagttgctgagggcagagggagacccagggctacctgctcctaatgaccagcctcacgttctccactgctcactccctgctgttcaccagctgcatgaccttgagcagtgcactcaactgtaaacagaggtgaaaacactcctttaccaactgttttaggggccactcttgtttgaggccttgaacctcctttcagttccgtggtggtcctgagcctctgaatctgggtatggcccctgctgggtcctggtctcttaggcagcacgatggcctccctgctcaaggccctgcacccaggggcagattgtgggaggcccactggccatggctgggccctatcgcagagagcctgtcagcacggccatttccacacccaggctggctgggaagcaagctacgaggtgctcaaaggccctctatgtctgcaggtagccccgtcccacacaggcgaggatcgttgggcctccttagtagccaaaggaactgaggtccagagcagggaatgtgttgcccagtgtcagcatggtctgctctggggtcaggcgtcttgccctggtcctaagccaccccaagccaaggcatgtccctgggcccatttcctctctcgaggtcttgggttccctatttctgatgtgtgtgaaaggaaggcctgtcctctggggtgaccatgaggctcagtgggaggagctgccaggcttgagctgggacttggcacctggccagccttttttctatttcattgtaccttgatgggctgtcagttctgaagagaaaaaatacactaggaatccattcttcctccaccattctccctggcagagggaagtgactacacccctatggtgtggacatactgacgctcctccatgaagcagcaaagttctgttgtttcaggagactgtgggccttgaggatgtggtagtgacctcaccagaggagttggcaattcctaagtgctgcctggaggcctctacagagacataatgttggagaacttctgccacatggcagtgctgggtaagacccctctgtccccaccagtgcccttgaggttatgggtgttggtaggtctgtggcctccatctccatgacgatggtgttaaggactgcatgtttgtgtccccccccaaagtttatatgttgaaaccctgacccccaggagggtggtattaggaggtggggcctttgggaggtgactaggcttaggtgagatcgtgagggtggggctcgccgatgagatcgagtccttataagaaaaggaaggaactagagcgaggtcactttgtgctgtgtgagcatacaagaaaactgccatcttcaagctgggtgcagtggctcacgcctgtaatcccagcactggaaggccaaggcattaggattgcatgagtccaggagttcgagaccagcctaggcatgataagaccttattgctaaaaaaaaaaaaaaaggaaataaaa

SEQ ID NO: 4354 - DNA, 1593 bp, Homo sapiens
atgaaaggagaaattcaacagtcgcttggagcctgggttttgcttacatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacttacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacat

SEQ ID NO: 4355 - DNA, 1722 bp, Homo sapiens
ctaaacccggaagcgagggaggaacttcggagctgtcgcccgggttaccgggaggcggagccgccgagctcgctgtggcccggatgttcggtgcagctgccagatccgctgatctagtgcttctcgaaaaaaaccttcaggcggcccatggctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacttacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctacataaaatt

SEQ ID NO: 4356 - DNA, 1636 bp, Homo sapiens
ccgccgagctcgctgtggcccggatgttcggtgcagctgccagatccgctgatctagtgcttctcgaaaaaaaccttcaggcggcccatggcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttacaacccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactgagtgtagacatgtgaaatgccaaaaacctgagaagtgctcctaataaaaaagtaaatcaatcttaacagtgtatgagaactattctatcatatatgggaacaagattgtcagtatatcttaatgtttgggtttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacttacctgttgtgtttcagtttgtttttcacctataatgaattgtaaaaacaaacatacttgtggggtctgatagcaaacatagaaatgatgtatattgttttttgttatctatttattttcatcaatacagtattttgatgtattgcaaaaatagataataatttatataacaggttttctgtttatagattggttcaagatttgtttggattattgttcctgtaaagaaaacaataataaaaagcttacctac

SEQ ID NO: 4357 - DNA, 3648 bp, Homo sapiens
acttcccgcgcccgctcgccgctgaccggagttgtctcctcctccgcagggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaacggaaacaaggtcttacattttatgtgtttttttaaattctgcactttgacagtggtagcaaaataaaagtaatccaaaagttatttttctattgagaagagagaagaggtgggttttatttttttccttttgattccaatcttttctcccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcagggatgtcggtgtcattgccctcactaacgtcatgggcttcatcatgaatctgccctccagcctatgctggggtccactgaaactgcccctcaaaaggcagcactggatctgtgttcgagaggtgggaggggcctactacaacctcgactccaaactcaagatgcccgagtggattggaggcgagagcgagctcaggaagtttctaaaacatcatttgcgaggaaagaactgtgaactcctgctggtggtaccagaagaggtagaggctcatcagagttggaggaccgatgtgtaacagttctgcccaacctccctctcgcctcagccccttcagtcctctgtgacgtgctgtggcctctacagtgggtctgcccttgccacttccccaaacatctcatcaagtttttccccttcagatctgacagtgcaataggacagacgtgtggactgttataagaactactcagtgttttgttcctgggcaaggaaggtaggagttctgtgcacttaaggccagtggtcacaaacccttgttttatttaagagacagaggagaaagtggagcggggagggaatcctagcttattttcccttttctatgaggacttgacacaggttctgctgagttgtcactgctgctccagactcacctagagatgctgcctccactttccatcctgtctgggtctgaaaacagtgggtctgcagatagtgcccacaaaccccatgtgactggtttgaaggacccagagcataaaggtctctcaggaaaccatgtccaaaaccctagcagcggtacagcatgctgtctccaacccttatccccaggtttaagggtggtttatggccatacgtggaggttttttgttgttgtttttgagactgagtttcactcttgttgcccaggctggagtgcaatggcaccatctcggctcactgcaacctccacctcctggttcaagcgattctcaggcctcagcttcccaagtagttgggattacaggcgcctgccaccacacctggctaattttgtatttttagtagagatggggtttctccatgttggtcaggctggtctcaaactcccgacctcaagtgatctgcccgccttggcctcccaaagtgctgggattacaggcgtgagccaccgcacccggcagagttttataatgaaaaattaactaatattctagtatgaagtgaggaggatactgaacaggatgtggctaaagccaacctgggacagccatggggtggcttggtttcttcactccagtgttgtccctaccatttcgcagcattgatttaggaggctctgggacaaaagagaagccaaagagcagttttcccagttcactcactctggcaaaatcaggaaaaaaaagtctgcttttgacatcaaattccactaatttggggcagcgttgggtgaggaaagtattgtgaagacaggcttcttggagtaggggcagccacaattcagtagacactctaggctcggaggctgccactgtagttgccaagctcaggttgggtggttctgtgctgtatggatggaataggacctgggctggtcatcttcatgtcgtttcctctctgtatcaatggaagttcaacccgcccctacctcttcagatagttgtaggccacttttctcttgtaactttggaaaacaaaagaggagaaataagtatcataccatatgcgtgtctccaaagtggatgtggttgcctcaaggcaggtggcaggcaggggtgacctgctggccctcagatcaatggtcgtggcaggtctgagagctgtcccactggccagacttctctccagcagcaaagccagcctggggcttgcatgttgatcctgagcaagcttaacggggtgaagctgggctttctcccccctgtgactggagtgcatgttgacaccagcactttttctgcacatgtatcttcaatccaacaaggccgtttttttaatgctgagtaacaggccaccaagcggctactgcgttatatcttctcagcaactggccgcagtctcttctgcaccattttctacaccagacctgcttggcaccacagggagctcttttcctgccctgcacaatgacattccaaccaccaccagccagacattacagccaaccttgctgattgtcacaagcaggaccttggggccactggcactgtcagatagtaagccatttcttgggtagaggaggaaactcctctccacaaatccacttgggcctgtgcaaatggcacttgaaagagtccccatgcacttggagtccatgagccaatgggatatgcaaagacgcttaaacatttcagggctggtttctctgttcatatccaattctggtgcttaggaacagggacccatgctgatgcccaagggcaaaaagccccacttcctttaaggaagtgaacaggcctgaccctgatgcccaataacgggcaaccctaggctttttgtttttcttgcttttattcctttttgttgttggccttgtgctgcgtttgtttacaaaagatgtattttgtttaaccaaatattaaaaatggaaaactccatatatgtctccttgtctgcctgaattctataattgtgtaaagaaaaataaactttagtatgacgctgttttaaaagga

SEQ ID NO: 4358 - DNA, 529 bp, Homo sapiens
agttggcggcgcgcactccaggtggcggccggctgcggtgaggggaccgccagcggcgagcagtcccggcggccctgggtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcag

SEQ ID NO: 4359 - DNA, 623 bp, Homo sapiens
acttgaaatgtgactcccagcgagacacctacccttgacgctccctggacagtgcggcacggtcgggcccactaaccaaggcaatttgcgcccgaccgaatcaggtgcttcaaaatcccccctggtgagccgcgcgttaaccacacataaaacagtcaacgcagaaggagcgagaacgttcggccgaaaagcccggcacagagaagggaggggtgctgaaagccgcggactgcagccgctggcctggctgccgccccgaaacaacgcccacgcccgggagaagggcaggctggcgtccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggt

SEQ ID NO: 4360 - DNA, 843 bp, Homo sapiens
gcgcactccaggtggcggccggctgcgggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaacggaaacaaggtcttacattttatgtgtttttttaaattctgcactttgacagtggtagcaaaataaaagtaatccaaaagttatttttctattgagaagagagaagaggtgggttttatttttttccttttgattccaatcttttctcccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagag

SEQ ID NO: 4361 - DNA, 818 bp, Homo sapiens
agccgccgcccaggaaggggatgcggaaacccctggctcggtggagcggagaggcaggcggggagccgaggacggcatgtcccaggccccgggagcacagccgagcccacccaccgtgtaccacgaacggcagcgcctggagctgtgtgctgtccacgccctcaacaacgttctgcagcagcagctctttagccaggaggctgccgatgagatctgcaagaggttggccccagactcccggctgaaccctcatcgcagcctcctgggcaccggcaactatgatgtcaatgtgatcatggccgctctgcaggggctgggcctggccgccgtgtggtgggacaggaggaggcccctgtcccagctggccctgccccaggtactggggctgatcctgaacctgccctcgcccgtgtcgctggggctgctgtcactgccgctgcgccggcggcactgggtggccctgcgccaggtggacggtgtctactacaacctggactccaagctgcgggcgcccgaggccctgggggatgaggacggagtcagggccttcctggcggctgcgctggcccagggcctgtgcgaggtgctgctggtagtgaccaaggaggtggaggagaagggcagctggctgcggacagactgaccatggctgaccatcggcgcccacagcgcagtccctgcgcatccccctccggctgcgcacactgcatgcctgggaaaggccagcacttcatggaccctggggaggccccgccccctccccacacccctgctccccactgccgctgctgcctcaataaatctgctgatttgctgcc

SEQ ID NO: 4362 - DNA, 769 bp, Homo sapiens
gcgccgtggctgggcaggagccgaggacggcatgtcccaggccccgggagcacagccgagcccacccaccgtgtaccacgaacggcagcgcctggagctgtgtgctgtccacgccctcaacaacgttctgcagcagcagctctttagccaggaggctgccgatgagatctgcaagaggttggccccagactcccggctgaaccctcatcgcagcctcctgggcaccggcaactatgatgtcaatgtgatcatggccgctctgcaggggctgggcctggccgccgtgtggtgggacaggaggaggcccctgtcccagctggccctgccccaggtactggggctgatcctgaacctgccctcgcccgtgtcgctggggctgctgtcactgccgctgcgccggcggcactgggtggccctgcgccaggtggacggtgtctactacaacctggactccaagctgcgggcgcccgaggccctgggggatgaggacggagtcagggccttcctggcggctgcgctggcccagggcctgtgcgaggtgctgctggtagtgaccaaggaggtggaggagaagggcagctggctgcggacagactgaccatggctgaccatcggcgcccacagcgcagtccctgcgcatccccctccggctgcgcacactgcatgcctgggaaaggccagcacttcatggaccctggggaggccccgccccctccccacacccctgctccccactgccgctgctgcctcaataaatctgctgatttgc

SEQ ID NO: 4363 - DNA, 733 bp, Homo sapiens
cccagtcagcgcggtgttgcccgccccgcactcggagcccagagccgccgcccaggaaggggatgcggaaacccctggctcggtggagcggagaggcaggcgggcaggagccgaggacggcatgtcccaggccccgggagcacagccgagcccacccaccgtgtaccacgaacggcagcgcctggagctgtgtgctgtccacgccctcaacaacgttctgcagcagcagctctttagccaggaggctgccgatgagatctgcaagaggcccctgtcccagctggccctgccccaggtactggggctgatcctgaacctgccctcgcccgtgtcgctggggctgctgtcactgccgctgcgccggcggcactgggtggccctgcgccaggtggacggtgtctactacaacctggactccaagctgcgggcgcccgaggccctgggggatgaggacggagtcagggccttcctggcggctgcgctggcccagggcctgtgcgaggtgctgctggtagtgaccaaggaggtggaggagaagggcagctggctgcggacagactgaccatggctgaccatcggcgcccacagcgcagtccctgcgcatccccctccggctgcgcacactgcatgcctgggaaaggccagcacttcatggaccctggggaggccccgccccctccccacacccctgctccccactgccgctgctgcctcaataaatctgctgatttgc

SEQ ID NO: 4364 - DNA, 996 bp, Homo sapiens
ttcctaggcccgacggccgacttcagggccacgcggcccgggcgttccgtgtggagcaggagtcccgcggggccccacgggagtcgtagtccggcgcgcggggatcaccgggagctgtagtccgtcccgcctgcccagtcagcgcggtgttgcccgccccgcactcggagcccagagccgccgcccaggaaggggatgcggaaacccctggctcggtggagcggagaggcaggcgggcaggagccgaggacggcatgtcccaggccccgggagcacagccgagcccacccaccgtgtaccacgaacggcagcgcctggagctgtgtgctgtccacgccctcaacaacgttctgcagcagcagctctttagccaggaggctgccgatgagatctgcaagaggttggccccagactcccggctgaaccctcatcgcagcctcctgggcaccggcaactatgatgtcaatgtgatcatggccgctctgcaggggctgggcctggccgccgtgtggtgggacaggaggaggcccctgtcccagctggccctgccccaggtactggggctgatcctgaacctgccctcgcccgtgtcgctggggctgctgtcactgccgctgcgccggcggcactgggtggccctgcgccaggtggacggtgtctactacaacctggactccaagctgcgggcgcccgaggccctgggggatgaggacggagtcagggccttcctggcggctgcgctggcccagggcctgtgcgaggtgctgctggtagtgaccaaggaggtggaggagaagggcagctggctgcggacagactgaccatggctgaccatcggcgcccacagcgcagtccctgcgcatccccctccggctgcgcacactgcatgcctgggaaaggccagcacttcatggaccctggggaggccccgccccctccccacacccctgctccccactgccgctgctgcctcaataaatctgctgatttgctgcc

SEQ ID NO: 4365 - DNA, 2595 bp, Homo sapiens
atgcgtgcaggcccggagccccaggcgctggcggggcagaaacgcggcgccctgcgtcttctggttccgaggctggtcctcaccgtttccgctccggcggaagtgaggaggagggtccttcgacccgtgctgagctggatggaccgcgagacgcgcgccctcgccgacagccacttccgaggcctgggggtcgatgtccccggcgtcggccaggctccgggccgggtagccttcgtctcggagccgggcgccttctcctacgccgactttgtgcggggcttcttgctgcccaacctgccctgcgtgttttccagcgccttcacgcagggctggggcagccggcggcgctgggtgacgcccgcggggaggcccgacttcgaccacctgctacggacctacggagacgtggttgtaccagttgcaaactgtggggtccaggaatacaactcgaaccccaaagagcacatgactctcagagactacatcacctactggaaagagtacatacaggcgggctactcctctcccaggggctgtctctacctcaaagactggcacttgtgcagggactttccggtggaggacgttttcaccctgcctgtgtacttctcgtccgactggctgaatgagttctgggatgcactggatgtggatgactaccgctttgtctacgcggggcctgcgggcagctggtccccgttccatgctgacatcttccgctccttcagctggtctgtcaatgtctgtgggaggaagaagtggctcctcttccccccagggcaggaagaggccctgcgggaccgccacggcaacctgccctacgacgtgacctccccagcactctgcgacacacacctgcacccacggaaccagcttgctggcccacccttggagatcacgcaggaagcgggcgagatggtgtttgtgcccagtggctggcaccaccaggtgcacaacctggatgacaccatctccatcaaccacaactgggtcaatggcttcaacctggccaacatgtggcgcttcttgcagcaggagctatgcgccgtgcaggaggaggtcagcgagtggagggactccatgcccgactggcaccaccactgccaggtcatcatgaggtcctgctcgggcatcaactttgaagagttttaccacttcctcaaggtcatcgctgagaagaggctcctggtcctgagggaggcagccgctgaggacggtgctgggttgggtttcgaacaggcagcctttgatgttgggcgcatcacagaggtgctggcctccttggttgcgcaccccgacttccagagagtggacaccagcgcgttctcaccacagcccaaagagctgctgcagcagctgagagaggctgttgatgctgctgcggccccatagcacctgtcgtgaggatagaaggacgggtggaagagaggcagcctcctgctccggggcccttccagaaataaagaccgccctccctgtgacctggggcccacccctgtcgaggcttgtggcctggctgttcatggccactgcctgggtgcctgttttcaggtgaggcccaatgaggtcagggacccaagatgggatgtggcccttctgacctgcagcaggcctgctgggagctcggagatggtgccaggacctggctcttttgggggccctgcctccttaggccaggacgcctgagctgacaggagtctgtgtctggtgtgccttctctggtggctcctcttaataggccagccctgtcccctcgtctcaggccattggaccacccctggctctgccctgtgggttcagggaggggttggagcagtgctgggcaagctcaccagggcctccaggcagggctggggttggcctccatcacctccaggtgatgggctgtggaaccagcggcctgcgccttcctctgggtacccagagtggagggctgggttgggctggcctttgccacctccctgcctttgcagggcctgtggacagctggagaggccacagatggggtggaatcccatctgctgctgaatcctcacctgggcctgagggactgtgcctgctgtgcactcacagctgggtcttcccaaggatgctgttctcaggagtggtgggtccccagcccctcttcacactgggtatgatggaggtgtgggcgggctcgtccaggccgatcaaggcacagcagtgagcagcggaggcctgtggtggggaatggactctcgtgggatcctcttgcagaggatgccccaggcctgaaccctctagtggatccacagtttgtggagactggcactctcccagccctgtccttgaccgagagtccagcattttttcagttggcccctggttggctgcctcaccccagcaggggaggaggcatccgaatccacagggacggcacgtgccatggctatgcacattgcctgcccgtggcatcaactggggccgctggcacttgtctaggatggaagcccccaagaagggcaggggtttctgtctgctctgttcagtgaatcatgtgaagtgcttgcaaaggcagctttacacagtaggtgcttcatatgtgtctgtcgaatgaatgcgctccagccaaca

SEQ ID NO: 4366 - DNA, 2480 bp, Homo sapiens
aggcgctggcggggcagaaacgcggcgccctgcgtcttctggttccgaggctggtcctcaccgtttccgctccggcggaagtgaggaggagggtccttcgacccgtgctgagctggatggaccgcgagacgcgcgccctcgccgacagccacttccgaggcctgggggtcgatgtccccggcgtcggccaggctccgggccgggtagccttcgtctcggagccgggcgccttctcctacgccgactttgtgcggggcttcttgctgcccaacctgccctgcgtgttttccagcgccttcacgcagggctggggcagccggcggcgctgggtgacgcccgcggggaggcccgacttcgaccacctgctacggacctacggagacgtggttgtaccagttgcaaactgtggggtccaggaatacaactcgaaccccaaagagcacatgactctcagagactacatcacctactggaaagagtacatacaggcgggctactcctctcccaggggctgtctctacctcaaagactggcacttgtgcagggactttccggtggaggacgttttcaccctgcctgtgtacttctcgtccgactggctgaatgagttctgggatgcactggatgtggatgactaccgctttgtctacgcggggcctgcgggcagctggtccccgttccatgctgacatcttccgctccttcagctggtctgtcaatgtctgtgggaggaagaagtggctcctcttccccccagggcaggaagaggccctgcgggaccgccacggcaacctgccctacgacgtgacctccccagcactctgcgacacacacctgcacccacggaaccagcttgctggcccacccttggagatcacgcaggaagcgggcgagatggtgtttgtgcccagtggctggcaccaccaggtgcacaacctggatgacaccatctccatcaaccacaactgggtcaatggcttcaacctggccaacatgtggcgcttcttgcagcaggagctatgcgccgtgcaggaggaggtcatcatgaggtcctgctcgggcatcaactttgaagagttttaccacttcctcaaggtcatcgctgagaagaggctcctggtcctgagggaggcagccgctgaggacggtgctgggttgggtttcgaacaggcagcctttgatgttgggcgcatcacagaggtgctggcctccttggttgcgcaccccgacttccagagagtggacaccagcgcgttctcaccacagcccaaagagctgctgcagcagctgagagaggctgttgatgctgctgcggccccatagcacctgtcgtgaggatagaaggacgggtggaagagaggcagcctcctgctccggggcccttccagaaataaagaccgccctccctgtgacctggggcccacccctgtcgaggcttgtggcctggctgttcatggccactgcctgggtgcctgttttcaggtgaggcccaatgaggtcagggacccaagatgggatgtggcccttctgacctgcagcaggcctgctgggagctcggagatggtgccaggacctggctcttttgggggccctgcctccttaggccaggacgcctgagctgacaggagtctgtgtctggtgtgccttctctggtggctcctcttaataggccagccctgtcccctcgtctcaggccattggaccacccctggctctgccctgtgggttcagggaggggttggagcagtgctgggcaagctcaccagggcctccaggcagggctggggttggcctccatcacctccaggtgatgggctgtggaaccagcggcctgcgccttcctctgggtacccagagtggagggctgggttgggctggcctttgccacctccctgcctttgcagggcctgtggacagctggagaggccacagatggggtggaatcccatctgctgctgaatcctcacctgggcctgagggactgtgcctgctgtgcactcacagctgggtcttcccaaggatgctgttctcaggagtggtgggtccccagcccctcttcacactgggtatgatggaggtgtgggcgggctcgtccaggccgatcaaggcacagcagtgagcagcggaggcctgtggtggggaatggactctcgtgggatcctcttgcagaggatgccccaggcctgaaccctctagtggatccacagtttgtggagactggcactctcccagccctgtccttgaccgagagtccagcattttttcagttggcccctggttggctgcctcaccccagcaggggaggaggcatccgaatccacagggacggcacgtgccatggctatgcacattgcctgcccgtggcatcaactggggccgctggcacttgtctaggatggaagcccccaagaagggcaggggtttctgtctgctctgttcagtgaatcatgtgaagtgcttgcaaaggcagctttacacagt

SEQ ID NO: 4367 - DNA, 1416 bp, Homo sapiens
gtcggggaaaggcggggtctcggccggcgctgacgcagccatggcggaggcggctttggaagccgtgcggagcgagttacgagaattcccggccgctgcaagggagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggtgccctggatcccactggaccccttggcgccagacctagcacggtaccctagttacagtcaggcccaggcccttcgctgcacggtgcgggccggtgagatgctctatctgccggctctgtggttccaccacgtccagcagtcccagggctgcatcgcagtgaatttctggtatgacatggaatacgacctcaagtatagttacttccagctgctcgactccctcaccaaggcttcaggccttgactgatggagcactggtgaacaccaccaagcacgcctcgggggacggagccagcccctccctggccaggtcaattctcgagagagcctggagtgtgcatgctggctgctggccccgggtccagcatggcttgagatcagctttggaggatcttggaatgtggtcataaggactcaaggtgccaggcaggtctgggtgagggttctcaggaagttgccacacaggtgagcagagtggggatcaggtgcagcggcacctctccccagcgctgtgatgttgggcgagtcactgcgtctcgggcattggtgtcctgtcagtaaagagataataatggctgtacctcgcggggctgttgtgggcttggagatgatgtctatgaggaccagcatggagctggcacacaggacatgttgaataaaaggtagctgtga

SEQ ID NO: 4368 - DNA, 2123 bp, Homo sapiens
atggtaaccggcggcgcccatagtcgctctcggggcggccttcccagtgcctcccgtagaggcctcttccggggcgggccaaaggaggtcacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggcgcccgggcgggccgggggccgtggcggaggaggagcgctgcacggtggagcgtcgggccgacctcacctacgcggagttcgtgcagcagtacgccttcgtcaggcccgtcatcctgcagggactcacggacaactcgaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcaggcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgcttgccagtaaagccttcg

SEQ ID NO: 4369 - DNA, 2042 bp, Homo sapiens
acttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggcgcccgggcgggccgggggccgtggcggaggaggagcgctgcacggtggagcgtcgggccgacctcacctacgcggagttcgtgcagcagtacgccttcgtcaggcccgtcatcctgcagggactcacggacaactcgaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcaggcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgcttgccagtaaagccttcgataaacgct

SEQ ID NO: 4370 - DNA, 2033 bp, Homo sapiens
atggtaaccggcggcgcccatagtcgctctcggggcggccttcccagtgcctcccgtagaggcctcttccggggcgggccaaaggaggtcacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggtacgccttcgtcaggcccgtcatcctgcagggactcacggacaactcgaggttccgggccctgtgctcccgcgacaggttgctggcttcgtttggggacagagtggtccggctgagcaccgccaacacctactcctaccacaaagtggacttgcccttccaggagtatgtggagcagctgctgcacccccaggaccccacctccctgggcaatgacaccctgtacttcttcggggacaacaacttcaccgagtgggcctctctctttcggcactactccccacccccatttggcctgctgggaaccgctccagcttacagctttggaatcgcaggagctggctcgggggtgcccttccactggcatggacccgggtactcagaagtgatctacggtcgtaagcgctggttcctttacccacctgagaagacgccagagttccaccccaacaagaccacgctggcctggctccgggacacatacccagccctgccaccgtctgcacggcccctggagtgtaccatccgggctggtgaggtgctgtacttccccgaccgctggtggcatgctacgctcaaccttgacaccagcgtcttcatctccaccttcctcggctagccaaaacagctggcaggactgccggtcacacaccagcacgtcccacctcgtgctcacggattttattacacagatagtggcggcaatggcctcagcccagcccaccctcacctgcttttccagcccacaaagggggacgatcacggcccagcaaaagcgatgctgagaggggaaacagtccagagtccaacagcagaacttgggggaagcggtcggggtggccaggaacataaactatgtataggggccgggggcttctgcccagggctcccctggaccaggacgccaggtagggcagggaacctcagtagtcctccacccagccattctcagagatgaatgcgtcaataacctccttcatagccaagttggggatgagctgttcctgggtcagggggctccgggtcacggggtcaaaatgacccacacgctgcagtgacaagaagggcagagggcagtcatggggcccaggaccatgccactggccctgctcccccagccgcaggcctcacctgcaggtgctcctcgatgtccttgcggtcgtaggtgatgccactgggcgtgatgcacggctcccgcatcagctcaaagctgatcttgccacacaggtagtcggggatgtctcgcttctgtggcacaggggcacacggtcagaggctgaaaaggggcactgcacgagcacctgccagccatcggcagcaagcgacacacactcaccttcctcttctcatccacctgagaaaaaagctcgtccatgtccgccatgtacttgtcctgtgaagagttgagtgctgtgcttgggggagacaccccacctccctcctccatggggcacagacccaacacaaggcggggatgctcccacgccacgtgcacacacacagacccacatgtgggtggggggcaccctcacgtgcttggcctcaatgcaggcctgctgggcccggacgtggctgtcgtcctcatcaccctcgtggtttcgctggcactcttccagctccctgggggttgaccaggagccggtcagagatggacctggccagatgtctgaccacaccccaatctcagagctaacatccacacttccccacatttcctgcttgccagtaaagccttcg

SEQ ID NO: 4371 - DNA, 3200 bp, Homo sapiens
ggccagagtccggagcagccgccgcccgaccacgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacagatgcgttg

SEQ ID NO: 4372 - DNA, 3497 bp, Homo sapiens
ggccagagtccggagcagccgccgcccgaccacgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtacggccccctctttgcaggcttttcctcctctctagaacctccttctgttggaggccctcccatctccccgctgaaacctgcgctccttttttggggggatcctttgctgctgagcttccccaagcacggtgtgccctggcctgccttcttcttgtgtctttggtggggatggggaggcctattcctgctggccccttctgggggtggtgggcaggtgacacggagtggcttgagcttctggggatgcaggtccaccgagcccctgacccctgtctgtccccgctcccctaacaggtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacagatgcgttg

SEQ ID NO: 4373 - DNA, 3439 bp, Homo sapiens
gccaactacatgcatgtccccgggggcaagttcgactttgacgacgggggctgctacgtggggggctgggaggcggggcgggcacatggctacggcgtgtgcacgggccccggcgcccagggcgagtacagcggctgctgggcacacggcttcgagtcactgggcgtcttcacggggcccggcggacacagctaccagggccactggcagcagggcaagcgcgaagggctgggcgtggagcgcaagagccgctggacgtaccgcggcgagtggctgggcgggctgaaggggcgcagcggcgtgtgggaaagcgtgtccggcctgcgctacgccgggctctggaaggacggtttccaggacggctacggcactgagacctactccgacggaggcacctaccagggccagtggcaggccgggaagcgccacggctacggggtacgccagagtgtgccctaccatcaggcggcgctgctgcgctcgccccgccgcacctccctggattccggccacagcgaccccccgacgccacccccgcccctgcccttgccgggcgacgagggaggcagccccgcctcgggctcccggggcggcttcgtgctggccgggcccggggacgccgacggcgcgtcgtcccgaaagcgcactccggcggccggcggattctttcgccgttcgctgctgctcagcgggctccgagcgggcggacgtcgcagctccctgggcagcaagcgaggctccctgcgcagcgaggtgagcagcgaggtgggcagcaccggaccgcccggctcggaggccagcgggcccccggccgcagcgccgcccgccctcatcgagggctcggccacagaggtgtacgcgggcgagtggcgcgcagatcggcgcagcggcttcggcgtcagccagcgctccaacgggctgcgctacgagggcgagtggctgggcaaccggcggcacggctacgggcgcaccacccgccccgacggctcccgcgaggagggcaagtacaagcgcaaccggctggtgcacggcgggcgcgtccgcagtctcctgcctctggcccttcggcggggcaaggttaaggagaaggtggacagggctgtcgagggcgcccgtcgagccgtgagtgctgcccgtcagcgccaggagatcgccgctgccagggcagcagacgccctcctaaaggcagtggcagccagcagtgtcgctgagaaggccgtggaggcagctcgaatggccaaactgatagcccaggacctgcagcccatgctagaggccccaggccgcagacccaggcaggactcagaaggttccgacacggagcccctggatgaggacagccctggggtatatgagaacggactgaccccctcagagggatcccctgaactgcccagcagtcctgcctcctcccgccaaccctggcgaccccctgcctgccggagcccactgcctcctggaggggaccagggtcccttctccagccccaaagcttggcctgaggagtgggggggggcaggcgcacaggcagaggaactagctggctatgaggctgaggatgaggctgggatgcaagggccagggcccagagacggttccccactcctcggaggctgcagcgacagttcaggaagtcttcgagaggaggagggggaggatgaagagcccctgcccccgctgagggccccagcaggcacggagcctgagcccatcgccatgctggtcctgaggggctcgtcctcgaggggtcctgatgctgggtgcctgacagaagagctcggggagcccgctgcaaccgagaggcctgcccagccgggagctgccaaccccctggtggtgggagccgtggccctcctggacctcagcctggcattcctgttctcccagctcctcacctgaggctacttcctggcctggttctggctttggttgcgtgcctcttcacccctttgacctgccttttttctcttctcctcttcctggctgtgttttctcctatctttctttctcttcttcctttcttttctgtgctcctttgtttttttctctcgctttttctttccctgtcttctttcagattatctcatttcttctggatctgtctctgtattcctcactcccttccccatcccaaccccttctttctctagattgtttacatatgaagggcttttctctctcagagttgctgtcttctctgagacacacaaatctaagtcagaccattgctccacgccctcccaccttttctttagacctcaacttcgctgcgggtgggggtttggtgtcctaaggagactcctggaagctgaatggagaggaggaagaaaatgaagaaggagtgattgaatgtcgggcaaggcactggctgagctgctgtggctccctagcctaaggggcctgctgtccctctgaggcctagtgaaaaagctgcaggaggtgcatcctccacctctaatcttggaggctattatcttacctccaagcactgagctgggttactgcccaattccatccttccctgaaggagagaagggaagtgaaaagtagagtaactccccagcatttccctctttttctcctcatcggccagcccctcctccagccccctctggtggcatgccatgccaagagcaacgtgtaaaggaacagagaatatccaatgcagtcaagtccaccctgcccagactttgccactgacttctcccacccttctgtctcccccataatagtttatttggttggtctggactcacttgtggcctttgattaaattcctaaggggcctgaagaagacatttctactgcagagggttagaggcacttgagcaaggcccccacatcccaactctgggagttgtggtgggaggaggcacttctgggggataggaccagacaagataacaggagctcacatggaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcagaggtgggagtcaaacccgggtgacaggtgggtggagagccctgtttgaggttgtggctgatccctctctggtattagtttttcccctgggagcaggaagccctaggaagaggggactgcagggtccccaggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcagg

SEQ ID NO: 4374 - DNA, 2181 bp, Homo sapiens
gctccctcaccgcccggccgctccctcatctcgcgatgccatcctctttttttttttttctttcccccctcccactcgcccccaagccctatgactccctcccctcccaacgtgtttttcaaatccaccaatgggcacacagcttaggctcgaaccagccaatcggaatgcggagtcaccgggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtattagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccaccctt

SEQ ID NO: 4375 - DNA, 1087 bp, Homo sapiens
gcgcggcagagtgcggcgcagcgcagctcctgaggttttggttatgaacaggattcggattcacgtcttgccaaccaatcgggggaggatcactccagtgcccaggtctcaggaacctctgtcttgtgcattcactcatcgtccatgctctcaccctcgtctggaggggcaggagttttgcattaagcatatccttgaagacaagaatgcacccttcaagcagtgtagttatatatcgacgaagaatggaaaaagatgtcccaatgctgccccaaagccagagaagaaagatggggtgtccttctgtgctgaacatgtccgtaggaatgccctggcacttcatgctcaaatgaagaagaccaacccagggcctgtgggtgaaacactcctgtgccagctgagctcatatgctaagacagagctggggtctcagactccagaaagtagtcgcagtgaagccagccgaatactagatgaagacagctggagtgatggggagcaggaacccattactgtggatcagacatggagaggtgaccctgacagtgaagctgatagcatagacagtgatcaagaagatcccctaaaacatgctggtgtctacacagcagaagaagtggccctgattatgcgtgaaaagctaattcgtttgcagtcgttgtatattgatcagtttaaacgacttcagcatctgctcaaggagaagaagcgccgatacttacataatcgcaaagtggaacatgaagctctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccagaaagatgcgactgccattggtgacctgttaactctttactgtggtctaatggagacagcactcgactga

SEQ ID NO: 4376 - DNA, 2155 bp, Homo sapiens
gagcggcgcggcagagtgcggcgcagcgcagctcctgaggttttggttatgaacaggattcggattcacgtcttgccaaccaatcgggggaggatcactccagtgcccaggtctcaggaacctctgtcttgtgcattcactcatcgtccatgctctcaccctcgtctggaggggcaggagttttgcattaagcatatccttgaagacaagaatgcacccttcaagcagtgtagttatatatcgacgaagaatggaaaaagatgtcccaatgctgccccaaagccagagaagaaagatggggtgtccttctgtgctgaacatgtccgtaggaatgccctggcacttcatgctcaaatgaagaagaccaacccagggcctgtgggtgaaacactcctgtgccagctgagctcatatgctaagacagagctggggtctcagactccagaaagtagtcgcagtgaagccagccgaatactagatgaagacagctggagtgatggggagcaggaacccattactgtggatcagacatggagaggtgaccctgacagtgaagctgatagcatagacagtgatcaagaagatcccctaaaacatgctggtgtctacacagcagaagaagtggccctgattatgcgtgaaaagctaattcgtttgcagtcgttgtatattgatcagtttaaacgacttcagcatctgctcaaggagaagaagcgccgatacttacataatcgcaaagtggaacatgaagctctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccatatttgtcaggatacgaatcaggttctcttcaagtgctgccagggatctgaagaggtaccctgcaacaaacctgttcctgtaagcctctctgaggatccctgctgcccactgcatttccagttgcctcctcagatgtataagcccgagcaggtactgtctgtgccagacgatctggaagccggccccatggatctgtacttgagtgctgctgagcttcagcccactgagagtttacctctggagttcagtgatgacttggatgttgtgggtgatggtatgcagtgtcctccttcacctttgctttttgatccttcactaacccttgaagatcatttagtcaaagaaattgctgaagacccagtggatattttgggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatccctatcaaagcttctgggattatttgggactatacctaaaaggaaagtgacatctttgtaatgggatttcccaagtcatggatagaaatccacttaagtagctaggtgggagctgtctttgtgagtggtgtctttgagatactgatggccctaatatcggttatctctatctgaagacctgcagtttagcttttcttcacctctacttaattgggcagtctttaacccctttccctggtgaactctggctttttatcctctgagaaaacagcccacaggactgggtcctccttatccgtcttgcttttaacctatgtaaatttctgtggttgctatcttatgtaaaatatagtaaaaatttattgtatatagtttctattaaatgttaaagaaaatgttatgaaaatatcaaacagtca

SEQ ID NO: 4377 - DNA, 343 bp, Homo sapiens
cggcagagtgcggcgcagcgcagctcctgaggcttccaggagccaggatctccggtgactggagccgtaggacaaaatggcgctcgcataggcttccgaggccaggcccagtcgtgcgctctgaggttttggttatgaacaggattcggattcacgtcttgccaaccaatcgggggaggatcactccagtgcccaggtctcaggaacctctgtcttgtgcattcactcatcgtccatgctctcaccctcgtctggaggggcaggagttttgcattaagcatatccttgaagacaagaatgcacccttcaagcagtgtagttatatatcgacgaagaatggaaa

SEQ ID NO: 4378 - DNA, 5253 bp, Homo sapiens
aggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatatgattgttaaatacctgtgaagtatgtgtggcccggtcctatttcctcacctgtttacagtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaca

SEQ ID NO: 4379 - DNA, 5153 bp, Homo sapiens
gccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccattgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaa

SEQ ID NO: 4380 - DNA, 771 bp, Homo sapiens
ggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccattgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaaggtcattttgaccttttgtgggtag

SEQ ID NO: 4381 - DNA, 2000 bp, Homo sapiens
ttttactcggtgcccgcagcgccggggcgtggaggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccattgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgacaccattacctgtctactcttggtttcaccactag

SEQ ID NO: 4382 - DNA, 5012 bp, Homo sapiens
agtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacagggtctcactctgtcacccagactgcagtgcagtggcacgatctcagctcactacaagccttgacctccaggactcagtctccttgtggaccaccacccttctgttatgacattgccacattgccacagattgatgcttacacaccatctcttttggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaa

SEQ ID NO: 4383 - DNA, 1448 bp, Homo sapiens
cgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatgctctgtacaaaatgagctaagtagctaagtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcag

SEQ ID NO: 4384 - DNA, 4473 bp, Homo sapiens
tggtctctggtgggaccgggcgctgcccccttcccctgtctcctgggtctctggaggagcccaggaaggaggctccgctggttccgctgggtcaggcgctgacgggaccgggctgcggcaatcgttagcgggtcatgtcggccgcccagggctgggacaggaaccgccggaggggaggaggcgccgccggcgctggtggcggaggtagcggggccggcgggggcagtgggggcagcgggggtcgggggactggccagctcaaccgcttcgtgcaactctccgggcggccgcacctgccaggtaagaagaaaatacgatgggacccagttaggaggcgcttcattcagtcctgtcccatcataaggatccctaacaggtttttgagaggccacagacctccaccagcacgaagtggacatcgttgtgtggcagataataccaacctatatgtgtttggaggttataacccagattatgatgaatcgggagggcctgataatgaagactatcctctcttcagggaactctggaggtatcattttgctacaggagtatggcaccagatgggcacagatggctacatgccccgggaattggcatctatgtcacttgtgctgcatggaaacaacctgttagtatttggaggtacgggcatcccatttggagagagcaacggcaatgacgtccatgtgtgtaatgtgaagtataagagatgggctttgctcagctgtcgggggaagaaacccagtcgtatatatggacaggctatggccatcatcaatggctccctttatgtctttggaggtacaaccggctatatttacagcacagacctgcacaagttagatctcaataccagagagtggacacaactgaaaccaaacaacctatcctgtgatctaccagaagagagataccgacatgaaattgcacatgacgggcagaggatttacatcttgggaggtggtacttcctggacagcatattccttaaacaagatccatgcatacaaccttgaaacgaatgcctgggaggaaattgcaacaaaaccccatgaaaaaataggctttcctgcagcccgaaggtgtcacagttgtgttcaaataaaaaatgatgtatttatttgtgggggctataatggagaggtgatcctgggagatatctggaagttgaatctgcagactttccaatgggtgaagctcccagctaccatgccagagccagtttattttcactgtgcagctgttacaccagctggttgcatgtacattcatggaggagtggtgaacatccatgaaaacaaacggactgggtcattgtttaagatctggctggtggtacctagcctgctggaactggcatgggagaagctgcttgcggccttccctaaccttgcaaacctctcccgaacacaacttctgcaccttggactcacacagggactcatcgaacgcttgaaatgaggatttctggactgttcattgatactggaaatgttaatttaaagagactcctttatttatgggcagtgtagaatgtgctacaaagaggattggttaccctgatcaaggccttatttagaaaatacatcagatgcctttctgtaaattggtttttcagtttatggacatctcactttcccacgtgcttccttctttgcttctgttcctcctgacccattacatgcacatgtactcacatactccctcttccttctcgatggagttaagggaaagcctgaaagtaccttaataatgttattaatcaagacagattcctttttaaaggaattctgaatagttccatgtcatacaatattctagaaattaaaacatcatcaacataaagaaaaatgaaattaaaaaatttttacatctagcaacagcaacaaccacaaatttaggggaagctgagaaggctaaccttgggaatcttgcaggttatacttaaacctagatgtttaacttagtgttttcaagatgtgtctaactgagtagtagctgggtctgatggcagcagtgcttgccatcttgttgcacagataactcaaacctaccctttggctttgaaggaaggttaagcagcccagcaactcttggttagtgatttctttctcatcctcatggtgccagcagtggttagagttggtttgtcaaaagacttacgtgtgtgtcgtggtcgtgctctttgttgttgctcttagaaattatggcaccaagaatgtttcaaacggaaaaacttgtggtggccaaagttcttcattctggcagttttgaaactctcttatgcttattaatggttttaaatatctctttgacttcttcatggggaattgtagaccctaagtatgtggtgtaaatgccatgtaacatgaacacaagctcccgagggaggccagagaagagccaggcagagaaaacctgcatcctctgggcttgttaacttggcttccactcgggctgtggtctttggctatcatcttggccatttccttttgagaacttgtttcttttctaatctctgggccaggtacctgccattttctcaggcagttggtccttgatttttcccttagcttgttgccttcttttccgtctgctttaatgtgcatggtgctgtgaataattgtctagtaattggatacaaggtcttgggggtaaagccacaggtcatccttcctgaagaaccaagtatcatttaaaaactagcatgaggaaggaatgaaactgagtagcattcattttgtgtgtgtgaaattttagttctggtttgtttgatttgttttttttttaattctaaaaagaatgacataaattttcactcgctttgccatctggctgctaggggagctgagcaagaggctcaccatgcgcatgtgtaagccgcaggtgtactcaaggtgctgaaggcgtgcaaggggcagcgctggtcctcccggggccaactcacagcaggagactcgcatgggagagttggaacacatctttcctttaagtgcctcttttttcacctagcttttaaagttattctttgtccttcatctcagaagggatctctttagcttatgtgtggatttaaaatgacctttgagctacggttaaaaagctaccatctggtgttcagttctgggaaagagaaaaccgtagcctccagacatgctcctgatttctaggccttatcataccatcccctctgtgatgggttgagttcatggagcctgtattctgggaagtcttataataaccacgcacctgtgaacgtgggtcctttctggggagtgaggaatgtgggagagaggcagaaaaaggagcagctcctctaggggcccatcctcccacatcttgccattaccagtctgtgtagcacttaacctcctgccaccactgccaggcttgctcctccgttctctcccagagcaagtcagtctgagcagctccattagtccaaaacagagctttgctgcatgacttcagcctggcctctggatatttggtggaaatatattctaaattgaacaagccaggctgtccagggtggcaagaggatttttgacctggatttatacagggaccaaagactgaatgctcagcctctgtgcttagactttcatggtccttaggatagaagtgagtctctagccctgctacaccagagagctgaagagagatgtggtctggttccatccatacttgctggcatcctttgttaagccttctgagggcagtcttctttgaggtagaccttggaggcctgacatcgaagacctgtgtgttttattttcataaaagtatatatccttggtctaaagtgtcttcttttaatataacactagtaaaaatgacatggtatgaccagcactgagtgctatagaaccacacatgtgtacatgttctggatgccaaatgagactgtgtgtaaatgactaagtgtagataactagaaattagataggggtcatcaggcgtttcggtatacctataaccagcactcggaattcctgacactgtttacttgatttaggaaagtttatgcctgctgcttctctgcctctttgaggtactcccagccgtcttactacagtcctgtaaatttaagtgcaatatatagaaacatatggatatatacagattatatatagggtgtaactataaagcaggtagactacttttttgcatcttggggaagtgagctcattactttaggttcaaattatgccaagaattttagatgtgatcagctggcttaagccaactcatgtcatgataaagctggattttcaagtccatgttttcttactccaactcttagagactcattgttccttaggtttgttagagttgagattttttttctccctgtcatctttgtactctctcatgtttgcatgtcttacattttgttgccggagaacaaggaagtccatctgtaaggagtttcctaaacggagaattaaaacctagtatttaacactaa

SEQ ID NO: 4385 - DNA, 1935 bp, Homo sapiens
actccatttctgtgcgccgagctccgccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgagaagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttgtgtgaaataaattggacttgaaacaaga

SEQ ID NO: 4386 - DNA, 1279 bp, Homo sapiens
ggtcagtttctccctatggaactactgggcttttagaatgataggaaacctggcctgtccctttacaggtgcgttacagtcaggcgaagctgggctgcgtgaccctgggcagggtgggcggctctcacctgtggagatgcagcactgaggggcccctccagcgtggttgctaacacagactgcctaggagcgtgcttttctcatcctggaccccagctactgcttaatttgcaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagaaactcaggagtggctggaggagacggactcggaagaggacagtgaggaggttgagggcgccgagggtggggtcgacgacgaagacagcggagaggagagcggtgcggaggactgagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttgtgtgaaataaattggacttg

SEQ ID NO: 4387 - DNA, 1829 bp, Homo sapiens
atttctgtgcgccgagctccgccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgagaagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttgtgtgaaataaattggacttg

SEQ ID NO: 4388 - DNA, 1748 bp, Homo sapiens
atttctgtgcgccgagctccgccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggagacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttgtgtgaaataaattggacttg

SEQ ID NO: 4389 - DNA, 6703 bp, Homo sapiens
ctggctgggagctggaattcccttcccgcctggcgccgcccgggagagcccgcgcgaggacgcccgccgcgctccgccggcccttttttggcgctgagggaaaggagaagggcagggccgccgcctcgcgggagcgggccccgggaggaggggccgccggagaggccgggcgagcgcgggcggccctcacctcgccgctcctcccgggccgccatccctcggcgccccgcccggaaccggcgcgcgcgtaggggctgggaggccggcgcgcagatctggcggtgagcgctgccgccccggggcccccagccatgtcggccgaggagatggtgcagatccgcctggaggaccgctgctacccggtgagcaagaggaagctcatcgagcagagcgactacttccgcgccctctaccgctccggcatgcgcgaggccctgagccaggaggccggcggcccggaggtgcagcagctgcgcggcctcagcgcgccgggcctgcggctggtgctggacttcatcaacgccggcggggcccgcgaaggctggctcctgggcccgcgcggggaaaagggcggcggggtggacgaggacgaggagatggatgaggtgagcctgctgtccgagctggtggaggcggcctccttcctgcaggtcacgtccctgctgcagctgctgctgtcccaggtgcggctcaataactgcctggagatgtaccgcctggcgcaggtgtacgggctgcccgacctgcaggaggcctgcctgcgcttcatggtcgtccacttccacgaggtgctgtgcaagccccagttccacctcctggggtctcctccccaagctccaggggatgtcagcctgaagcagaggctgagggaggcccggatgactgggactcctgtcctcgtggccctcggggacttcctggggggacccctggcccctcacccctaccagggggagcccccgtccatgctcaggtacgaggagatgactgagcgttggttcccgctggccaacaaccttcctcccgacctggtcaatgtcaggggctatgggtctgccatcctggacaactacctcttcatagtgggcgggtacaggatcactagccaggagatctccgctgcgcattcctacaaccccagcaccaacgagtggctccaggtggcctccatgaaccagaagaggtctaacttcaaacttgtggctgttaattcaaaactctatgccatcggagggcaggccgtttctaacgttgagtgttacaaccccgagcaggatgcgtggaattttgtggcgcccttacccaatcctctggctgagttctctgcctgtgagtgtaagggaaaaatttatgtcattggaggatacactaccagagaccggaacatgaacattttgcagtactgcccctcttccgacatgtggacgctctttgaaacatgtgacgtccacattcgcaagcagcagatggtgtctgtggaagagaccatctacatcgtgggggggtgtctccacgagctggggcccaaccgcaggagcagccagagcgaggacatgctcaccgtgcagtcctacaacaccgtcacccgccagtggctctacctcaaggagaacacgtccaaatcgggtcttaacttgacttgtgcgctccataacgacggcatctacatcatgagcagagacgtcaccctgtcgaccagcttggaacaccgagtgttcctcaagtacaacatcttttcagatagttgggaagcatttcggcgttttccagcttttggacataacttgctggtttcttctctttatctgcccaataaagcagaaacatgactgaattgaattggtagatgaaaaaaacctggttcaagttttttttaaaatgtggtgtcccattccaagggagaccaattcctaaagggtaaagaagggttaaagtaggtcacatatatacagtagcagctgtaaataagcttacttgaactaattacttgaaaactggtggaaaaaagagaccaactttgttattttttaaattattgatttttaaattatgggagcaaatccatctccaaacatgatactcttgggccaatgacggatcatcaaaatgtagattcattgtgtctgtgtggtaaagggccaaagtcaataattgggacaaatggtaaagatgattttaaaatctgttgtatttaggtcccttgacatatcattagcaccttaagtgagaggttttctttttcttatcagtgtccttgacaagcattcatattaacatattcattctctcttctccatcacccatacccacacatacatctagtatgtttagggttctgtgttcagatattttgtttgcacactactttttaggaaacttataatgatggagccctacagtgaatccttaccagtgttcagtcctccccaaaacttgcataaaaatattcttagctatttttccagccttttttgcagttacaaatgctggataaatagactgataaaacctcttattttatttatgtggcaggttgcatatttatgtggacacataggttgcactgctaggcattctgtattgttttaaagaggatatattatttagaaaaatggacatatgaatattattaaaaattgagtcttaaatttaaatgggaagggaagaaaacaccaaataagaaaaaaatttgcctttaagagttacttttgttgaatgtatttgacttagttcttattttaaggctaaaaaaactttgtcatatttaagtcggcagctttctaatttaatcttagctttgtaattcatgttttgcttttgtggactaaggtaaggacagcatttaaatatttgtgctggagtgaggggaagaagctgttacagaagtggaatggtttctggtggtatttctgaagttaggtaaagtgctttacttgccttggttgttaattgaaatagaattcagctcaagcagttgttttcagtgagtgagttaacaataaaagcttctgccaatcatagatcaacattcctcaaaaatacatacactcatacttatggaaattttattttgattgaaaacactctgaaattatctgatattttgtaatggcatcagttaaactgtgagctggattccatctttctgcagtaacagcgggcagaaccatttcagttagcatgtgcctcactttaagaaagtcctgtaggggaaaaaaaaaactgtcagagcgaattcatgcattcaacaaacacttatgagtgcctggagtatgccgtccactgtgcagatgtaggacaggggctaatcacttagagttcttcagtttattagaggagtgactacaggttttctttacaaccatggcctctagtatacttaaaataagcgtccagttataaaaagcctatttgcacaactttttgggaatacttctattaactaaaatgaggtaagccattattttggacatagaaacagatctttgtatcttgtcaccaaataatcttacctctagtctacttacaactttgtaagggtttctaagctatgcccatttattcccaaatattaagcccttaaaaaaataaaacctctgaaccaaaatcttcccaggaatagtacttaatagattttaatgttaatttatattcattgtagaattgaatttccagtgacctgtaatttcattacatatattttaaaatctatttattttagatggtgttaacttttcgttgctgaagagcttaactttttaaaggctttgtcctatacatttagaagatgagtcagttgaattagtactggacaaacagttggagattagtttgcaaataagcatatcatatcaaatacaatattccagccaaccagttaattctcttcctggttacattcattgggtctatttgcctaatgttgacaattagattcttggaccaagtgagggtgtactctgatccacaaagctcttttataaaccaggtttgaggttgtgtgtgtgtgtgggggtgtgtgtgtgtgtgtgtgtgtatgtttgcatattatagctctctttaagacagacatctaaaaagattttggttattctgggctgccagcagtacgtgggaaaggtggaatgtgcaataggaacagatctgtgcattttgtgacatcgtccttcctgctgtgcacatcagctgtgatgacattttgagggtagttttaatttagctcggttctcttgttggtgccagtattacattgaagactacctatgatagaggcaatgttgctttgaaaatctcccttcaggcggaggttgcagtgagccgagattgtgccattgcactccagcctgggcgacagtgcaagactctgtctccaaaaaaaaaaaaagaaaaaagaaaatcccccttcatcccccaggactgtcctttactctttgatagtatccctctattttcttcccaattctctaaatgctttatcattttttcctgagatgcttctgagggatgctgacctcccactatggggaaaagggttgcttggaggacctggggtggcagccccccgaccagaagcaccctattttatagatagcagtctgaatggtagagagtcctgtgtgtgggttgttagaaggttggttcttcctgttattctctctggctttcctttcaacccacttattttcagaggcctctccccttagcatcctttaaaaggttttctgatgaatgtgtgaaagagttgattatttcaacagtattggttaagtcacaacgacgaagtgctgagaaggttatgggtaccaggaagaaacaaacagaagtcttaagattagaatgagaaccaaagagaatttaaccctgccatttttttttttttaacaccaagatcctaagtaattccaaatgccttagatatcaatgaaagctacacaccattgagatgggcaaaattctttctctacaaagggagtaatcaagtaaatacctgttctctttcaatggactgttgcctattgagcattgtggatgatgtgttttcagatttccaggtgaagttctgaccctacctgtttggccaaagacgtaaattgagaggaaaggccttggtcttcctgatcaaccagcatttaacgaacagtggcttaatgcagatcactcaagaggcagcatagcaatgtaaaaggaatataagtaggtgttggatgcctttttcctagaccaggaatggggaatatataacacctgtgccaccgctcttttaaggaggcattatgaatgagtgcagcattcctgtcctctgtgccaggatttggtcttagaatccatgtcagattggtgcttccagacatctattcccagtccatcagagtgaaatgaaggctatttgccatccctgccttagacagaggagtgaaagaattaagtgggtagacaccaaccaaaatgactttgaaagcagtgagctgattgagctccagttctgtggttaccagaaatactgagtgtctgtcatgtgcaagacaatgctaagaacagaatacagacataaataagtcacggcccatgaccttgaagagcttacggccttataaagaggttcactgtaattgtcttcaccagggcgtccttctcaaagatgcccacttttgtctggcacattggggctcggtggtctggtggtcccttcggtcttggccctgtccgtcctttgtttttgtgatttactaacaatcatcacgaaccagttttgtttttcttttaaatttgaacatcacatcttgtgttttagttttttgctctatgatttttttctcactgcttttcagtcttctctgtacttcatttttgtgaaaaagtgaaaatcacatataatctttatttaaaaatgctcaccaagcactgcagactttggagttagggattcagcagcttgttccagtgaaaaggaggagtgaagctggggaagttagtatctaagaggggcaagctgattgcatgtgcatttatacctatgcctttaaaacattcccataaaaagtattaataaagaaatttccattccacactagtactgatgaaaaggtggttgattttgccttgtgataattatcaaaggatagtttttcatccttagattttattcacatgagagattttttttattttctctgttgacttaggaacacatcataaattcacaccaactgacacgttgctgacgtctgtacttgacataaccatttttattcatacaggaagcattaaatataaaagatggtcagttttgaagagcaaagggtgctgaaatgacttgtacggttggctggtgctttctcaaatggattgccatagttcattactagtaaagaaaaggaaaatgtgatttacgttgtcatttttcctattaaaaaaaacccttaagaatggggcacttgagctgtccctgcaatgttttcatatctagtagtcattttagggaaagtgataatctgtagaatgaatagttatgttttgatatgactgatactttctttgttaaaaggttgtattaagtcttcaatttcaagtctagcttaaaagtgtaaacattatgtgattcatttgaatacaagaatgcctatgaaatacccactataacagcattccttttgtgtttagaactatagaagaaaatgtcttcaaataaagtagttttcagtca

SEQ ID NO: 4390 - DNA, 2990 bp, Homo sapiens
ccacctcagccccaaccccaaccccagccgcatcccctgccccagctgacgggtcaaagcctcaggagagtgtggctctccccaggcgctaccaggaggggcaggtctcagccagctggggaaaccttattgccatggttcttagaagccaccccttccccaggcaagacaggccccaagggagtgtcccgagggcggttcccgggagccccgtgggtcccagcacttccacacactctgaggacagacacggcccctcttcttcagtggggacagtcatagggacaggtacagggggcctggttgaggctggaggtcagccacagccaagaagctccgagaccaacggatcgcccagcccagaccctcccccaggcctaagaggagagggaaccagggagaaaagtctagacccgctgccccaagccgcgatgcccaggggccccgcacagccccccgcgcagaggccgcctggccccgcggcctcctcctctgcgaggcgctcacagccggtaccccagctacggaaacgcagcaggtgcgaaatcgccccgagctcggagcaggaggtcaggccggccgcctcgggggaccctcaaggggaggcgccgggggaggggggcagccctgccggccgcagcggggcgctcacggaaaagcaggaggaggcccggaagctcatggtgtttctgcagaggcccgggggttggggggtggtggaggggccccggaagcccagctcccgggccctggagcccgccacggcggcagccctgcggcggcggctggacctgggcagttgcctggacgtgctggcctttgcccagcagcacggagagcccggcctggcgcaggagacctacgcgctgatgagcgacaacctgctgcgagtgctgggagacccgtgcctctaccgccggctgagcgcggccgaccgcgagcgcatcctcagcctgcggaccggccggggccgggcggtgctgggcgtcctcgtactgcccagcctctaccaggggggccgctcagggctccccaggggccctcgtggcgaggagcctcctgcggcggcccctgtgtccctgcctctacctgcgcacctgcatgtgttcaacccccgggagaacacctggcggcccctgacccaggtgcccgaggaggccccgcttcggggctgcggtctctgcaccatgcacaactacctgtttctggcggggggcatccgtggctccggtgccaaggccgtctgctccaacgaggtcttctgctacaaccctctgaccaacatctggagccaggttcggcccatgcagcaggcccgagcccagctcaagctggtggccctggacgggctgctctatgccatcggtggcgaatgcctgtacagcatggagtgctacgacccgcgaacagacgcctggaccccacgcgcgccactccccgcaggcaccttccctgtggcccacgaggctgtggcctgccgtggggacatctacgtcaccgggggtcacctcttctaccgcctgctcaggtacagccccgtgaaggatgcttgggacgagtgcccatacagtgccagccaccggcgttccagcgacatcgtggcactggggggcttcctgtaccgcttcgacctgctgcggggcgtgggcgccgccgtgatgcgctacaacacagtgaccggctcctggagcagggctgcctccctgcccctgcccgcccccgccccactgcactgcaccaccctgggcaacaccatttactgcctcaacccccaggtcactgccaccttcacggtctctggggggactgcccagttccaggccaaggagctgcagcccttccccttggggagcaccggggtcctcagtccattcatcctgactctgccccctgaggaccggctgcagacctcactctgagtggcaggcagagaaccaaagctgcttcgctgctctccagggagaccctcctgggatgggcctgagaggccggggctcagggaaggggctgggatcggaacttcctgctcttgtttctggacaactttccccttctgctttaaaggttgtcgattattttgaagcccagactccctcagcctctttctgcccctcactccacacccagactgtttcctgactcaattccgtacctacttacagaccctctcagcttgctgacacccccctgtctgtgggactccctattccctagagccagggactgatgcgtctccacagacaaggacttggctcgctggagctctgctgagccgagagaggagggggtagaaaacattcacacttcctatgctctgtcagcaggacagggagcaaaaacgtccccaggcaacgccctcgcctctgggactttctgcctgtcctaaggcctccccaggtaccaaccccgtagctatctgggtctgtttggcactgtggattctcaagggcctagaacccttgcctctgaaactggtccgctggtgcagccctgctgtctgcagctcctgcccatacccccagcccacaccaggccaggcccactccgggctcaccaccctctgcagccttgtggggctctcccagcccctccagaagcccaccccacttctcgccaacccccgatctctaaatgaggcctgagcgtcaccctagttctgcccctttttagctgtgtagacttggacgagacatttgacttccctttctccttgtctataaaatgtggacagtggacgtctgtcacccaagagagttgtgggagacaagatcacagctatgagcacctcgcacggtgtccaggatgcacagcacaatccatgatgcgttttctccccttacgcactttgaaacccatgctagaaaagtgaatacatctgactgtgctccactccaacctccagcctggatgtccctgtctgggccctttttctgttttttattctatgttcagcaccactggcaccaaatacattttaattcaccgaaagc

SEQ ID NO: 4391 - DNA, 2928 bp, Homo sapiens
ctttgcagctgagactgggtggagggagaggcgcggagacactggggctctgacgagctggctgaggccctctcagtaggggggtcacgcctcctggaactcagggaccccaagtttctgtgcattcagggcggggctggccccatgccctgtgcataggggcctggctgcatcccagtcgatcagccagaggcagcagcagtggactcatcaattgtggaggaagccctggggaccctggggaccttgccgactctattcccagccagctcctaggacaagcctcagagccaacacccgctcgaccctctcccggcccctccccttctttgtcttttgcagatgatcgccgggtgtcgatccttttccctccagtcagggccaggcgtggacgccgccggaccgctgagactcggggcacggtgaagcactggccggggtctggctgggtccggcgctcgggagccagatggaggtggcgataggggccgtgggagccggcgccaagtagccggtggacccccgcgctcgcacctctcccggcgcccgggcgctccccaaggctgccatggaggtgcctaacgtcaaggacttccagtggaagcgcctggcgccactgcccagccgccgggtctactgctccctgctggagaccgggggccaggtctatgccatcgggggatgtgacgacaacggcgtccccatggactgcttcgaggtctactccccggaggccgaccagtggaccgccttgccccggctgcccacagcccgggcgggggtggccgtcaccgccctggggaagcggatcatggtgattgggggcgtgggcaccaatcagctgcccctgaaggtcgtggagatgtacaacatcgatgagggcaagtggaagaagaggagcatgctgcgtgaggccgccatgggcatttctgtcacggccaaagattaccgagtatatgcggcaggcgggatgggcctggacctacgtccacacaaccacctccaacactatgacatgctgaaggacatgtgggtgtccctagcacccatgcccaccccgagatatgctgccacctccttcctccgaggctccaagatctacgtgctggggggacgacagtccaagtacgcggtcaacgctttcgaggtctttgacatcgagactcgctcctggaccaagtttcccaacattccctataagcgggccttctccagctttgtgaccctggacaaccacttgtacagcctaggaggcctgcggcaaggtcgcctctaccggcagcccaagttcctgcggacgatggacgtgttcgacatggaacaggggggatggctgaagatggaacgatcgttcttcctcaagaagcggcgggcagattttgtggctggctctctgagtggacgggtcatagtggctgggggacttgggaatcaacccactgtcctggagacggcggaagcattccacccagggaagaacaaatgggagatcctccctgccatgcccacaccccgctgtgcctgctccagcatagtcgtcaagaactgcctcctcgccgtgggaggtgtcaaccagggtctgagtgacgcagtggaggccctgtgtgtctctgactcctagctgtctctgggctcagtacctttgccctggaccatatcacttcactcttaacatgaggaatgatcttgtccaagcagtcggggctacttccaagaatgtcagctcctgttagcaaccagtggagtctggccttggggctctaagttgacctctctatagctccaaatcctaccaatctcagaaaactgtaagaggcacagatgactccaccagctgcagagctgactctgaagagagtcttcacttactgcacaggcaaagaaaggcacaggaatatttcctacctctccctcctgtgagtcccacctccccccacccccatctccaggaggcaggtagagcagttctgaccgagaggatagactgctgttgctgtctttccccagctctgaactagttttaaggtagcttaggatgaaaaatggagaatgattgggggttccaaaccactttcttctcccttggcttatatctcttcaccatttggtggtcaactgtgggcctaccctggacctcatctactcagcgagaattggacatgaagctagaggcagctgccttggaagggaagtcaggctcacttggacagcccaggccatggcaggaagaatcccttcctcttggggtccttgatgggcatgtgtgatggggaaggagcagtctcccagccctgggtctgctccccacatctctcctaattccacttcaccttttgccaccccctccccaccagaggcctagcccttttgtcaccgaaggcccccagagtgtttctgtgtgaaaccctctcatttacactgtggcatcaaaatccacaaaagatggattaattgcactctggttaatagcagcagcacaatgattaaaatctatattcctatcttctctagcaccctggtgtggggatggggcggaagggtgtcttgaggggcagggaggaccccataaaacaatccctcctgcattctcaggctaaatagggcccccagtgactacctgttcttggctgtcccctctgaagagctctgccttctcacagccaccaccagttgccccactcccaggaaaacagcacatgttcttcttctcctgccttgagactgcgtgttagtcttccattcataactcatcagcagctcagtccttcttatgtctagtctcagttcattcagccaaagctcatttttgtcctatccaaagtagaaagggttcttttagaaaacttgaagaatgtgcctcctcttagcatctgtttctgactcccagttatttttaaaataaatgatgaataaaatgcctgccctgaa

SEQ ID NO: 4392 - DNA, 3177 bp, Homo sapiens
ttctctcccatctggcagaggagtccggctccctaaatcttctttttgttgatgatcgccgggtgtcgatccttttccctccagtcagatgaggacactcagattcaaggacataagtgactggtgcataatcacacagctaggaggtggctgcaccaggattcagatgcagcctgtctgatgctgaccacatggtctgtggggtgctgcagaaagaaaactgcataaagaaggtgatcctggcctcggggagttcctggtgtgtgcctccagccagcgtggtaccctgcagagggcactccgacaaggtgagcgcttccgcggcggggcttctgtacagaggtcacagcacgctgtgtcccgggacgcacgcggattcctgcacaggtgtggtggctgcggatggggacggagcggagcaggctcgccggcctcctccccggcggcggctccgcttctccttcctgctgttcacttcatctcctcatctgcatgtgtgacagcggcgcgcggactggggaaggacagagcgccctctccccggctcccgtgcagcggggcgggggctccgggctccccagtgatgcgtcgtctgcgcctcgccgccgcgctccccgggcctggcagcggccaggcgtggacgccgccggaccgctgagactcggggcacggtgaagcactggccggggtctggctgggtccggcgctcgggagccagatggaggtggcgataggggccgtgggagccggcgccaagtagccggtggacccccgcgctcgcacctctcccggcgcccgggcgctccccaaggctgccatggaggtgcctaacgtcaaggacttccagtggaagcgcctggcgccactgcccagccgccgggtctactgctccctgctggagaccgggggccaggtctatgccatcgggggatgtgacgacaacggcgtccccatggactgcttcgaggtctactccccggaggccgaccagtggaccgccttgccccggctgcccacagcccgggcgggggtggccgtcaccgccctggggaagcggatcatggtgattgggggcgtgggcaccaatcagctgcccctgaaggtcgtggagatgtacaacatcgatgagggcaagtggaagaagaggagcatgctgcgtgaggccgccatgggcatttctgtcacggccaaagattaccgagtatatgcggcaggcgggatgggcctggacctacgtccacacaaccacctccaacactatgacatgctgaaggacatgtgggtgtccctagcacccatgcccaccccgagatatgctgccacctccttcctccgaggctccaagatctacgtgctggggggacgacagtccaagtacgcggtcaacgctttcgaggtctttgacatcgagactcgctcctggaccaagtttcccaacattccctataagcgggccttctccagctttgtgaccctggacaaccacttgtacagcctaggaggcctgcggcaaggtcgcctctaccggcagcccaagttcctgcggacgatggacgtgttcgacatggaacaggggggatggctgaagatggaacgatcgttcttcctcaagaagcggcgggcagattttgtggctggctctctgagtggacgggtcatagtggctgggggacttgggaatcaacccactgtcctggagacggcggaagcattccacccagggaagaacaaatgggagatcctccctgccatgcccacaccccgctgtgcctgctccagcatagtcgtcaagaactgcctcctcgccgtgggaggtgtcaaccagggtctgagtgacgcagtggaggccctgtgtgtctctgactcctagctgtctctgggctcagtacctttgccctggaccatatcacttcactcttaacatgaggaatgatcttgtccaagcagtcggggctacttccaagaatgtcagctcctgttagcaaccagtggagtctggccttggggctctaagttgacctctctatagctccaaatcctaccaatctcagaaaactgtaagaggcacagatgactccaccagctgcagagctgactctgaagagagtcttcacttactgcacaggcaaagaaaggcacaggaatatttcctacctctccctcctgtgagtcccacctccccccacccccatctccaggaggcaggtagagcagttctgaccgagaggatagactgctgttgctgtctttccccagctctgaactagttttaaggtagcttaggatgaaaaatggagaatgattgggggttccaaaccactttcttctcccttggcttatatctcttcaccatttggtggtcaactgtgggcctaccctggacctcatctactcagcgagaattggacatgaagctagaggcagctgccttggaagggaagtcaggctcacttggacagcccaggccatggcaggaagaatcccttcctcttggggtccttgatgggcatgtgtgatggggaaggagcagtctcccagccctgggtctgctccccacatctctcctaattccacttcaccttttgccaccccctccccaccagaggcctagcccttttgtcaccgaaggcccccagagtgtttctgtgtgaaaccctctcatttacactgtggcatcaaaatccacaaaagatggattaattgcactctggttaatagcagcagcacaatgattaaaatctatattcctatcttctctagcaccctggtgtggggatggggcggaagggtgtcttgaggggcagggaggaccccataaaacaatccctcctgcattctcaggctaaatagggcccccagtgactacctgttcttggctgtcccctctgaagagctctgccttctcacagccaccaccagttgccccactcccaggaaaacagcacatgttcttcttctcctgccttgagactgcgtgttagtcttccattcataactcatcagcagctcagtccttcttatgtctagtctcagttcattcagccaaagctcatttttgtcctatccaaagtagaaagggttcttttagaaaacttgaagaatgtgcctcctcttagcatctgtttctgactcccagttatttttaaaataaatgatgaataaaatgcctgccctgaa

SEQ ID NO: 4393 - DNA, 1442 bp, Homo sapiens
attcagggcggggctggccccatgccctgtgcataggggcctggctgcatcccagtcgatcagccagaggcagcagcagtggactcatcaattgtggaggaagccctggggaccctggggaccttgccgactctattcccagccagctcctaggacaagcctcagagccaacacccgctcgaccctctcccggcccctccccttctttgtcttttgcagatgatcgccgggtgtcgatccttttccctccagtcagattaccgagtatatgcggcaggcgggatgggcctggacctacgtccacacaaccacctccaacactatgacatgctgaaggacatgtgggtgtccctagcacccatgcccaccccgagatatgctgccacctccttcctccgaggctccaagatctacgtgctggggggacgacagtccaagtacgcggtcaacgctttcgaggtctttgacatcgagactcgctcctggaccaagtttcccaacattccctataagcgggccttctccagctttgtgaccctggacaaccacttgtacagcctaggaggcctgcggcaaggtcgcctctaccggcagcccaagttcctgcggacgatggacgtgttcgacatggaacaggggggatggctgaagatggaacgatcgttcttcctcaagaagcggcgggcagattttgtggctggctctctgagtggacgggtcatagtggctgggggacttgggaatcaacccactgtcctggagacggcggaagcattccacccagggaagaacaaatgggagatcctccctgccatgcccacaccccgctgtgcctgctccagcatagtcgtcaagaactgcctcctcgccgtgggaggtgtcaaccagggtctgagtgacgcagtggaggccctgtgtgtctctgactcctagctgtctctgggctcagtacctttgccctggaccatatcacttcactcttaacatgaggaatgatcttgtccaagcagtcggggctacttccaagaatgtcagctcctgttagcaaccagtggagtctggccttggggctctaagttgacctctctatagctccaaatcctaccaatctcagaaaactgtaagaggcacagatgactccaccagctgcagagctgactctgaagagagtcttcacttactgcacaggcaaagaaaggcacaggaatatttcctacctctccctcctgtgagtcccacctccccccacccccatctccaggaggcaggtagagcagttctgaccgagaggatagactgctgttgctgtctttccccagctctgaactagttttaaggtagcttaggatgaaaaatggagaatgattgggggttccaaaccactttcttctcccttggcttatatctcttcaccatttggtggtcaactgtgggcctaccct

SEQ ID NO: 4394 - DNA, 2169 bp, Homo sapiens
agtgatgcgtcgtctgcgcctcgccgccgcgctccccgggcctggcagcggccaggcgtggacgccgccggaccgctgagactcggggcacggtgaagcactggccggggtctggctgggtccggcgctcgggagccagatggaggtggcgataggggccgtgggagccggcgccaagtagccggtggacccccgcgctcgcacctctcccggcgcccgggcgctccccaaggctgccatggaggtgcctaacgtcaaggacttccagtggaagcgcctggcgccactgcccagccgccgggtctactgctccctgctggagaccgggggccaggtctatgccatcgggggatgtgacgacaacggcgtccccatggactgcttcgaggtctactccccggaggccgaccagtggaccgccttgccccggctgcccacagcccgggcgggggtggccgtcaccgccctggggaagcggatcatggtgattgggggcgtgggcaccaatcagctgcccctgaaggtcgtggagatgtacaacatcgatgagggcaagtggaagaagaggagcatgctgcgtgaggccgccatgggcatttctgtcacggccaaagattaccgagtatatgcggcaggcgggatgggcctggacctacgtccacacaaccacctccaacactatgacatgctgaaggacatgtgggtgtccctagcacccatgcccaccccgagatatgctgccacctccttcctccgaggctccaagatctacgtgctggggggacgacagtccaagtacgcggtcaacgctttcgaggtctttgacatcgagactcgctcctggaccaagtttcccaacattccctataagcgggccttctccagctttgtgaccctggacaaccacttgtacagcctaggaggcctgcggcaaggtcgcctctaccggcagcccaagttcctgcggacgatggacgtgttcgacatggaacaggggggatggctgaagatggaacgatcgttcttcctcaagaagcggcgggcagattttgtggctggctctctgagtggacgggtcatagtggctgggggacttgggaatcaacccactgtcctggagacggcggaagcattccacccagggaagaacaaatgggagatcctccctgccatgcccacaccccgctgtgcctgctccagcatagtcgtcaagaactgcctcctcgccgtgggaggtgtcaaccagggtctgagtgacgcagtggaggccctgtgtgtctctgactcctagctgtctctgggctcagtacctttgccctggaccatatcacttcactcttaacatgaggaatgatcttgtccaagcagtcggggctacttccaagaatgtcagctcctgttagcaaccagtggagtctggccttggggctctaagttgacctctctatagctccaaatcctaccaatctcagaaaactgtaagaggcacagatgactccaccagctgcagagctgactctgaagagagtcttcacttactgcacaggcaaagaaaggcacaggaatatttcctacctctccctcctgtgagtcccacctccccccacccccatctccaggaggcaggtagagcagttctgaccgagaggatagactgctgttgctgtctttccccagctctgaactagttttaaggtagcttaggatgaaaaatggagaatgattgggggttccaaaccactttcttctcccttggcttatatctcttcaccatttggtggtcaactgtgggcctaccctggacctcatctactcagcgagaattggacatgaagctagaggcagctgccttggaagggaagtcaggctcacttggacagcccaggccatggcaggaagaatcccttcctcttggggtccttgatgggcatgtgtgatggggaaggagcagtctcccagccctgggtctgctccccacatctctcctaattccacttcaccttttgccaccccctccccaccagaggcctagcccttttgtcaccgaaggcccccagagtgtttctgtgtgaaaccctctcatttacactgtggcatcaaaatccacaaaagatggattaattgcactctggttaatagcagcagcacaatgattaaaatctatattcc

SEQ ID NO: 4395 - DNA, 1314 bp, Homo sapiens
cgggacttgaggtgggaaccccggctggcgtccggtagggggaggttcccggggaagcccgcggaaggcgaggtgcctggcctgccatgtaggggctcgttccaagccgcagaccccaccgccctccctctccccggggcccatggcggtggccgtgcccccgggtcgggccgcaggctcaggctgggcctggaggccagtggcgcgggacgcgcttttggctagagctttccattcatgcaccgaactgcggggacggttctatctcgtaggtggtctcctagcaggaggagcgagagagcccagcagcgatacggtggttttcgacccagctaggggccaggccgtacgattgggagcccggggcagccccccgcgcagtcaccacgacgcggcacccgtggacgggcgttggctctgcgtggtgggcggctgggacgggtctcgccgcttggccacagtgaccgcactggacacagagcgcggtgtgtgggaggcgtggacagggacccctggtgactgcccccccgccggcctcagtagtcacacctgcacccgaatctctgaccgagagctgcaggtggctggccgggagggcggtatccacactcagcgacgctatggaagcatctacacattaaggctggaccccagcgcccgcacctattgctacaagcaagaaggctgccacacagcctcacgctcaggtcactgtgcggccctgctccaaactcctggaccccatccaggtcatcagctattgctctttggaggttgcaacttagctgaaccagaagtagctgggcattggagtcatgggaaaattaaggaggaaccacctgttgctcctcatttgatggaacagcttgcaaggcttgtgagcagtgggcaggggtcccagaaggggccccatggactacggcatcactcatgttctgtggtcgggccctttgctgtgctgtttggtggagaaactctgaccagagctagagacaccatctgcaatgatctctacatctatgatactcgcacatctcctcctttgtggttccacttcccctgtgcagatcgtgggatgaaacgcatgggccatcgcacctgcctttggaatgatcagctttacctggttgggggttttggtgaggatggcaggacagccagtccacaggtttgcatcctggactttatctaaatagtgccaagacacatcactaagcctcgttttgttttgctttgttgcaaacctataaagcgttatcaccagagctatctgcttcacttcaaatgcttattaaatttcaatctgagactcaa

SEQ ID NO: 4396 - DNA, 1333 bp, Homo sapiens
cgggacttgaggtgggaaccccggctggcgtccggtagggggaggttcccggggaagcccgcggaaggcgaggtgcctggcctgccatgtaggggctcgttccaagccgcagaccccaccgccctccctctccccggggcccatggcggtggccgtgcccccgggtcgggccgcaggctcaggctgggcctggaggccagtggcgcgggacgcgcttttggctagagctttccattcatgcaccgaactgcggggacggttctatctcgtaggtggtctcctagcaggaggagcgagagagcccagcagcgatacggtggttttcgacccagctaggggccaggccgtacgattgggagcccggggcagccccccgcgcagtcaccacgacgcggcacccgtggacgggcgttggctctgcgtggtgggcggctgggacgggtctcgccgcttggccacagtgaccgcactggacacagagcgcggtgtgtgggaggcgtggacagggacccctggtgactgcccccccgccggcctcagtagtcacacctgcacccgaatctctgaccgagagctgcaggtggctggccgggagggcggtatccacactcagcgacgctatggaagcatctacacattaaggctggaccccagcgcccgcacctattgctacaagcaagaaggctgccacacagcctcacgctcaggtcactgtgcggccctgctccaaactcctggaccccatccaggtcatcagctattgctctttggaggttgcaacttagctgaaccagaagtagctgggcattggagtcatgggaaaattaagtcctttctttctccccaaggaggaaccacctgttgctcctcatttgatggaacagcttgcaaggcttgtgagcagtgggcaggggtcccagaaggggccccatggactacggcatcactcatgttctgtggtcgggccctttgctgtgctgtttggtggagaaactctgaccagagctagagacaccatctgcaatgatctctacatctatgatactcgcacatctcctcctttgtggttccacttcccctgtgcagatcgtgggatgaaacgcatgggccatcgcacctgcctttggaatgatcagctttacctggttgggggttttggtgaggatggcaggacagccagtccacaggtttgcatcctggactttatctaaatagtgccaagacacatcactaagcctcgttttgttttgctttgttgcaaacctataaagcgttatcaccagagctatctgcttcacttcaaatgcttattaaatttcaatctgagactcaa

SEQ ID NO: 4397 - DNA, 6710 bp, Homo sapiens
agcccacccgcctggctgcgcgtcccgggcccggcggctgaagaggagccgcggcgaggaacaagagtgtggtgagaggacgcggaaacacctgatatcccagcaaaggaagctgcagaggaagggtcctgccccgtgagcgaggacagcctccaggagcacagcggcttctcctaacatccccctggcagtgaattacggatgaccccgtatatgaggaggtgtggatgccgacacacggggagagctcctgagaccagcacacaggaccagtgtcctccccgtgaccttgcagttgtgtagccacaagtgggagccacagagaaggagagcccataaggggactcttttcaagacacggtgttaaatcaaggctctgaagttggggccacagccggtctcagctttctgtgttctgggggcgcggtgatatgacagcatgtgaagtgagtgggtgagcacggactcctgagagcgagggcgcacccaatacctggttatctggtactgcagagagacacctagtcagccagcgttgcaaagagggatagctagtcactcaggctgcagagagagacacctggtcacccaggctgcagaaacaaccgcagtcaactgcagctccagtcattgctggatgttggctgacgcggtcctggcgccagctggagatccattcaccaagactttctgggcagatttaaagtggctggggttcagaagttcagcaagtcggacacacccctcctcgctggagaggagagggcaaaggcgaggcgggggagcagcgtgtgagattccccccttcacacacacaacaacaaagcgtggacacacagaagtgaaatctgatcgcgtgccaggaaaagctgtgaggctggaaaccccggagtaaggctcgaccttggccagacctgcaggctgcggaaccgggggcgcgcgggcgcagcgcagcacagcccggccatggagcacgcggtggccccctgcgtcctctacccagggactgagcccggggctgccggggagagcgagagcgagggcgccgcgtccccggcgcagacaccctgcagtctcggcgcgtccctgtgcttcagctccggggaagagtccccgccgcagtccctcgcctcagcggcggaaggcgcggccacctccccgccctccagcggtggcccgcgggtggtggagcggcagtgggaggccggcagcgcgggcgccgcgtccccggaggagctcgcgtcccctgaggagcgcgcgtgcccggaagagcccgcggcgccgtcccccgaaccgcgcgtttggcttgaggaccccgcgtcccccgaggagcccggggagcccgcgcccgtacccccggggttcggggcggtgtacggggagccggacctggtgctggaggtgtcggggcgccggctgcgcgcgcacaaggcggtgctggcggcgcgcagcgactacttccgcgcgcgcgcgtcgcgggacgtgctgcgggtgcagggagtgagcctgacggcgctgcggctgctcctcgccgacgcctacagcgggcgcatggcgggcgtgcggcccgacaacgtggccgaggtggtggccggcgcgcgccgcctgcagctgcccggcgccgcgcagcgcgccaccgacgccgtggggccgcagctgagcctggccaactgctacgaggtcctgagcgcggccaagcggcagcggctgaacgagctgcgcgacgccgcctactgcttcatgagcgaccactatctggaggtgctgcgcgagcccgccgtgttcggccgcctgtcgggcgcagagcgggacctgctgctgcgccgccgcctgcgcgccggccgcgcccacctcttggccgcggcgctcgggccggcgggggagcgcgcgggcagccggcctcagagcccctcgggggacgcggacgcgcgcggggacgcggccgtctactgcttccacgcggcggccggagagtggcgcgagctgacgcggctgcccgagggcgcgccggcgcggggctgcggcctgtgcgtcctctacaactacctcttcgtggcgggcggcgtggcgcccgcgggccccgacggccgcgcgcgcccgtccgaccaggtcttctgctacaacccggccacggacagctggagcgccgtgaggcccctgcgccaggcgcgctcgcagctgcggctgctggccctggacggtcacctctacgccgtgggcggcgagtgcctgctcagcgtggagcgctacgacccgcgcgccgaccgctgggcccccgtggcgccgctgccccggggcgccttcgccgtggcgcatgaggccaccacctgccacggcgagatctacgtgtccgggggctccctcttctatcgcctgctcaagtatgacccgcggcgcgacgagtggcaggagtgcccgtgcagcagcagccgcgagcgctcggccgacatggtggctctcgacggcttcatctaccgcttcgatctgagcggcagccgcggcgaggcgcaggcggcggggccgagcggggtcagcgtgtcccgataccactgcctggccaagcagtggagcccgtgcgtcgcgcccctgcgcctccccggcggccccacgggcctgcagcccttccgctgcgccgccctggacggcgccatctactgcgtgagccgcgcgggcacctggcgcttccagcctgcccgggaaggcgaggccggcggcgacgcaggccagggcggcggcttcgaggcgctgggcgcccccttggacgtccggggtgtgctcatcccgttcgctctcagcctgcctgagaagccgccccgaggggagcagggcgccccgtaggccggcggggtcggcgggcgtctccctcggcaggggtttgcggggcccaggtccctttgggcccgcggaggaggacgtggtggggagtcggggccgctggccacgctggtggtttggacacttcgaaggagccccgaggacgctctcagggccgctttcgctttgctttccttttgcttgtctttgcttctgggggtggatgccttgagacccaggaggtgtgcggatgggtcccttgacagacaggacacagagaaggctgtgggatccaaagggtcagcctcagggtacagtgggggttcctgaggcagcctgcagccggccccggggtgtcccgaaccccgcagagcaccgaggctgtgcgcaggagcctgggaccctcaagtaggtcgccgcgaactatcgggggaagcacgcagagagggtcacgccttttatttttggcttgagatttaaaattataactgataagtaaagctctttctgatttagttgaaaatttcgtaccatgtgctcgctttggttggctcaactccaaaaagagtaatttaataagcattaaaggtaaaatctttgattaccagtaaggtttcttgttcaatatgcattggaagtatttccttccccacaccattgctactcaaactcacatgcctagagcagctccgtctcactgttggaccgagggggctttcatattttcagttgaaaggatgttaactgatgtagcgatgatttaccattatttaaattttaagtcttcagtggctaaatgtgaccaaacagcacatcataagtaggaaaaacttaccagggtgcttgtctatctaaaaagcaatctttgatagtccactctgtatgcccagccgctttcataatctggaacgagataaaatattcctaaaaagcggggaaaatcattttgctttgacagttctataaaaaaaagtgtaggcacattttaaacccactgtatatgatgttttcaatgtggatcgtgtagttctgatgagggagattaatttttacaatcagtattctaagtgtggccgagtgacagtgggcatagatttataacaaggaagtgacgtgcttatcaccatagatttgcaagtaaactgcatgtatttaattgtattgaattgagttccaaaataccctaatagaattaacacgaggctcactgcattgacagggtatgaggattaaaaacaaatcagttgggtcgtttctcatttaacattttacttttcaagtgtgtatacagaggacttactattatgactttgaggatgagatccatgctcacaaatagaggcgaacatttgaactccgaatccaacccattttcttactgtaagaggaaaagttactggaacgtaactagttgaaatcctgcctactttaatattatttgtttgttaatccagtaatgggaactgccatctctgtagaaatcagtgggtaattgaaaaataggttatgctttttaaagagtctgtggttatgagaggtctcagttaagtgtgtttagaagtgatcagcttgaaccttatgcatgactcgggggctggaatttatgatctgggttacggtatgttctggggacgtgtctgcttgcccatggttactcatgaactgaggggatagcttggcaacttggttaatcatcttgggaaagaaaaacagacttcatatcgcctgacttgattggccttttataggagtatactggagaaatggttgtagaaacagtatttacagcaaaaggaaacaaataatgttcattttaagcaatgtaccattcacactgtcctgccttttcctctagaattttattaatggtagaaatttttatatgaaatgggaccaggaccaggctaatattttcagtccttaaatatcaaactcatatgctgttatcactgtgattttacttgtgaaatcattcctgtaatgtttattgtttgaaaatgaaatattgaaattaggcttccagagtaacactgtccccggaaaaggatatgagaagtggtggatgttggatgggggtggttgcacagtcctgtgcggttcccatggctttccagcgtttcatttagtgaaggaatgctcacactagatgtagcacagcttcctgtggggcccggcagcaaagccccaggtgctccctgtcacctcacaacaaaatgcactaagaaacgtaaagaataagaggaattaatacccaccattaaaggatgtccggccaacctattgtggaaatttatagaatagtatacaccacagttctgaatagtgatatcacataaaaatacatactagaggacctgccacgccatgagcagtgtttttgctttttgggggccagtccctggggtgtggagccgctagggtttgcacccatgaaacagagaaaagccacaccctccaaggtgtggctttcattttgggactgctgcagggagggcagaggcattgctgagactgcctggcaacggctgatgccccaggtaggaccttttccaattcaaagtggtgttctaagtctgcgtccaacactgtgtaggaaaaaggttggtgcaaaaatattcctggtcatccacccattaaaatagttagatgaggctattgccttgatgacagctgtccacactcctcatgaaattaacccgtatgccggggcatttccaaatgtctgactcgtgaaattaacccatacgcaggggcctttccaaatgtctgaaaaggcagtggtgtcttttggggaaaatgttatgcatggaagcctgaccttttgcttagttgacagcaatcccttctgtattgccaatcaaggttcatttgagatgcagaggaatgagcttgagccttcctccttttccttccggttttattcttcctcttgggaacatccctccactccgcactgcttcctgcagctttgtagagctggatttggaacttcgggatttggtttctgagtctgtggaggcaccgacttctgctgtaagaaaatgaatgttgtggaaattctttggctacttaactaaaactcgtgactgtataagtttggctacaaataagtaagaaattaatcatctgctctgtttctgctaatttctggtgtcacttcagtaattctggtagcagccgttgaatctgtcagtctcttaggtaacttcctgtaaacgatttggaaataggatgttttcaacgttcttttgtcttttgctgaagtcaggatagattcaagacataatctcttgtaagatctaaatagagcaaatgtaaacaaaagtgcatttttgtattcttgttaattttagatgctttcctagcttacaaaaagttctgtttttgggttaaaaatcaatcaactttctgatatttccccttctgcaatgttattgttcataagaaaacacgagctgaaaatggaaatctgcagttgtttcagttgtcttgaatttctttcagtggccacatcatttccacgttttccacatccgggaggaagcctggactgtgcagccttcgggcacccggcacagacactgtgctggcaggagcttcagacacgccaagtggatggatttggattgaacgcatatgaaacaggagacgggttctcatgtgagatcaaagctcctccaaagcctgttcaagctctaagcgattctcaaatgttaccatttattaaaggtaaactacacctgttgaaggccaagttcagggcagctgttgtgatctgtgtagttaatgtatttattaatgcttgacttttaaaatcctgggcataaatagtgcagagcctcgtatgtttgtcagttcatgccgagatgaaataaatcacgcagaaagtgccagtc

SEQ ID NO: 4398 - DNA, 5727 bp, Homo sapiens
agtagggtacgggacgcgcgcggggagaccctgtgcagcgacaccggggctgtagtcgccgtctggaaccagcgcgggaataggtgcgcaggcgcacagtggctggagggcagcggcggcgtggtctcgggccacttccaagcagagggcagcacctgtcccctcggaggcgctgccagcgccctccctcctcctccgcagggcgcgggacctctatttatatcgcccagccagcacaggcccatattgggcagtggcctcagtcaggcccgctggccgccctgccacacggtagcgtccaagccaggtcgtggcccagcgagtggggacgcgccccgaaccaggcagcaccttcaaatgtttcctgacatctttgtagcttcatgagtaatcagacatgcaaatagcccctcaggaatcaagctacacttaaagaagacttagttggaaactttggagagtagatcatggagtgcaagattgagggaaaagaaaaataccaacatagcttgaatttactgaataaaattcagaacatgaaagaattagcagaaatgattgatgtggtactcacagcagaaggagagaaatttccttgccacagactggtcctggctgcatttagcccttatttcaaagctatgttcacctgtggactacttgaatgtaatcaaagggaagtcatactttatgacatcacagcagaaagtgtgtcggtgttattaaattacatgtacaatgcagctttggagatcaataatgccaatgtacagactgtagctatggctgcctattttatgcagatggaagaagtcttcagtgtgtgtcaaaaatatatgatggaccacatggatgcctccaactgtttaggtatctattattttgcaaagcagattggagctgaagatttatctgatcgatcaaagaaatatttatatcagcactttgccgaggtgagcttacatgaagaaatactagaaatcgaagtgcaccaatttttgacacttattaaatcagatgatcttaacatatccagagaagagagcattctggacttagttctgagatgggtaaatcataacaaagaattgcgtacagtgcatcttgttgagcttttgaagcaagtcagattggaacttgtaaatccttcttttttaagacaagccctaagaaggaacacaatgcttctgtgtgatgcagattgtgttgacataattcaaaatgcattcaaagccatcaagacaccccaacagcactctctaaatctgcgctatggtatggagactaccagtcttctgctttgcattggcaacaattcttcaggaatcagatcaagacataggagctatggggatgccagtttttgttatgatcctgtatcacggaaaacctatttcatctcatctcccaagtacggagagggtttaggaactgtgtgtactggtgttgtcatggaaaataatactataattgtggctggagaagcaagtgcctctaaactctctagacaaaagaacaagaatgttgaaatttataggtatcatgatagaggaaaccagttttgggaaaagttatgcacagctgaatttcgagaactctatgctctgggcagtattcataatgacctttatgttataggaggacagatgaaaattaaaaaccagtatcttattacaaactgtgttgataagtactctgtagaacgggacaattggaaaagggtgtctccccttccactgcaattggcatgtcatgctgtagtgacagtgaataataaactttatgtaattggaggctggacccctcagatggatcttcctgatgaagaacctgatcgattaagcaacaaactgttgcagtatgaccccagccaagatcaatggagtgtgcgggcacccatgaagtactctaagtaccgattcagtacagctgtagtcaacagtgagatttatgttttgggtggcattggctgtgtaggtcaagacaagggccaggttcgaaaatgccttgacgtggtggagatctacaacccagatggggacttttggcgagagggccctcccatgccaagtcccctcctctcactccgcaccaattccaccaatgcaggggcagtggatgggaaactctatgtctgcgggggattccatggagcagatcgccatgaggttatctccaaagaaatattggaactggacccatgggaaaaccagtggaatgttgtagccatcaacgtcctcatgcatgacagctatgatgtctgcctagtagccaggatgaatccccgagacctcatccccccgccttcagatttggtggaagaaggcaatgagcactaaggtgaccttgctggaggacctcctgctgttctgcaaacaaggccttcagaacggagagggcccacagcatctctgtcatgccagtcatgtgcactgcatgcgtagtggcctgtgtgtgaagaagcagtgtgtgctgggcactgggtggggagcatggggagtctcccttcagggacttcccagcctgatagggtaaataagacactacaaagaagaggtgatgacggccacaggaggggcacagggccacaggagagcagcagagggagggtctcactctgctggggacccatgaacagcactgccaaggagcagaccttttattgggtccccaaaaggatgaggaggaagtggtcccatgggtgcagtcaatgatgagttcatggaaacagccaagcaagggcccagagacagaaagctcgtgcctgtctgcagtatcctggctgggccagattgcctggggcacagggtttgtggtcaaggctggaaaagtaggttgtagctagatgaccaacgcctgaaagaatgaggagttggacctggtctgtaagccagggaattgtctcaaaatcgtgcattaagggagacttctctctgtgctctgttccagcttcagtcttataaacactgaccattctccttcagaatccccttctactgaagcaacgccacccagcagcagggctagctgtactaccagcccctaacaaccaaggcactcaagccagaccacagtggccaagaatcctgccctgggctgactctgtccgggacagggatgtggggttctgcagcctggtccactccggggctggcagggagtgtcctggagtgggctgacccaggctgcctttgcccacctctcagacacatacaaccatctgcagggtagtcctggctgaacaggactcgcccaagccacccaagccagggacagagaaggctctggctgaggacaggggaagaagcatctcctccagctgctgccaaccccatggcccggcctttgcaataaagatggagccacccacttcagcccacaattgagcataatcagaagacagtcactcccaaaatatatgttagaaataacatttaaatgacacatgggaagtccgtctatcttacttcccgtctctaattctggaagcacagtggattcaatgagggcatcttcatagctcttcttcagcaacttctccaaagagtttcacattgcacaaggctcttttggaagcaggagtggtcagtaaattcagagggagacaaaccctaagtagagacagctttctttggtgctgagctgtgtgattgtgatgaccgctagcctgtgcccctaggttccagctgcccaccaggcaggacaggcaggtcttgccaaaactggagcctgttggaaacctatttctgccaccaaggagagggaccaggagacccagcgtaggttggccccaagtaggctcaactcgggagggtgggggtcccgcctttctcttcgcacttgtgccccaagtgcactcacagtacctggcatgtgggtgacctcttgggtggccggcatggggcagtgtttctcaatcagagggcctgggccccgagcacgtccaggaatctgagttaaagtgagcttactctttccccagtggatgatcatgatctgtgcattctttttcttgctacaaagatgttcctcctagctgctgtgttggctgtcggcggccagggttgaggacggcctccacagggcctccacttccctccattcctcttcacatagtcactccacctgctccacctgcttgaaaagtccagaaagctgccgcgtctccctggctcaaggaggccttgttggcatgtcatggcacatctcctagatgttttgggttcaagatctgggttccagcccccgctctgctacttagctaaccatgtgaacttgggcaagatgacctttctaaagcctcatttccctcatatgcagagtgggaaggaaaatattaatacatactttatagggttggtatgaggattaagtgctgagcaaagtgcctgtgaaatcctgaaataataagcatgttttagctgccattattatcatcactgtcattatcattgcagtcagcacttcccaaagcaaggtgcccaaaacagactcagtgctttagggaagtggggcagatgtgcatatggcttgtgacggttctttctttttttttttttttttgagacggagtctctctctctcgccaggctggagtgcagtgcagtggcacgatctcagcccactgcaacctccgcctcccaggttcaagtgattctcctgcctcagcctcccaagtagctgggattacaggcgcccaccaccacacccagctaatttttgtatttttagtagagacggggtttcaccatgttggccaggatggtctcaatctcttgacctcgtgatctgcccgcctcggcctcccaaagtgctgggattacaggcatgagcccctgcacctggctgagatggttcttaatttcccataccctgttgcttggctcctccagttggcggctgagagttaagcaagggtttactcggatctgaggcccccgatgccctcaatggacacattcaggaccctgtggcagctcagcagaggcacctgagggtcacgctaggtgagaccatcgcccgcctgtgggaggcaagataagtgggtaaacatcattcctgtctaatgcgaggtctgggcagtgtcccagtggaactttccagagagtgccaagggaggaccgagaaggggcatgacctctgctggagccaggagggcagtgaccaggagctggcttagcactgaagggaagcaggcatcaagggcaggatttctcaaacttcttctgaggaatccccgaggtcgaaaccggtgcttcacagatttcagatgtctgatcttgatttttctttgattccatacaacagattgcttgcctgggttagtgcttattttaagttcttggtgcttcttgtctgacttctgtatttgcaattaaaaacaacatgaccctccccacctgcagccagatatcgttagaaattcaacttcgaaatatattcctatcactcctgttttcactttaatagaaggctgttgcagtactgcatgatgggctcttataaaacttctactatctgctaattcttatctttgtgacaggattgtttgacactgagcaaggaaacacaataaggaagtaatttggatgctaggctggcagaagcctgcagctgtcaaccacagcctgccccagtgtgttcaacacggtggcattgttctccctgacttcataatgagcaaatgtttcacatttgaacttaaggaataaatttttactaataaaa

SEQ ID NO: 4399 - DNA, 5268 bp, Homo sapiens
atcatggagtgcaagattgagggaaaagaaaaataccaacatagcttgaatttactgaataaaattcagaacatgaaagaattagcagaaatgattgatgtggtactcacagcagaaggagagaaatttccttgccacagactggtcctggctgcatttagcccttatttcaaagctatgttcacctgtggactacttgaatgtaatcaaagggaagtcatactttatgacatcacagcagaaagtgtgtcggtgttattaaattacatgtacaatgcagctttggagatcaataatgccaatgtacagactgtagctatggctgcctattttatgcagatggaagaagtcttcagtgtgtgtcaaaaatatatgatggaccacatggatgcctccaactgtttaggtatctattattttgcaaagcagattggagctgaagatttatctgatcgatcaaagaaatatttatatcagcactttgccgaggtgagcttacatgaagaaatactagaaatcgaagtgcaccaatttttgacacttattaaatcagatgatcttaacatatccagagaagagagcattctggacttagttctgagatgggtaaatcataacaaagaattgcgtacagtgcatcttgttgagcttttgaagcaagtcagattggaacttgtaaatccttcttttttaagacaagccctaagaaggaacacaatgcttctgtgtgatgcagattgtgttgacataattcaaaatgcattcaaagccatcaagacaccccaacagcactctctaaatctgcgctatggtatggagactaccagtcttctgctttgcattggcaacaattcttcaggaatcagatcaagacataggagctatggggatgccagtttttgttatgatcctgtatcacggaaaacctatttcatctcatctcccaagtacggagagggtttaggaactgtgtgtactggtgttgtcatggaaaataatactataattgtggctggagaagcaagtgcctctaaactctctagacaaaagaacaagaatgttgaaatttataggtatcatgatagaggaaaccagttttgggaaaagttatgcacagctgaatttcgagaactctatgctctgggcagtattcataatgacctttatgttataggaggacagatgaaaattaaaaaccagtatcttattacaaactgtgttgataagtactctgtagaacgggacaattggaaaagggtgtctccccttccactgcaattggcatgtcatgctgtagtgacagtgaataataaactttatgtaattggaggctggacccctcagatggatcttcctgatgaagaacctgatcgattaagcaacaaactgttgcagtatgaccccagccaagatcaatggagtgtgcgggcacccatgaagtactctaagtaccgattcagtacagctgtagtcaacagtgagatttatgttttgggtggcattggctgtgtaggtcaagacaagggccaggttcgaaaatgccttgacgtggtggagatctacaacccagatggggacttttggcgagagggccctcccatgccaagtcccctcctctcactccgcaccaattccaccaatgcaggggcagtggatgggaaactctatgtctgcgggggattccatggagcagatcgccatgaggttatctccaaagaaatattggaactggacccatgggaaaaccagtggaatgttgtagccatcaacgtcctcatgcatgacagctatgatgtctgcctagtagccaggatgaatccccgagacctcatccccccgccttcagatttggtggaagaaggcaatgagcactaaggtgaccttgctggaggacctcctgctgttctgcaaacaaggccttcagaacggagagggcccacagcatctctgtcatgccagtcatgtgcactgcatgcgtagtggcctgtgtgtgaagaagcagtgtgtgctgggcactgggtggggagcatggggagtctcccttcagggacttcccagcctgatagggtaaataagacactacaaagaagaggtgatgacggccacaggaggggcacagggccacaggagagcagcagagggagggtctcactctgctggggacccatgaacagcactgccaaggagcagaccttttattgggtccccaaaaggatgaggaggaagtggtcccatgggtgcagtcaatgatgagttcatggaaacagccaagcaagggcccagagacagaaagctcgtgcctgtctgcagtatcctggctgggccagattgcctggggcacagggtttgtggtcaaggctggaaaagtaggttgtagctagatgaccaacgcctgaaagaatgaggagttggacctggtctgtaagccagggaattgtctcaaaatcgtgcattaagggagacttctctctgtgctctgttccagcttcagtcttataaacactgaccattctccttcagaatccccttctactgaagcaacgccacccagcagcagggctagctgtactaccagcccctaacaaccaaggcactcaagccagaccacagtggccaagaatcctgccctgggctgactctgtccgggacagggatgtggggttctgcagcctggtccactccggggctggcagggagtgtcctggagtgggctgacccaggctgcctttgcccacctctcagacacatacaaccatctgcagggtagtcctggctgaacaggactcgcccaagccacccaagccagggacagagaaggctctggctgaggacaggggaagaagcatctcctccagctgctgccaaccccatggcccggcctttgcaataaagatggagccacccacttcagcccacaattgagcataatcagaagacagtcactcccaaaatatatgttagaaataacatttaaatgacacatgggaagtccgtctatcttacttcccgtctctaattctggaagcacagtggattcaatgagggcatcttcatagctcttcttcagcaacttctccaaagagtttcacattgcacaaggctcttttggaagcaggagtggtcagtaaattcagagggagacaaaccctaagtagagacagctttctttggtgctgagctgtgtgattgtgatgaccgctagcctgtgcccctaggttccagctgcccaccaggcaggacaggcaggtcttgccaaaactggagcctgttggaaacctatttctgccaccaaggagagggaccaggagacccagcgtaggttggccccaagtaggctcaactcgggagggtgggggtcccgcctttctcttcgcacttgtgccccaagtgcactcacagtacctggcatgtgggtgacctcttgggtggccggcatggggcagtgtttctcaatcagagggcctgggccccgagcacgtccaggaatctgagttaaagtgagcttactctttccccagtggatgatcatgatctgtgcattctttttcttgctacaaagatgttcctcctagctgctgtgttggctgtcggcggccagggttgaggacggcctccacagggcctccacttccctccattcctcttcacatagtcactccacctgctccacctgcttgaaaagtccagaaagctgccgcgtctccctggctcaaggaggccttgttggcatgtcatggcacatctcctagatgttttgggttcaagatctgggttccagcccccgctctgctacttagctaaccatgtgaacttgggcaagatgacctttctaaagcctcatttccctcatatgcagagtgggaaggaaaatattaatacatactttatagggttggtatgaggattaagtgctgagcaaagtgcctgtgaaatcctgaaataataagcatgttttagctgccattattatcatcactgtcattatcattgcagtcagcacttcccaaagcaaggtgcccaaaacagactcagtgctttagggaagtggggcagatgtgcatatggcttgtgacggttctttctttttttttttttttttgagacggagtctctctctctcgccaggctggagtgcagtgcagtggcacgatctcagcccactgcaacctccgcctcccaggttcaagtgattctcctgcctcagcctcccaagtagctgggattacaggcgcccaccaccacacccagctaatttttgtatttttagtagagacggggtttcaccatgttggccaggatggtctcaatctcttgacctcgtgatctgcccgcctcggcctcccaaagtgctgggattacaggcatgagcccctgcacctggctgagatggttcttaatttcccataccctgttgcttggctcctccagttggcggctgagagttaagcaagggtttactcggatctgaggcccccgatgccctcaatggacacattcaggaccctgtggcagctcagcagaggcacctgagggtcacgctaggtgagaccatcgcccgcctgtgggaggcaagataagtgggtaaacatcattcctgtctaatgcgaggtctgggcagtgtcccagtggaactttccagagagtgccaagggaggaccgagaaggggcatgacctctgctggagccaggagggcagtgaccaggagctggcttagcactgaagggaagcaggcatcaagggcaggatttctcaaacttcttctgaggaatccccgaggtcgaaaccggtgcttcacagatttcagatgtctgatcttgatttttctttgattccatacaacagattgcttgcctgggttagtgcttattttaagttcttggtgcttcttgtctgacttctgtatttgcaattaaaaacaacatgaccctccccacctgcagccagatatcgttagaaattcaacttcgaaatatattcctatcactcctgttttcactttaatagaaggctgttgcagtactgcatgatgggctcttataaaacttctactatctgctaattcttatctttgtgacaggattgtttgacactgagcaaggaaacacaataaggaagtaatttggatgctaggctggcagaagcctgcagctgtcaaccacagcctgccccagtgtgttcaacacggtggcattgttctccctgacttcataatgagcaaatgtttcacatttgaacttaaggaataaatttttactaataaaagatca

SEQ ID NO: 4400 - DNA, 3745 bp, Homo sapiens
gcgggggcggcgggggcggcgggcccggcgtctcgcggccccggactgacaaggcggcgcgggcgggcgggcggcgcggctcccgggggaggagtctggcggtggtcgggccctgaggagcgtgcggcggcgcccgcagaggacgctgctttccgcgctggacggaccaagcgagggagggtgcgaggggaaaccggaaggaagaggcggcggcgccagccttcctcggccggaggcggaggcgagaccccaggcgaggccgcggcgggagggccacgcccccgccgccgcgccggaggggcccagtgtggacggggccaccggctggagcggatcccacacctccggaccgagggacgcggttactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaagacgagaggcagatcaatactgaatatgctgtgtcattgttggaacagttgaaactgttttatgaacagcagttgtttactgacatagtgttaattgttgagggcactgaattcccttgtcataagatggttcttgcaacatgtagctcttatttcagggccatgtttatgagtggactaagtgaaagcaaacaaacccatgtacacctgaggaatgtcgatgctgccaccttacagataataataacttatgcatacacgggtaacttggcaatgaatgacagcactgtagaacagctttatgaaacagcttgcttcctacaggtagaagatgtgttacaacgttgtcgagaatatttaattaaaaaaataaatgcagagaattgtgtacgattgttgagttttgctgatctcttcagttgtgaggaattaaaacagagtgctaaaagaatggtggagcacaagttcactgctgtgtatcatcaggacgcgttcatgcagctgtcacatgacctactgatagatattctcagtagtgacaatttaaatgtagaaaaggaagaaaccgttcgagaagctgctatgctgtggctagagtataacacagaatcacgatcccagtatttgtcttctgttcttagccaaatcagaattgatgcactttcagaagtaacacagagagcttggtttcaaggtctgccacccaatgataagtcagtggtggttcaaggtctgtataagtccatgcccaagtttttcaaaccaagacttgggatgactaaagaggaaatgatgattttcattgaagcatcttcagaaaatccttgtagtctttactcttctgtctgttacagcccccaagcagaaaaagtttacaagttatgtagcccaccagctgatttgcataaggttgggaccgttgtaactcctgataatgatatctacatagcagggggtcaagttcctctgaaaaacacaaaaacaaatcacagtaaaacaagcaaacttcagactgccttcagaactgtgaattgcttttattggtttgatgcacagcaaaatacctggtttccaaagaccccaatgctttttgtccgcataaagccatctttggtttgctgtgaaggctatatctatgcaattggaggagatagcgtaggtggagaacttaatcggaggaccgtagaaagatacgacactgagaaagatgagtggacgatggtaagccctttaccttgtgcttggcaatggagtgcagcagttgtggttcatgactgcatttatgtgatgacactgaacctcatgtactgttattttccaaggtctgactcatgggtagaaatggccatgagacagactagtaggtcctttgcttcagctgcagcttttggtgataaaattttctatattggagggttgcatattgctaccaattccggcataagactcccctctggcactgtagatgggtcttcagtaactgtggaaatttatgatgtgaataaaaatgagtggaaaatggcagccaacatccctgctaagaggtactctgacccctgtgttagagctgttgtgatctcaaattctctatgtgtgtttatgcgagaaacccacttaaatgagcgagctaaatacgtcacctaccaatatgacctggaacttgaccggtggtctctgcggcagcatatatctgaacgtgtactgtgggacttggggagagattttcgatgcactgtggggaaactctatccatcctgccttgaagagtctccatggaaaccaccaacttatcttttttcaacggatgggacagaagagtttgaactggatggagaaatggttgcactaccacctgtatagtggggaagttcagggagtgcacgcctgagttatgtgctttgtcattttctttgctaaacaaaagaggctatgaaagaactaaatatgagtacataaaattctatctttgataaattttatttttatgccctacttaatatttgcatcagtataatatatatcagtgagtcttacagaaagatatgcttccataatatgaaatagattattcaataattgagaaactttatgtgtaatcatgagagtataagaatctggattatctaacattgttagccctgtgtatgtacagttcaaaaagttcatttataaaagtagtttcctgttcctagtgtgatgtatcacaaattgtgctgaggttattttagtatgtgtgtttcattcccgtgcttctgttctgaagtcctggaatacagttttcagtgtaattaattcaactgcacttaacactaatgtccgtgttggtatagaaatgtctaaatcctatactctagttgaggaagatcttccataattttatggtattacacagggaaagctatgactgcaggatcagtctaactatactattaggtgcatgtattctcttttcactaacttatacttgtctatctagaatacaggtcttccagtcagctggtcatttaccaggtgtggacttaagttgctaggcttgcagtaagaattgccagccactcattgtgcgggtctgcgtggagctttaatcagaaaaagcctccactttctgtattatgttaacattggctcatgcatataactatctgctgctgatgtagttctccatcttcaagatttagagtgggttaaccaggtcattacatcttaatttaataacaagcattactgtagagtgattgtgtatagatctgttagctgtcagggtgtgttttttttaacctgttgtgtgcgtgtgggggttaggattagtaaggtgaactgttcaggaattctctgcactagctgtgcagaagagcagataactagcgctgctctggcattaatcccaggaaccactagcagtagtggggcgccgccaatctaacatgagcacaggtgcttcatgacaaacattactagcatgttcaactgcaccatgttctggcactgtattttgaatgacattaatttattaaataaattgtatatattcaa

SEQ ID NO: 4401 - DNA, 556 bp, Homo sapiens
aaagactcgcgacgtgttcgcgacatggtgggccgaaggaggacacccccttccttctgtattccccccgcgtacatctgaactaaccaagagaggtctagacgaacagagctcctgttatggtctatatcgacttaaaaaagaaagcagaaactgccctttgaaacggaaaattgtttactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaagacgagaggcagatcaatactgaatatgc

SEQ ID NO: 4402 - DNA, 593 bp, Homo sapiens
gcattgcagcacacaacggaaggcttcagacgctggagctgccgtccgcacccagatgtctctctctcccttttcccctaacctcccccaactgcgggcccttttgggtgctgctctgacttcttccttggccttgggaaaagccgaagcggctctggagagaggagggcatggtttggagaagaggtgctgcggcaacaaagcgacccgcccaacgcctcctcaactttctcctgcccccgttactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaag

SEQ ID NO: 4403 - DNA, 537 bp, Homo sapiens
aattgttttggctttccggtggcatccggcagaggaaaagggcgggggcagctagattactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaagacgagaggcagatcaatactgaatatgctgtgtcattgttggaacagttgaaactgttttatgaacagcagttgtttactgacatagtgttaattgttgagggcactgaattcccttgtcataagatggt

SEQ ID NO: 4404 - DNA, 724 bp, Homo sapiens
attcccagtgtttttctcttttgtaatctttataggtggccaaattacaattctagacaatgagatgtttgtggaagtctgctgagtttgggagatgtagtatcctgagaaagctttcactttcctgaagaaaaaaaagaccatggatggtggaagccaccccctttcccctcttcttgccttgaacaaaggtgcgaaggctaaaactgctgcagccatattgcaaccatgaagtcaatgtcgagagaatcacagaaatgatggccctgctgttcttgagctattgaaccaacaaagttactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaagacgagaggcagatcaatactgaatatgctgtgtcattgttggaacagttgaaactgttttatgaacagcagttgtt

SEQ ID NO: 4405 - DNA, 1047 bp, Homo sapiens
gttcgagaagctgctatgctgtggctagagtataacacagaatcacgatcccagtatttgtcttctgttcttagccaaatcagaattgatgcactttcagaagtaacacagagagcttggtttcaaggtctgccacccaatgataagtcagtggtggttcaaggtctgtataagtccatgcccaagtttttcaaaccaagacttgggatgactaaagaggaaatgatgattttcattgaagcatcttcagaaaatccttgtagtctttactcttctgtctgttacagcccccaagcagaaaaagtttacaagttatgtagcccaccagctgatttgcataaggttgggaccgttgtaactcctgataatgatatctacatagcagggggtcaagttcctctgaaaaacacaaaaacaaatcacagtaaaacaagcaaacttcagactcttcagaactgtgaattgcttttattggatgcacagcaaaatacctccaaagaccccaatgctttttgtccgcataaagccatcttttgctgtgaaggctatatctatgcaattggaggagatagcgtaggtggagaacttaatcggaggaccgtagaaagatacgacactgagaaagatgagtggacgatggtaagccctttaccttgtgcttggcaatggagtgcagcagttgtggttcatgactgcatttatgtgatgacactgaacctcatgtactgttattttccaaggtctgactcatgggtagaaatggccatgagacagactagtaggtcctttgcttcagctgcagcttttggtgataaaattttctatattggagggttgcatattgctaccaattccggcataagactcccctctggcactgtagatgggtcttcagtaactgtggaaatttatgatgtgaataaaaatgagtggaaaatggcagccaacatccctgctaagaggtactctgacccctgtgttagagctgttgtgatctcaaattctctatgtgtgtttatgcgagaaacccacttaaatgagcgagct

SEQ ID NO: 4406 - DNA, 3751 bp, Homo sapiens
agcgaagggcgggaccaaggccaagagcccgacagttacgccactcacacttgcggaagagttaacgggacagcggtgcaggccaatcgcaaccagtcctctggaggcagggagactggggtggagacttcggagactgcagttgcagttctaaggacatatggaattggctatggataattcatatgctttcaatcaacgaagcacatgtaatggaattccatctgagaagaaaaacaacttccttgtatcagaagatcatggacaaaaaatcttaagtgtactacagaattttagagaacaaaatgtcttttatgatttcaaaataattatgaaagatgaaataatcccgtgtcatcgttgtgtgttagcagcatgcagtgactttttcagggctatgtttgaagtaaacatgaaagaaagagatgatggaagtgttaccattactaatttgtcctccaaggcagtaaaagcatttctcgattatgcctatactggaaaaacaaaaataacagatgataatgtggaaatgttcttccagttgtcatcatttcttcaagtttccttcctatccaaagcttgcagtgactttttaataaaaagtattaatcttgtcaattgtttacagttattatctatatcagatagctatggctccaccagtttgtttgatcatgcattacactttgtacaacatcacttttctttattatttaaatccagtgatttcttagagatgaattttggagtactacagaaatgtctggaatcagatgaattaaatgttcctgaagaagaaatggtactgaaagttgtccttagttggactaaacataacttagaatcaaggcaaaagtatctgcctcatttgattgaaaaagtgagattacatcagttatctgaggagacacttcaggactgtctgttcaatgaagagagtttactcaaaagcacaaactgttttgacataatcatggatgcaattaagtgtgtgcaaggttctggtggactcttccctgatgctcgaccatccacaactgagaaatacatattcattcacaaaactgaggaaaatggagaaaatcaatatacattttgctataacattaaatctgattcatggaaaatactgccgcaatcacacctgattgatttgccaggatctagtctttcgagttacggagagaaaatattcttgacaggtggttgcaaagggaaatgttgtcgaacggttcgactgcatattgccgagtcatatcatgatgccactgatcaaacctggtgctactgtccagtgaaaaatgatttcttcttggtatcaactatgaaaacaccaagaaccatgcatacatcagttatggctctcgatagattatttgtcataggtggaaaaactagaggatcccgggacattaaaagtctcttagatgttgaatcttacaatcctctttccaaagaatggatatctgttagcccattacccagaggcatatactatccagaagcaagcacatgccaaaatgtaatttatgttcttggatcagaggtagagattacagatgcttttaacccatcacttgattgcttttttaaatacaatgctacaactgatcagtggtctgaactagtagcagagtttgggcaattttttcatgcaacattaattaaagctgtaccagtaaactgtacactgtatatatgtgacctttccacctataaggtttatagtttttgtccagacacttgtgtttggaaaggcgaaggatcttttgagtgtgcaggctttaatgcaggtgcaattggaattgaagataaaatttatatattaggtggtgattatgcaccagatgaaatcacagatgaagtgcaggtctaccacagcaacaggtctgaatgggaagaagtttcaccaatgcctagagccttaacagaattttactgccaggtgattcagtttaataaatacagagacccatggttttctaatctatgtgcttgaacattctaaaacgagtccagttctagtaacctaaagtaaatttgttaaccaaaatgataggtaaaaagatctatacatcttaatgaaataaaacattcctgcttttagttattatgtatgtacaccatatatgaataaacagtttccaaaaacttaaaatacaaaatatattttaccaaaaattatactgaatataatttaaccttggggaatccagaatacttagtattttcacatgaaactacaaatcatagactctgacactttgatttttaaagtactctgtccataaaagatttgtactgtttagatgggagaaacctctagagagagtaaaaatgaattacactgtatcttatatgaagtaaaaaataaatcagaggtgagaatattgttactgcgggtatgagttgttgaattcctatcatttgtgatgattggttaacttcttttaggtaccctttttacccttttttagttcagaaataattctcccagctttataaatagtacactaaacatagtttaactttttttaatgactcattttttcattaaaagcataatgtaccatgttataatgccattagcagttacttaaatgctttaaaaattgctgattagttttcaatgtcagttggtttcaatttctagctctctctctctctctcctccccccctctcattttctggttcaatcttagtaaattaacattctggatttaattagtagttctaagttacacctggcctgagtttatgttaacatgtaaccctcaattggaaatttttggattctgggatggcagtactaaaatactttttatgtatcattgctaggttccagcctaattaaggacatagaaaattgacctctaattaagtggatcattattatggcatttcttaagctttatccaaatttcagctacataaaacatttcaggatttaaattagtaccatatcaattttctgtgatgatgtataccaactataaagcactatgttggtttactacttcagtaaattattcttagtgaattattttctaaattaaaaaaaatgacttggcttttggtattgataatagtattcacaacctgcatctgttaagatgtttgatctttaacccacacaatgtaagggtactgttgtcattgttctcaggtaggtgattctgccttccaagagtatatgtttctttaatcagtttaaaagataaaggcattttgggttttaagacccctgctttacatctcaggtaatgtgtagattgtacttctctggaaccaaatgtagttttctacactcagttgtaaatgttaatctttctcaaatgtgcacattctttaaaagtgtgttcctaagtagaaatacacctaaatgaagattctcttattttatcatataaatttatgcaacgataagttccaaatgtatttttcaaaacagaatggaatatcagagtacattttcatgaagtttaaaaatcaaggactgttcctgattagatgacgtatttattggtggccttcttatctaagcacatgagtagttggctctgaactttgtgtatttgaaaaaggaaaattcagtggaggcttttgtttgtgtgtgtgtggctttgaaaacaaattatttgagaaagaccataacacagtgagtagcctatatgtgcatttactgaattgttaatttaaggatatatattaatagagtatgtttaaaataaatattgttttcatcactga

SEQ ID NO: 4407 - DNA, 2682 bp, Homo sapiens
agcgcacgccctccatggatggcaccaagcagaaccgtttggcagggaaaaccatacactgaaagcggacctcgccgctatctcgggcctgatggcgcggacgcaaacgtggccccacccccttcttcccggcgtccgtgcgcaggggacgggccgtcgctacgcagactggcccaccgacagccctcccagcccgcccccgactcagccacctcctctcggagaaagcagctgggggcggagacggagatcagccctgcgctttgcggcattgtatgacgtcaagtaggcgaggcttcggaggcgagcgaagggcgggaccaaggccaagagcccgacagttacgccactcacacttgcggaagagttaacgggacagcggtgcaggccaatcgcaaccagtcctctggaggcagggagactggggtggagacttcggagactgcagttgcagttgttccgtgtaggctgttgttgactctcgtatgaaagcccacgcgatccaagtgccctgcaggttttggtccagggaaaagttggtctctgcagatgactgtaaatgactacctggaggtcgattaaagtgcggtactgcgggattcagccgatttccttcttcctctgactgcccggaaatatcagccaaaggccagcgttctaaggacatatggaattggctatggataattcatatgctttcaatcaacgaagcacatgtaatggaattccatctgagaagaaaaacaacttccttgtatcagaagatcatggacaaaaaatcttaagtgtactacagaattttagagaacaaaatgtcttttatgatttcaaaataattatgaaagatgaaataatcccgtgtcatcgttgtgtgttagcagcatgcagtgactttttcagggctatgtttgaagtaaacatgaaagaaagagatgatggaagtgttaccattactaatttgtcctccaaggcagtaaaagcatttctcgattatgcctatactggaaaaacaaaaataacagatgataatgtggaaatgttcttccagttgtcatcatttcttcaagtttccttcctatccaaagcttgcagtgactttttaataaaaagtattaatcttgtcaattgtttacagttattatctatatcagatagctatggctccaccagtttgtttgatcatgcattacactttgtacaacatcacttttctttattatttaaatccagtgatttcttagagatgaattttggagtactacagaaatgtctggaatcagatgaattaaatgttcctgaagaagaaatggtactgaaagttgtccttagttggactaaacataacttagaatcaaggcaaaagtatctgcctcatttgattgaaaaagtgagattacatcagttatctgaggagacacttcaggactgtctgttcaatgaagagagtttactcaaaagcacaaactgttttgacataatcatggatgcaattaagtgtgtgcaaggttctggtggactcttccctgatgctcgaccatccacaactgagaaatacatattcattcacaaaactgaggaaaatggagaaaatcaatatacattttgctataacattaaatctgattcatggaaaatactgccgcaatcacacctgattgatttgccaggatctagtctttcgagttacggagagaaaatattcttgacaggtggttgcaaagggaaatgttgtcgaacggttcgactgcatattgccgagtcatatcatgatgccactgatcaaacctggtgctactgtccagtgaaaaatgatttcttcttggtatcaactatgaaaacaccaagaaccatgcatacatcagttatggctctcgatagattatttgtcataggtggaaaaactagaggatcccgggacattaaaagtctcttagatgttgaatcttacaatcctctttccaaagaatggatatctgttagcccattacccagaggcatatactatccagaagcaagcacatgccaaaatgtaatttatgttcttggatcagaggtagagattacagatgcttttaacccatcacttgattgcttttttaaatacaatgctacaactgatcagtggtctgaactagtagcagagtttgggcaattttttcatgcaacattaattaaagctgtaccagtaaactgtacactgtatatatgtgacctttccacctataaggtttatagtttttgtccagacacttgtgtttggaaaggcgaaggatcttttgagtgtgcaggctttaatgcaggtgcaattggaattgaagataaaatttatatattaggtggtgattatgcaccagatgaaatcacagatgaagtgcaggtctaccacagcaacaggtctgaatgggaagaagtttcaccaatgcctagagccttaacagaattttactgccaggtgattcagtttaataaatacagagacccatggttttctaatctatgtgcttgaacattctaaaacgagtccagttctagtaacctaaagtaaatttgttaaccaaaatgataggtaaaaagatctatacatcttaatgaaataaaacattcctgcttttagttattatgtatgtacaccatatatgaataaacagtttccaaaaacttaaaatacaaaatatattttac

SEQ ID NO: 4408 - DNA, 2331 bp, Homo sapiens
gttccgggctccgggatgaaaggagggaacgcagacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttaatgctctcggtttttggcccgcacagtgcaagtgggaaactgccttcagggcagatcggcacagtgatagctctatacggctgccaagctgtgccaagacccacctggcccagctgcagaatacagaggaatttctccacttgccccaccgcttactcacagatatcatctcggatggagttccgtgttctcagaacccaacagaggcaatagaagcctggatcaactttaataaagaggaaagagaggcttttgcagagtcactcaggacaagcttgaaggaaattggggagaatgtgcacatttacctgattgggaaagagtcatctcgtacccactcgttggctgtgtccttgcactgtgcagaagatgactccatcagtgtaagtggccaaaacagtttgtgccaccagatcactgcggcctgcaagcatggtggagacttgtatgtggtgggagggtccatcccacggcgcatgtggaagtgcaacaatgccaccgttgactgggagtggtgtgctcctttgcctcgggaccggctccagcacaccctggtgtctgtgcccgggaaagatgccatatattcactgggtggcaagacactgcaagataccctctccaacgcagtcatttattatcgcgtaggtgataatgtgtggacagagacaactcagctagaggtggctgtgtcaggggctgctggtgccaacctcaacgggatcatctacttactagggggggaggagaatgatctggacttctttaccaaaccttcccgactcatccagtgctttgacacagagacagacaaatgccatgtgaagccctatgtgctgccctttgcaggccgcatgcacgcagctgtgcataaagatctggtgttcatcgtggctgaaggggactccctggtgtgctacaatcccttgctagacagcttcacccggctttgccttcctgaggcctggagctctgccccatccctctggaagattgccagctgtaacgggagcatctatgtcttccgggaccgatataaaaagggggatgccaacacctacaagcttgaccctgccacttcagccgtaactgtcacaagaggtattaaggtgctgcttaccaatttgcagtttgtgttggcctaaggctgtggggaggggaggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattgttttcttatccatctgtcaggaaatgtaactttggttttatttttggcttattccaaggggtaagccagaaaatagaaatgattatttctgattaatagcagaaactttttcaatctcaaatatataaggtgtctgctcttttaaaagctctaagctaagtcaagagctaggaactgttgatacaaataaaagtttttgaaggg

SEQ ID NO: 4409 - DNA, 2460 bp, Homo sapiens
gaggttccgggctccgggatgaaaggagggaacgcaggtgagaaagcgagacaggcaggtagggaaatcgtgaggtgagcgtggtcctagctccttgtggcagagcctagagagaaggcgaggacgctgaagaaccaggcggacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgatcctgagctctatacggctgccaagcactgtgccaagacccacctggcccagctgcagaatacagaggaatttctccacttgccccaccgcttactcacagatatcatctcggatggagttccgtgttctcagaacccaacagaggcaatagaagcctggatcaactttaataaagaggaaagagaggcttttgcagagtcactcaggacaagcttgaaggaaattggggagaatgtgcacatttacctgattgggaaagagtcatctcgtacccactcgttggctgtgtccttgcactgtgcagaagatgactccatcagtgtaagtggccaaaacagtttgtgccaccagatcactgcggcctgcaagcatggtggagacttgtatgtggtgggagggtccatcccacggcgcatgtggaagtgcaacaatgccaccgttgactgggagtggtgtgctcctttgcctcgggaccggctccagcacaccctggtgtctgtgcccgggaaagatgccatatattcactgggtggcaagacactgcaagataccctctccaacgcagtcatttattatcgcgtaggtgataatgtgtggacagagacaactcagctagaggtggctgtgtcaggggctgctggtgccaacctcaacgggatcatctacttactagggggggaggagaatgatctggacttctttaccaaaccttcccgactcatccagtgctttgacacagagacagacaaatgccatgtgaagccctatgtgctgccctttgcaggccgcatgcacgcagctgtgcataaagatctggtgttcatcgtggctgaaggggactccctggtgtgctacaatcccttgctagacagcttcacccggctttgccttcctgaggcctggagctctgccccatccctctggaagattgccagctgtaacgggagcatctatgtcttccgggaccgatataaaaagggggatgccaacacctacaagcttgaccctgccacttcagccgtaactgtcacaagaggtattaaggtgctgcttaccaatttgcagtttgtgttggcctaaggctgtggggaggggaggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattgttttcttatccatctgtcaggaaatgtaactttggttttatttttggcttattccaaggggtaagccagaaaatagaaatgattatttctgattaatagcagaaactttttcaatctcaaatatataaggtgtctgctcttttaaaagctctaagctaagtcaagagctaggaactgttgatacaaataaaagtttttgaaggg

SEQ ID NO: 4410 - DNA, 2372 bp, Homo sapiens
aagtgtgcagcagatcttcttccgggcggacgtggagccggaagcggaggttccgggctccgggatgaaaggagggaacgcagacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggtggaaggccgggagtttcagctccatcggctggtcctctcagctcagagctgcttcttccgatccatgttcacttccaacctgaaggaggcccacaaccgggtgattgtgctgcaggatgtcagcgagtctgttttccagctcctggttgattatatctaccatgggactgtgaaacttcgagctgaggagttgcaggaaatttatgaggtgtcagacatgtatcagctgacatctctctttgaggaatgctctcggtttttggcccgcacagtgcaagtgggaaactgccttcaggtgatgtggctggcagatcggcacagtgatcctgagctctatacggctgccaagcactgtgccaagacccacctggcccagctgcagaatacagaggaatttctccacttgccccaccgcttactcacagatatcatctcggatggagttccgtgttctcagaacccaacagaggcaatagaagcctggatcaactttaataaagaggaaagagaggcttttgcagagtcactcaggacaagcttgaaggaaattggggagaatgtgcacatttacctgattgggaaagagtcatctcgtacccactcgttggctgtgtccttgcactgtgcagaagatgactccatcagtgtaagtggccaaaacagtttgtgccaccagatcactgcggcctgcaagcatggtggagacttgtatgtggtgggagggtccatcccacggcgcatgtggaagtgcaacaatgccaccgttgactgggagtggtgtgctcctttgcctcgggaccggctccagcacaccctggtgtctgtgcccgggaaagatgccatatattcactgggtggcaagacactgcaagataccctctccaacgcagtcatttattatcgcgtaggtgataatgtgtggacagagacaactcagctagaggtggctgtgtcaggggctgctggtgccaacctcaacgggatcatctacttactagggggggaggagaatgatctggacttctttaccaaaccttcccgactcatccagtgctttgacacagagacagacaaatgccatgtgaagccctatgtgctgccctttgcaggccgcatgcacgcagctgtgcataaagatctggtgttcatcgtggctgaaggggactccctggtgtgctacaatcccttgctagacagcttcacccggctttgccttcctgaggcctggagctctgccccatccctctggaagattgccagctgtaacgggagcatctatgtcttccgggaccgatataaaaagggggatgccaacacctacaagcttgaccctgccacttcagccgtaactgtcacaagaggtattaaggtgctgcttaccaatttgcagtttgtgttggcctaaggctgtggggaggggaggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattgttttcttatccatctgtcaggaaatgtaactttggttttatttttggcttattccaaggggtaagccagaaaatagaaatgattatttctgattaatagcagaaactttttcaatctcaaatatataaggtgtctgctcttttaaaagctctaagctaagtcaagagctaggaac

SEQ ID NO: 4411 - DNA, 2517 bp, Homo sapiens
cctcgaagacagctgctcagtctaagcaaaccccagcaggaaagcaggggtacagagaggagcccccttggcaccgccaccgcaccctaggccacccaccatggcgctgggcttggagcaggcggaggagcagcggttgtaccagcagacgctcctgcaagacgggctcaaagacatgctggaccatggcaagttcctcgactgtgtggtgcgggcgggcgagcgcgagttcccgtgccatcgcctggtgctggccgcctgcagcccctacttccgggcgcgctttctagccgagccggagcgcgcgggcgagctgcacctggaggaggtgtccccggacgtggtggcccaggtgctgcactacctgtacacatcagagatcgcgctggatgaggcgagcgtgcaggatttgttcgccgcggcacaccgcttccagatcccttccatcttcaccatctgcgtgtccttcctgcagaagcgcctgtgcctctccaactgcttggccgtcttccgtctcggcctcctgctcgactgcgcgcgtctcgccgtggctgcccgcgacttcatctgcgctcacttcacgctggtggcgcgcgacgctgacttcctcggactctcggccgacgagctcatcgccatcatctccagcgacggccttaacgtggagaaggaggaggcagtgttcgaggcggtgatgcggtgggcgggtagcggcgacgccgaggcgcaggctgagcgccagcgcgcgctgcccaccgtcttcgagagcgtgcgctgccgcttgctgccgcgcgcctttctggaaagccgcgtggagcgccaccctctcgtgcgtgcccagcccgagttgctgcgcaaggtgcagatggtgaaggatgcacacgagggccgcatcaccacgctgcggaagaaaaagaaggggaaggatggagccggggccaaggaggctgataagggcacaagcaaagccaaagcagaggaggatgaggaggccgaacgtatccttcctgggatcctcaatgacaccctgcgcttcggcatgttcctgcaggatctcatcttcatgatcagtgaggagggcgctgtggcctacgatccagcagccaacgagtgctactgtgcttccctctccaaccaggtccccaagaaccacgtcagcctggttaccaaggagaaccaggtcttcgtggctggaggcctcttctacaacgaagacaacaaagaggaccccatgagcgcatacttcctgcagtttgaccatctggactcagagtggctggggatgccaccgctgccctcgccccgctgcctctttggcctgggagaagctctcaactccatctacgtggtcggtggcagagagatcaaggacggcgagcgctgcctggactcggtcatgtgctacgacaggctgtcattcaaatggggtgaatcggacccgctgccttacgtggtgtatggccacacagtgctctcccacatggaccttgtctacgtaattggcggcaaaggcagtgacaggaagtgcctgaacaagatgtgcgtctatgaccccaagaagtttgagtggaaggagctggcacccatgcagaccgcccgctcactctttggggccactgtccatgatggccgcattatcgtggcagctggggtcaccgacacagggctgaccagttctgccgaagtgtacagcatcacagacaacaagtgggcacccttcgaggccttcccacaggagcgtagctcactcagcctggtcagcctggtgggtaccctctatgccattggtggctttgccacactggagacggagtctggagagctggttcccacagagctcaatgacatctggaggtataacgaggaggagaagaaatgggagggtgtcctgcgggagatcgcctatgcagcaggtgccaccttcctaccagtgcggctcaatgtgctgtgcctgactaagatgtgaccagctcaggcagactgaactaagcacccctcccatcctgcgaccctcactggcctggccttgtgggggctccagaaaagaggctaggagaggccagagtctacctggatccagttatggtgcctcaggggctgcgtcagccaaggaaagggaagtgctgcttagtcctggacttttgggcaagggtgagaaactagaggcttctccagtgttgccatatccccctaggttgtcttgatccatgaaccagaaccacagggcggtatcccaggccgtgtgctggccctgccccagcctagctgagtgtgctggcaaagttccccacaggactcagccttctcgtctttccgatgggagcatccccatcaagtgcagtgtacagtgcagatatgtctccttctttaggaagaataaagtgccttctgagcaagcagctcagggtctgcatcagtgctccaagagtcagtgagcaggtgtgttgaagacttggggcttcagtgttctgctgttgggctgccaaggtcgatggtctctgctctccatctggtgtc

SEQ ID NO: 4412 - DNA, 1399 bp, Homo sapiens
agtctaagcaaaccccagcaggaaagcaggggtacagagaggagcccccttggcaccgccaccgtcttcgagagcgtgcgctgccgcttgctgccgcgcgcctttctggaaagccgcgtggagcgccaccctctcgtgcgtgcccagcccgagttgctgcgcaaggtgcagatggtgaaggatgcacacgagggccgcatcaccacgctgcggaagaaaaagaaggggaaggatggagccggggccaaggaggctgataagggcacaagcaaagccaaagcagaggaggatgaggaggccgaacgtatccttcctgggatcctcaatgacaccctgcgcttcggcatgttcctgcaggatctcatcttcatgatcagtgaggagggcgctgtggcctacgatccagcagccaacgagtgctactgtgcttccctctccaaccaggtccccaagaaccacgtcagcctggttaccaaggagaaccaggtcttcgtggctggaggcctcttctacaacgaagacaacaaagaggaccccatgagcgcatacttcctgcagtttgaccatctggactcagagtggctggggatgccaccgctgccctcgccccgctgcctctttggcctgggagaagctctcaactccatctacgtggtcggtggcagagagatcaaggacggcgagcgctgcctggactcggtcatgtgctacgacaggctgtcattcaaatggggtgaatcggacccgctgccttacgtggtgtatggccacacagtgctctcccacatggaccttgtctacgtaattggcggcaaaggcagtgacaggaagtgcctgaacaagatgtgcgtctatgaccccaagaagtttgagtggaaggagctggcacccatgcagaccgcccgctcactctttggggccactgtccatgatggccgcattatcgtggcagctggggtcaccgacacagggctgaccagttctgccgaagtgtacagcatcacagacaacaagtgggcacccttcgaggccttcccacaggagcgtagctcactcagcctggtcagcctggtgggtaccctctatgccattggtggctttgccacactggagacggagtctggagagctggttcccacagagctcaatgacatctggaggtataacgaggaggagaagaaatgggagggtgtcctgcgggagatcgcctatgcagcaggtgccaccttcctaccagtgcggctcaatgtgctgtgcctgactaagatgtgaccagctcaggcagactgaactaagcacccctcccatcctgcgaccctcactggcctggccttgtgggggctccagaaaagaggctaggagaggccagagtctacctggatccagttatggtgcctca

SEQ ID NO: 4413 - DNA, 5178 bp, Homo sapiens
gtgaaggcgagcagacgcggagaaaggacgcgggagtgagagagggtgagtcagccactgtctaaacgataacgggaggcggttctgcggggtagggttgaattcagtaaatgggctcgtgctgctgtctcttcggagacgctgctatcttagcgtcagcgagggaaggttgaggaggagccagagccgggtcctgcagcgtttctcgccatcagcgcccgtcgccatctccaccatgcagtcccgggaagacgccccgcgctctcgccgcctagccagtccccgtggtgggaagcggcccaagaagattcacaaacccacagtttcggcctttttcacgggtccagaggaattaaaggacacggcccattctgcagccctgctggcacagctcaagtccttctacgatgcgcggctgctgtgtgatgtgaccatcgaggtggtgacgcctggcagcgggcctggcacgggtcgcctgttcccctgcaaccgcaatgtgctggccgcggcatgtccctacttcaagagcatgttcacaggtggcatgtacgagagccagcaggccagcgtgaccatgcacgatgtggacgccgagtccttcgaggtgttggtcgactactgctacacgggtcgtgtgtctctcagtgaggccaacgtggagcgcctgtacgcggcctccgacatgctacagctggaatatgtgcgggaagcctgtgcctccttcttagcccgacgtcttgacctgaccaactgcaccgccatcctcaagtttgcagatgcctttggccatcgcaagctgcgatcccaggcccagtcctatatagctcagaacttcaagcaactcagccacatgggttcaattcgggaggagactctagcagatctgaccctggcccagctgctggctgtcctgcgcttggatagtctggacgtggagagtgagcagacagtgtgccatgtggcagtgcagtggctggaggctgctcccaaagagcggggtcccagtgctgcagaagtcttcaagtgcgtgcgctggatgcacttcactgaagaagatcaggactacttagaagggctgctgaccaagcccatcgtgaagaagtactgcctggacgttattgaaggggccctgcagatgcgctatggtgacctgttgtacaagtctctggtgccagtgccaaacagcagcagcagcagtagcagcagcaactctcttgtatctgcagcagaaaatccaccccagagactgggtatgtgtgccaaggagatggtgatcttctttggacaccccagagatccctttctctgctgtgatccatactcgggggacctttacaaagtgccgtcacctttgacctgtctggctcacactaggactgtcaccactttagctgtctgtatctctcctgaccatgacatctatctagctgctcagcccaggacagacctctgggtgtataaaccagctcagaatagttggcagcaacttgcagatcgcttgctgtgtcgtgagggcatggatgtggcatatctcaatggctatatctacattttgggggggcgagaccctattactggagttaagttgaaggaagtggaatgctacaatgttaagagaaaccagtgggcattggtggctccactgccccattcttttttatcctttgacctaatggtaattcgagactatctctatgctctcaacagtaagcgcatgttctgttatgatcctagccacaatatgtggctgaagtgcgtttctctgaagcgcaatgactttcaggaagcctgcgtcttcaatgaggagatctattgtatctgtgatatcccagtcatgaaggtctacaacccagttagggcagaatggaggcaaatgaataatattcccttggtctcagagaccaacaactacagaattatcaagcatggccaaaaattgttgctcatcacctctcgcaccccacagtggaaaaagaaccgggtgactgtgtatgaatatgatattaggggagaccaatggattaatataggtaccacattaggcctcttgcagtttgattctaactttttttgcctctctgctcgtgtttatccttcctgccttgaacctggtcagagtttcctcactgaagaagaagaaataccaagtgagtctagcactgaatgggacttaggtggattcagtgagccagactctgagtcaggaagttcaagttctctttctgatgatgatttttgggtgcgtgtagcgcctcagtgaaatgcacaggatcaacagggtttgttgtaactagattgaaacactaagttgtttttactgttttggaaaatatcttaaatatcctttttgttcctaaaggagaggaaaagttgattaacttctggtttggtttagaaaaagtaatgtttgaaatacgaaggtaatttaatgttacaaattttaacactcaaatcaaccttttaataattttctgtgctaagggtccagtatttatttgattatttagtatgtttatgtttcatgacactaatttagtcttttgatacattttacattctgtttactgccacaagcactgtggcaataacttttgaattttaatttttataatagaaaaatgattaggaattgctagatagtgttttgaaagcatatctttttcttcagaacaatgtagacttccaaaatggttaacctaaggggtctttacaaaatgtgttataagttaaacataatttgggaagttttacttttgttttcttctatgaagaaaaaaatgcaggctgggcgcggtggctcacgcctgtaatcctagcactttgggaggccgaggcaggtggatcacctgaggtcagttcaagaccagcctggccaacatggtgaaaccccgtctctactaaaaatacaaaaattagctgggcgtggtggcatgcgcctgtaatcccagctacccaggaggctgaggcaggagaattgctgaaacccgggagtcagaggctgcagagagccgagactgggccactgcactccagcctggatgacagagtgagactccgtctcaaaaaaaaaaaaaaaaaaaaaaggaaaaaaaaaaaagaaaaaaaaccatatgtgtattagggtgactgagtggtgacttcatttataataatacagagaatagctataagctcattgacagtaaaaacaacaaaccaggattctactgtttgaaaagaagtttcgttttaattttggaatttagaatgtgtatttgcaaagtcaccaattttcatctaaaaggttatattctagttgtgtcaccaaatcatcaaaaaaccttaaaaaagaagtaacttgctttgtaggtttgtattgttgatctaaacctgatacatgcttcatttaatcaggaataatccttttttttctgctggacatgtataaatttcactggattgtataaatttttatctattgccttaaacatttacatgattctcaatatgttttagctgtacagttttggtgttcatcttagaggattcttcagcagaagtgatatttctttactgttttgtgaggtaatactgattttgaaaatatatataagctaaaaacagtatttcgttgatatcagtagtcattgtgttaactataaagtcaagtgccagcaaagaactttaaaactgtaaagctgtgtatagaactgttttgtgtagcatggaaatattctgtcagctttttaaagtcactaaatgttcttgattatcagcttgaaggtatttttgtattacaagttgacagttgctgggtgtagtggctcatgcctgtaatcctagcaactcggggctgaggtgggaggattgcttcagcccaggagtttgagaccagcctgggcaacatagcaaaaccccatctctacaaaaataaaaaatatgtctgggcatggtggcccaagtctgagtcccagttacttgggaggatcacttgaatgtaggatcacttgagtctaggagttcggggctgcagctatcatctgcagctataatcatagctcactgcagctatgatcatgtctcagcactccagctttggcaacagaacgagatcccatctcttagaaaaacaaagttgatagttaaagaacataagtggatgatggcatttgaggccactagtgaaagtatgttttctctaaaatatttctctaatagtgatataaatggctattttattatgatgtttgtatgtgttttgtatttctctgtaaaccatgctccagtctttgtttttctgttaccataatgtaagagaaggtcctggaacagagactaaatcccacgaaactgacattgttaaacacactaaaacagaagtacttacctcttgaagatttaatatataatggttgacatgatacatgtacatgatgaatgaccagatgcttatggtctacattttcctttatcctgttagtattaccttccttaatctttgttcattaacatgctaattcctcttcagtgtttattttctagtgacagaatgctaacatttcttacaccctggcagaagggagagaaatgtgttttggggtgggtaactaaatttttgagtgaaatatcataagatgagaatggaaagagggagacacaaagagttataacaaaaaaacaatggtttttttagccatttgactggctctttaaatagtctacaagacattcacgtttaacatcacttttagtgaaataaaatgtgccatactagtatgtgcttcaaaagggcaaatgtgctttagtgccctaaggctaaattttggtcatttgacatcagagatgttgtaagtattgcacttaatacgcacctatttctcaatagtgttattttttggctagcattttctttaccactatcttgttgatagctttttgttctctaaggttgaaacatgacagtgcttatctcaaacagattacccatctgcagaactaaggaaagcaatttatgtatgaaagaaattcttgaattcgtcattctcaacctttgaattaaagcttagactaaatagtaatatatcgtgggaaggattttggttttgtgatatttctgtgaattaaggaatagatgttaaccattattttgtagaaaagtgatttgtatgtggttaattataaataaaactggtaccagaa

SEQ ID NO: 4414 - DNA, 2272 bp, Homo sapiens
gtgaaggcgagcagacgcggagaaaggacgcgggagtgagagagggtgagtcagccactgtctaaacgataacgggaggcggttctgcggggtagggttgaattcagtaaatgggctcgtgctgctgtctcttcggagacgctgctatcttagcgtcagcgagggaaggttgaggaggagccagagccgggtcctgcagcgtttctcgccatcagcgcccgtcgccatctccaccatgcagtcccgggaagacgccccgcgctctcgccgcctagccagtccccgtggtgggaagcggcccaagaagattcacaaacccacagtttcggcctttttcacgggtccagaggaattaaaggacacggccagcgtgaccatgcacgatgtggacgccgagtccttcgaggtgttggtcgactactgctacacgggtcgtgtgtctctcagtgaggccaacgtggagcgcctgtacgcggcctccgacatgctacagctggaatatgtgcgggaagcctgtgcctccttcttagcccgacgtcttgacctgaccaactgcaccgccatcctcaagtttgcagatgcctttggccatcgcaagctgcgatcccaggcccagtcctatatagctcagaacttcaagcaactcagccacatgggttcaattcgggaggagactctagcagatctgaccctggcccagctgctggctgtcctgcgcttggatagtctggacgtggagagtgagcagacagtgtgccatgtggcagtgcagtggctggaggctgctcccaaagagcggggtcccagtgctgcagaagtcttcaagtgcgtgcgctggatgcacttcactgaagaagatcaggactacttagaagggctgctgaccaagcccatcgtgaagaagtactgcctggacgttattgaaggggccctgcagatgcgctatggtgacctgttgtacaagtctctggtgccagtgccaaacagcagcagcagcagtagcagcagcaactctcttgtatctgcagcagaaaatccaccccagagactgggtatgtgtgccaaggagatggtgatcttctttggacaccccagagatccctttctctgctgtgatccatactcgggggacctttacaaagtgccgtcacctttgacctgtctggctcacactaggactgtcaccactttagctgtctgtatctctcctgaccatgacatctatctagctgctcagcccaggacagacctctgggtgtataaaccagctcagaatagttggcagcaacttgcagatcgcttgctgtgtcgtgagggcatggatgtggcatatctcaatggctatatctacattttgggggggcgagaccctattactggagttaagttgaaggaagtggaatgctacaatgttaagagaaaccagtgggcattggtggctccactgccccattcttttttatcctttgacctaatggtaattcgagactatctctatgctctcaacagtaagcgcatgttctgttatgatcctagccacaatatgtggctgaagtgcgtttctctgaagcgcaatgactttcaggaagcctgcgtcttcaatgaggagatctattgtatctgtgatatcccagtcatgaaggtctacaacccagttagggcagaatggaggcaaatgaataatattcccttggtctcagagaccaacaactacagaattatcaagcatggccaaaaattgttgctcatcacctctcgcaccccacagtggaaaaagaaccgggtgactgtgtatgaatatgatattaggggagaccaatggattaatataggtaccacattaggcctcttgcagtttgattctaactttttttgcctctctgctcgtgtttatccttcctgccttgaacctggtcagagtttcctcactgaagaagaagaaataccaagtgagtctagcactgaatgggacttaggtggattcagtgagccagactctgagtcaggaagttcaagttctctttctgatgatgatttttgggtgcgtgtagcgcctcagtgaaatgcacaggatcaacagggtttgttgtaactagattgaaacactaagttgtttttactgttttggaaaatatcttaaatatcctttttgttcctaaaggagaggaaaagttgattaacttctggtttggtttagaaaaagtaatgtttgaaatacgaaggtaatttaatgttacaaattttaacactcaaatcaaccttttaataattt

SEQ ID NO: 4415 - DNA, 4734 bp, Homo sapiens
agttctcccgggcgcctagcgggatcgccagcgcggcagtgggggcttccgcggctgcaagccagcgggtcctgtgagggcgagcggaggcggagaaagggcgcgggagtgagagagggtgagtcagccactgtctatgcaataaagggaggcctcaccgcgggatagggctgaattcagaagtgcggcccgtgccgcagtctgttccaggacgcggcttgtcttagcgtcagcgagggaaggttgaggaggagccagagcctggtcctgcagcctttctcgccgtcagcgcccgtcgccatctccaccatgcagtcccgggaagacgtcccgcgctctcgccgcctcgccagtccccgtggtgggaggcggcccaagaggatttccaagccctcggtttcggcctttttcacgggtccagaggagttaaaggacacggcccattctgcagccctgctggcacagctcaagtccttctacgacgcgcggctgctgtgtgatgtgaccatcgaggtggtgacgcctggcagcgggcctggcacgggtcgcctcttttcctgcaatcgcaacgtgctagcagctgcgtgtccctacttcaagagcatgttcacaggtggcatgtacgagagccagcaggccagcgtgaccatgcacgatgtggacgccgagtccttcgaggtgttggtcgactactgctacacgggtcgtgtgtctctcagtgaggccaatgtgcagcgcctgtacgcggcctccgacatgctacagctggaatatgtgcgggaagcctgtgcctccttcttagcccgacgtcttgacctgaccaactgcaccgccatcctcaagtttgcagacgccttcgaccatcacaagcttcgatctcaggcccagtcctacatagctcacaacttcaagcagctcagccgaatgggttcaattcgggaggagactctagcagatctaaccctggcccagctgctggctgtcctacgcctggatagtctggacatagagagtgagcggactgtatgccatgtagctgtgcagtggctggaggctgctgccaaagagcggggtcccagtgctgcagaagtcttcaagtgcgtgcgctggatgcacttcactgaagaagatcaggactacttagaagggctgctgaccaagcccatcgtgaagaagtactgcctggacgttattgaaggggccctgcagatgcgctatggtgacctgttgtacaagtctctggtgccagtgccaaacagcagcagcagcagtagcagcagcaactctcttgtatctgcagcagaaaatccaccccagagactgggtatgtgtgccaaggagatggtgatcttctttggacatcctagagatccctttctctgctatgacccttactcgggggacatttacacaatgccatcccctttgaccagctttgctcacactaagactgtcacctcctcagctgtctgtgtgtccccagaccatgacatctatctagctgctcagcccaggaaagacctctgggtgtataaaccagctcagaatagttggcagcaacttgcagatcgcttgctgtgtcgtgagggcatggatgtggcatatctcaatggctacatctacattttggggggacgagaccctattactggagttaagttgaaggaagtggaatgctacagtgttcagagaaaccagtgggcattggtggctcctgtccctcattccttctattcctttgaactcatagtggttcagaactatctttatgctgtcaacagtaagcgcatgctttgctatgatcctagccacaatatgtggctgaactgtgcttctcttaaacgtagtgactttcaggaagcatgtgtcttcaatgatgaaatctattgtatctgtgacatcccagtcatgaaggtctacaacccagctaggggagaatggaggcggattagtaatattcctttggattcagagacccacaactaccagattgtcaatcatgaccaaaagttgcttctcatcacttctacaaccccacaatggaaaaagaaccgagtgacagtgtatgagtatgatactagggaagatcagtggattaatataggtaccatgttaggccttttgcagtttgactctggctttatttgcctttgtgctcgtgtttatccttcctgccttgaacctggtcagagttttattactgaggaagatgatgcacggagtgagtctagtactgaatgggacttagatggattcagtgagctggactctgagtcaggaagttcaagttctttttcagatgatgaagtctgggtgcaagtagcacctcagcgaaatgcacaggatcagcagggttctttgtaaatagtattttgagacactaagatgtttctactgctacggaatgtattttaaacacatatcgtttctttttcttggaaaaaaagttgattaggaccacagatttggtttagaaagggtaatattttgaaatactacaaggtttagacagtccatgaaatcgacctgtttaataatttaccatcctgaaagtccagaattaaaatatggaagcaagaactatataattgattaggatgcttggtaggtttttttcattgttcaaatattcattgcacagtggattgttttgattagttagtatgctttttttttaattaattcagtcttctgttaatttttaagttttggttagtgccacaaggaatttaactttttgatttgtataatagaaaactgaactaggaattgttagcggggttttgaaggatgtgtactttccttcaaaataaagtggtagattttcaaaattttacactagtcagttctttatattctaagttaaatgtagtttgtaaaattattttggttttcttctacaaaggaaaaaattggatttatatatataaggttactgcataatgatttcattttgataatgtgcagaatggcctcataagctcacagaaagtaaaaaaaaaaaaaaaaaaaaagaaaaaatcaggattccactgttttaaaagaaatctcagtttttattttggaatataaaatgtgtatttggtatatgtgaccaattttctatcccaaaaaacacccattcttagtaatgtcatgaattaaacacccttctaaaccaaaaaaaaaaaaaaaaacggtaacttgctttttatgtttgtgtttttaatttatgcccaatacatgctttactgactcagaggaacaattcctggacatataattgggtaatgcaaatttttatccactggtcatgatttgtcttaaaatgtttacttgcctccctaaaatattttggctgtgtaggtttggtgtttgtcctagaggattcttcaacagaaagtgatttattctttactgttttgtgaggtaatatggtttagaacatatgtataagctaaaaacagtattttactcagatcagtagttatcgtgtctatcagctataaaaaaaatcaactgccagccaagaactttaaaactttaagctgtgtattatagaaccgttttgtgtagcattggaatattgtccattttgtaagtcattgtgaatgttcttaattatcagcttgaaggtatttttgtattaaaagttgacattgaagaacctaagtggatgatgggatttggggccagtagtgaaagtatgtttcctctaaaatatttccctaaacagtggtatacatggttattttattatgagatttgtatatgttctgtgtttctctgtgaacaatgtttcagtctctctgtcaccatatgtaaggggaagtccacaaatatagactacattgcacaaaactaaaattgttaattacaagaaaatataggtgcttaccttttgaaggtttattaatacatatggttgtcacaatacgtatatatgataaatggtgtacatatacagatgtttatggtgtataaatttttctatacccaattagaattatcttcctgattctttattcaataacatgctaattcctcttctatgttctatagtgacagaatgctaacttttcttataccctggcagaggacagaggagtctggtctaggatggggaactgaatttttgaacgaaaaggaaagagaaaggatgaaaaaacaaacaaacaaaaaaacacacgataatgtttcttagtcattttgattggccatttgaacagtctacaagtttaacgttatttccagtgaagtaggatggctgacctagcaatacatgtttcttcaaaagggtaaacatgctttagtgacctaaagctaaattttgtacatttgacatcagggatgttataagtactgcacttaatacaaagctatttctcaattgtgttatttttgagacaaatttttcttcaccattaacttcttgttggtagctttttgttttgtaaaaattgagagatggcaatgcttatctcaaccagattatccatctgcagaattaaggtatgcaactggtaaataaaagacaaatgctccagtttgtctttctcaacctttgagttcttaacctttgagttaaaacctagtctaaatagtgggaatgtcttggtttacagtaaggttttcttgggaaggatcttggttttgtgatctatttgtgaattaaggagtagatgttaaccattattttatagataagtgatttgtacatggttagttataaataaaactggtactagaacccag

SEQ ID NO: 4416 - DNA, 2357 bp, Homo sapiens
aaagggcgcgggagtgagagagggtgagtcagccactgtctatgcaataaagggaggcggcccaagaggagttaaaggacacggcccattctgcagccctgctggcacagctcaagtccttctacgacgcgcggctgctgtgtgatgtgaccatcgaggtggtgacgcctggcagcgggcctggcacgggtcgcctcttttcctgcaatcgcaacgtgctagcagctgcgtgtccctacttcaagagcatgttcacaggtggcatgtacgagagccagcaggccagcgtgaccatgcacgatgtggacgccgagtccttcgaggtgttggtcgactactgctacacgggtcgtgtgtctctcagtgaggccaatgtgcagcgcctgtacgcggcctccgacatgctacagctggaatatgtgcgggaagcctgtgcctccttcttagcccgacgtcttgacctgaccaactgcaccgccatcctcaagtttgcagacgccttcgaccatcacaagcttcgatctcaggcccagtcctacatagctcacaacttcaagcagctcagccgaatgggttcaattcgggaggagactctagcagatctaaccctggcccagctgctggctgtcctacgcctggatagtctggacatagagagtgagcggactgtatgccatgtagctgtgcagtggctggaggctgctgccaaagagcggggtcccagtgctgcagaagtcttcaagtgcgtgcgctggatgcacttcactgaagaagatcaggactacttagaagggctgctgaccaagcccatcgtgaagaagtactgcctggacgttattgaaggggccctgcagatgcgctatggtgacctgttgtacaagtctctggtgccagtgccaaacagcagcagcagcagtagcagcagcaactctcttgtatctgcagcagaaaatccaccccagagactgggtatgtgtgccaaggagatggtgatcttctttggacatcctagagatccctttctctgctatgacccttactcgggggacatttacacaatgccatcccctttgaccagctttgctcacactaagactgtcacctcctcagctgtctgtgtgtccccagaccatgacatctatctagctgctcagcccaggaaagacctctgggtgtataaaccagctcagaatagttggcagcaacttgcagatcgcttgctgtgtcgtgagggcatggatgtggcatatctcaatggctacatctacattttggggggacgagaccctattactggagttaagttgaaggaagtggaatgctacagtgttcagagaaaccagtgggcattggtggctcctgtccctcattccttctattcctttgaactcatagtggttcagaactatctttatgctgtcaacagtaagcgcatgctttgctatgatcctagccacaatatgtggctgaactgtgcttctcttaaacgtagtgactttcaggaagcatgtgtcttcaatgatgaaatctattgtatctgtgacatcccagtcatgaaggtctacaacccagctaggggagaatggaggcggattagtaatattcctttggattcagagacccacaactaccagattgtcaatcatgaccaaaagttgcttctcatcacttctacaaccccacaatggaaaaagaaccgagtgacagtgtatgagtatgatactagggaagatcagtggattaatataggtaccatgttaggccttttgcagtttgactctggctttatttgcctttgtgctcgtgtttatccttcctgccttgaacctggtcagagttttattactgaggaagatgatgcacggagtgagtctagtactgaatgggacttagatggattcagtgagctggactctgagtcaggaagttcaagttctttttcagatgatgaagtctgggtgcaagtagcacctcagcgaaatgcacaggatcagcagggttctttgtaaatagtattttgagacactaagatgtttctactgctacggaatgtattttaaacacatatcgtttctttttcttggaaaaaaagttgattaggaccacagatttggtttagaaagggtaatattttgaaatactacaaggtttagacagtccatgaaatcgacctgtttaataatttaccatcctgaaagtccagaattaaaatatggaagcaagaactatataattgattaggatgcttggtaggtttttttcattgttcaaatattcattgcacagtggattgttttgattagttagtatgctttttttttaattaattcagtcttctgttaatttttaagttttgg

SEQ ID NO: 4417 - DNA, 4684 bp, Homo sapiens
aagcgaaatgacatttcctttttaaatagctggagtcggggccccatcgagaaatggccgcgtcggcagatttaagtaagtcttccccaacaccgaatgggattccatcttcagacccagccagcgatgccatggaccccttccatgcttgcagtattcttaagcaactcaaaacaatgtacgatgaaggacagttgacagacattgtagtggaagtggatcacgggaaaacattttcctgtcatagaaacgttcttgctgcaatcagcccttacttcagatccatgttcactagcggccttacagaaagtactcaaaaagaagttcgaatagttggtgttgaagctgaatcgatggatttagtgttgaactatgcctacacttccagagttattcttacagaggccaatgttcaagccttgttcactgcagctagcatcttccagattccttccatccaagaccaatgtgctaagtatatgatcagtcatttggacccacagaattctattggggtctttatctttgctgatcattatggtcatcaggaactcggagatcgatcaaaagaatacattcgtaaaaagtttctgtgtgtcaccaaagaacaagagtttctccagttgacaaaagaccaactgataagtatactagacagtgacgatttaaatgtagaccgagaagagcatgtttatgaaagcattataaggtggtttgagcatgaacagaatgaaagagaagtgcaccttccagaaatttttgctaaatgcatacgttttcctctgatggaagatacctttatagagaaaattccacctcagtttgcacaggctatagccaaaagctgtgtagaaaagggaccatccaacaccaatggctgtacacagaggcttggaatgactgcttctgaaatgatcatatgttttgatgctgcccacaaacactcaggaaagaagcaaacagtgccttgtctagatatagtcacaggaagggtgtttaaactatgcaaaccaccaaatgacctgagagaagttgggattcttgtatcaccagataatgacatttacattgcaggagggtacaggccaagcagcagtgaggtctccatcgaccataaggcagaaaatgatttctggatgtatgatcattccaccaatagatggctatccaaaccatccttgcttcgagccagaataggctgcaaacttgtctattgctgtggtaaaatgtatgcaatcggaggtcgtgtttatgaaggtgatgggagaaactcactaaaatctgttgagtgctacgacagtagagagaattgttggacgactgtttgcgcgatgccagttgcaatggaatttcataatgctgtggagtacaaagagaagatctatgttttacagggagaattttttctcttctatgagcctcaaaaagactactggggtttcttaacccccatgactgtgcctagaatccagggcttagcagctgtatacaaggactctatctactacatagctggaacctgtggaaatcatcaacgtatgtttactgtagaagcctatgatattgagctaaataaatggactcgtaagaaagactttccatgtgatcagtccataaatccataccttaaactggtacttttccagaacaaactccatttatttgttcgagctactcaagtgactgttgaagaacacgtcttcagaaccagcagaaaaaattccctttaccaatatgatgacattgctgaccagtggatgaaagtgtatgagaccccagatcggctctgggaccttggccggcattttgaatgtgctgttgctaaactgtatcctcagtgtcttcagaaagtactctaaatgagtagcaggccttagtgcatcactggcatctcattcttaggaaacttgtctttgatacaaaagagtgctgacagtatttcagaaagctgagagagttttatacatggaaaatgggtatgcttaaagattgcagggtagggagggattttccttcatccttgtgacatttcatttcagtaaggaaaagataacaaagtgcaattatcagcatttttttttcctggcataaaattaatcatttcattttataattttgtgataaatagtaactgaggtaccagatgaatcaggacaactatgcactcttataagagcatttagggtattattgggtaaagacgtctaaacttgtttgatgtgacttttaattttaaatacgggtaacaatctgaggcaatatcactaggactttagctgtgacctctctaacacagagaagcactaacttagatcctcattcttaatatttatatgtatctatttttgtgtactgttttcaagtgtactgagatttaaatgtgttctattattagagtagatcgaagaaaaaattagtctcagaaagagcttttagtctgattgtttccatttcccatgtaattttaagttaagctaaagttttaaagtggcagttttctgtcgatgactttttcaagtgctaacactgtctcttttgtgaaaatctggaaaagtgctcatattcacaggtggctggtgctagtctaacttaattcatgtgtataactagatggatttaaatggtctgagcctatgcctatctttcaaattggtgtggatttcatggccatagtactttacctgttgaactcttgtgatttcacaagattctctacttatgtgataggagggtatggccagttattcatctaactggactcaatcttagaatagtaggaacattatacccagtttgcactaacatgggccatttgtagcccaaccttctcttccatctacctgtccattcattattggtacaaggaaaggtaacttatttctcttctgcacagagcataatgtgaagttttatacctacttttaaaattctgctttccagaaacaaaattcctgcagtggtctaatttaatgtctttaagtttcatattacaattaaaacctcattttttttttccatttttgcacttaacagtgatgaatacttttacgttggaatcctccttctagctgaaggtgattgaaaaggaaaagagtgagtgaacagaaccatagctttctaggtactaaagcattttttgcatttaactgatgaaatttctaacaatcatcagttaggaatattaacatgaaggataaaccaacttatttgtatacctaaggcaggcatttggatcagtaacatgttttactaagcctagagtaattcgtaaagggtataagcataggacagattttgccctcaatcacaatatttgtattcacttgaaagcaaactggcatggttcgtattttaaaaatcttgcacaaattgtaatgtgatactgtgaaacaaattgaaaacattgcctctttgcatcacatacctcgtttttcagaaactttccaaactgctttacatagacctctacaagtagggaatgttttctgaagcagaagttaaaatggacagcatttctagaattaacattttaaaatctagtcttagctagatatgtggtttcttcttattggtgttgatagtatgtctgtaatctctgtataaactttgtcaacatttttacctccccagttttatcttctgttttgtttttgtttttatcatcatgatgttttggagttattactgtgtattttagaaatcattctttacagttttgcattgctgaggagagagaaaaaacaatttttttgcaagagatgttcatgtaatttatttttgaaagctttgttgaataagatttcctgccgctttttgacaatcttgtgtatttagaaaaatgtattacttgaaaacatgacatagaacattgagttagcaatttacatgggctgtatgttatataagagaatgacatactgtggctaattcaacagtagatttattcttttagcctgcacaacagttgatcttttggctatgacaatttgtatggagggtacgatctaagttaagtgtgtcaaaagcaaggcttaggatttgttatgggagtagaatatatattgaattttgtatgaagaactatttgtttaaattatatagctgggatattttgccactgttaaaatggattcagaagaggtcctagaaaagtaagattagtgacatgtgtgggtttatatttagatatttaaggtgcattttcatagtgtggtaagaccttaagtaaaaggcacaatgggtactacagaattaaaatgtaggtctaacataatgccagttccactttaactttgtttttgcatttgaagaatgtatgtagcactttcctatatatttgtcacacattgaaaactggactgggtataactatgttataggaaagtagaaattgtattctttattttccatctttgttttctgttctacaaagttgatgcttaagcatcaagctgattttattggtcatgagaacaaatggatgtgatcatgaaggaatcagattccctatgtaaagcagtttaaaatggaattcaatgttcagtgctcaggtatgtagtaagtactgtagtcctgtgggggcaaatgtgtagatatttttaaacattttgccataattgcacaattttttgcatttttacctgatgtcattgtttcttataataaaaccttttctgattgaaaa

SEQ ID NO: 4418 - DNA, 4680 bp, Homo sapiens
gaaatgacatttcctttttaaatagctggagtcggggccccatcgagaaatggccgcgtcggcagatttaagtaagtcttccccaacaccgaatgggattccatcttcagacccagccagcgatgccatggaccccttccatgcttgcagtattcttaagcaactcaaaacaatgtacgatgaaggacagttgacagacattgtagtggaagtggatcacgggaaaacattttcctgtcatagaaacgttcttgctgcaatcagcccttacttcagatccatgttcactagcggccttacagaaagtactcaaaaagaagttcgaatagttggtgttgaagctgaatcgatggatttagtgttgaactatgcctacacttccagagttattcttacagaggccaatgttcaagccttgttcactgcagctagcatcttccagattccttccatccaagaccaatgtgctaagtatatgatcagtcatttggacccacagaattctattggggtctttatctttgctgatcattatggtcatcaggaactcggagatcgatcaaaagaatacattcgtaaaaagtttctgtgtgtcaccaaagaacaagagtttctccagttgacaaaagaccaactgataagtatactagacagtgacgatttaaatgtagaccgagaagagcatgtttatgaaagcattataaggtggtttgagcatgaacagaatgaaagagaagtgcaccttccagaaatttttgctaaatgcatacgttttcctctgatggaagatacctttatagagaaaattccacctcagtttgcacaggctatagccaaaagctgtgtagaaaagggaccatccaacaccaatggctgtacacagaggcttggaatgactgcttctgaaatgatcatatgttttgatgctgcccacaaacactcaggaaagaagcaaacagtgccttgtctagatatagtcacaggaagggtgtttaaactatgcaaaccaccaaatgacctgagagaagttgggattcttgtatcaccagataatgacatttacattgcaggagggtacaggccaagcagcagtgaggtctccatcgaccataaggcagaaaatgatttctggatgtatgatcattccaccaatagatggctatccaaaccatccttgcttcgagccagaataggctgcaaacttgtctattgctgtggtaaaatgtatgcaatcggaggtcgtgtttatgaaggtgatgggagaaactcactaaaatctgttgagtgctacgacagtagagagaattgttggacgactgtttgcgcgatgccagttgcaatggaatttcataatgctgtggagtacaaagagaagatctatgttttacagggagaattttttctcttctatgagcctcaaaaagactactggggtttcttaacccccatgactgtgcctagaatccagggcttagcagctgtatacaaggactctatctactacatagctggaacctgtggaaatcatcaacgtatgtttactgtagaagcctatgatattgagctaaataaatggactcgtaagaaagactttccatgtgatcagtccataaatccataccttaaactggtacttttccagaacaaactccatttatttgttcgagctactcaagtgactgttgaagaacacgtcttcagaaccagcagaaaaaattccctttaccaatatgatgacattgctgaccagtggatgaaagtgtatgagaccccagatcggctctgggaccttggccggcattttgaatgtgctgttgctaaactgtatcctcagtgtcttcagaaagtactctaaatgagtagcaggccttagtgcatcactggcatctcattcttaggaaacttgtctttgatacaaaagagtgctgacagtatttcagaaagctgagagagttttatacatggaaaatgggtatgcttaaagattgcagggtagggagggattttccttcatccttgtgacatttcatttcagtaaggaaaagataacaaagtgcaattatcagcatttttttttcctggcataaaattaatcatttcattttataattttgtgataaatagtaactgaggtaccagatgaatcaggacaactatgcactcttataagagcatttagggtattattgggtaaagacgtctaaacttgtttgatgtgacttttaattttaaatacgggtaacaatctgaggcaatatcactaggactttagctgtgacctctctaacacagagaagcactaacttagatcctcattcttaatatttatatgtatctatttttgtgtactgttttcaagtgtactgagatttaaatgtgttctattattagagtagatcgaagaaaaaattagtctcagaaagagcttttagtctgattgtttccatttcccatgtaattttaagttaagctaaagttttaaagtggcagttttctgtcgatgactttttcaagtgctaacactgtctcttttgtgaaaatctggaaaagtgctcatattcacaggtggctggtgctagtctaacttaattcatgtgtataactagatggatttaaatggtctgagcctatgcctatctttcaaattggtgtggatttcatggccatagtactttacctgttgaactcttgtgatttcacaagattctctacttatgtgataggagggtatggccagttattcatctaactggactcaatcttagaatagtaggaacattatacccagtttgcactaacatgggccatttgtagcccaaccttctcttccatctacctgtccattcattattggtacaaggaaaggtaacttatttctcttctgcacagagcataatgtgaagttttatacctacttttaaaattctgctttccagaaacaaaattcctgcagtggtctaatttaatgtctttaagtttcatattacaattaaaacctcattttttttttccatttttgcacttaacagtgatgaatacttttacgttggaatcctccttctagctgaaggtgattgaaaaggaaaagagtgagtgaacagaaccatagctttctaggtactaaagcattttttgcatttaactgatgaaatttctaacaatcatcagttaggaatattaacatgaaggataaaccaacttatttgtatacctaaggcaggcatttggatcagtaacatgttttactaagcctagagtaattcgtaaagggtataagcataggacagattttgccctcaatcacaatatttgtattcacttgaaagcaaactggcatggttcgtattttaaaaatcttgcacaaattgtaatgtgatactgtgaaacaaattgaaaacattgcctctttgcatcacatacctcgtttttcagaaactttccaaactgctttacatagacctctacaagtagggaatgttttctgaagcagaagttaaaatggacagcatttctagaattaacattttaaaatctagtcttagctagatatgtggtttcttcttattggtgttgatagtatgtctgtaatctctgtataaactttgtcaacatttttacctccccagttttatcttctgttttgtttttgtttttatcatcatgatgttttggagttattactgtgtattttagaaatcattctttacagttttgcattgctgaggagagagaaaaaacaatttttttgcaagagatgttcatgtaatttatttttgaaagctttgttgaataagatttcctgccgctttttgacaatcttgtgtatttagaaaaatgtattacttgaaaacatgacatagaacattgagttagcaatttacatgggctgtatgttatataagagaatgacatactgtggctaattcaacagtagatttattcttttagcctgcacaacagttgatcttttggctatgacaatttgtatggagggtacgatctaagttaagtgtgtcaaaagcaaggcttaggatttgttatgggagtagaatatatattgaattttgtatgaagaactatttgtttaaattatatagctgggatattttgccactgttaaaatggattcagaagaggtcctagaaaagtaagattagtgacatgtgtgggtttatatttagatatttaaggtgcattttcatagtgtggtaagaccttaagtaaaaggcacaatgggtactacagaattaaaatgtaggtctaacataatgccagttccactttaactttgtttttgcatttgaagaatgtatgtagcactttcctatatatttgtcacacattgaaaactggactgggtataactatgttataggaaagtagaaattgtattctttattttccatctttgttttctgttctacaaagttgatgcttaagcatcaagctgattttattggtcatgagaacaaatggatgtgatcatgaaggaatcagattccctatgtaaagcagtttaaaatggaattcaatgttcagtgctcaggtatgtagtaagtactgtagtcctgtgggggcaaatgtgtagatatttttaaacattttgccataattgcacaattttttgcatttttacctgatgtcattgtttcttataataaaaccttttctgattgaaaa

SEQ ID NO: 4419 - DNA, 1033 bp, Homo sapiens
gcagagtatatactgaggtctgtggatcctaaggctcagaggattctcgccgcagcgttgttcggcccgaaaaggccattgtggacaatggacgtgaataaatttgaggcctctgtgggttttctcgatgtcaaaaagttcctcagtacctggaagttgcagaatccaaggacccattttgttctttctccgcactgctttatgggaggcattatggcccccaaagacataatgacaaatactcatgctaaatccatcctcaattcaatgaactccctcaggaagagcaataccctctgtgatgtgacattgagagtagagcagaaagacttccctgcccatcggattgtgctggctgcctgtagtgattacttctgtgccatgttcactagtgagctctcagagaaggggaaaccttatgttgacatccaaggtttgactgcctctaccatggaaattttattggactttgtgtacacagaaacagtacatgtgacagtggagaatgtacaagaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgatgcaagcagctgaggtttttagccagaagcattttcctgaagtggtacagcatgaagagttcattcttctgagtcaaggagaggtggaaaagctaatcaagtgcgacgaaattcaggtggattctgaagagccagtctttgaggctgtcatcaactgggtgaagcatgccaagaaagagcgggaagaatccttgcctaacctgctacagtatgtgcggatgcccctactaacccccaggtatatcacagatgtaatagatgctgagcctttcatccgctgtagtttacaatgcagggatctggttgatgaagcaaagaagtttcatctgaggcctgaacttcggagtcagatgcagggacccaggacaagggctcgcctag

SEQ ID NO: 4420 - DNA, 2257 bp, Homo sapiens
tccccagtgcctaactctgctgtctgctatatttcagcctttcatccgctgtagtttacaatgcagggatctggttgatgaagcaaagaagtttcatctgaggcctgaacttcggagtcagatgcagggacccaggacaagggctcgcctaggagccaatgaagtgcttttggtggttgggggctttggaagccagcagtctcccattgatgtggtagagaaatatgaccccaagactcaggagtggagctttttgccaagcatcactcgtaagagacgttatgtggcctcagtgtcccttcatgaccggatctacgtcattggtggctatgatggccgttcccgccttagttcagtggaatgtctagactacacagcagatgaggatggggtctggtattctgtggcccctatgaatgtccgacgaggtcttgctggagccaccaccctgggagatatgatctatgtctctggaggctttgatggaagcaggcgtcacaccagtatggagcgctatgatccaaacattgaccagtggagcatgctgggagatatgcagacagcccgggaaggtgccggactcgtagtggccagtggagtgatctactgtctaggaggatatgacggcttgaatatcttaaattcagttgagaaatacgaccctcatacaggacattggactaatgttacaccaatggccaccaagcgttctgatatgatggtaattccctgctaagtagcattgaatgttatgaccctatcatcgacagctgggaagtcgtgacatccatgggaacccagcgctgtgatgctggtgtttgtgttctccgcgagaagtgaccattgttggagcaccatccagagctagtgaccagtccagtggacagttagtgggagaatcaaaaatcctttccagaatgtctgtttctcactatgtgcaccgggtgattacaggcaccagtgcagtgatgattgtacttatttgacacatactccccgtcgtcctggttcttgttcctgagaagggtgggtaacagatattccaggaaaaagaatgcacattgaatggatgtgagagaccacattgcctctcccactgctttggggagcactttcctgtcatttctaacttaccacatgcttggtgtactatatgtatgttgtgcctcatatgttgcaaagaactaaggtgagtatagcctactagatatgggcaatatccagcctagatgattggaaagataccagtttaagtaaacttggtaaaatccaagtctttttttttttttccaggaacaactacattttctcatatacaggtagctaggggcaacacagttccattctagagggaaacaaaagggagagccccacaaaactttggggacaagggagagagagactcatctgacacttcttttggaggtcaggatttgtatatcagaattgaagttagaattaagtgaattaaactgaatttgattgtgagtgaacctagaacagcactgaagtattacataacctggaagactgagaagggtatattatttgaaggatctttttatttccccgaggtctttcgcactggagacagcataaaagagtgaacaaatgttgggatgagagaagatgacatcaatgtgggagttcagtataactggggataaactagaagaacctgtgattttacagtcatcttattacctgccagggctcatctagccatggcaatgtttgccttgaatgggggtgaaagcctttctttgttggatcaaatactactacactattacacttccacactatttatttggggatgggctgggagtgacagtagcctagtagttcagctacctgattactgccccattcttttagaagcacatgtctgccaaggagtggtttgtactgctgtgtttggtacatctagtcttttttctgctataagttttccttacctgtcctttagtgtagattttattcatcacaggacagaataatcaaggacaaccaaaatccttttgttagtttcagtacctcagctatcaacatttctgagctaccattcaatgttcctctgtgtcatggagtgaaattcttgttttgtgggtattaggagtgtgggaatgtgataacctaaacaacctttgctctgaaattccatttttccctctttccctgagttgtattgacctacagagttaatttcctttgtatttttttaagaaaatattaaaaatcaacggtctcaaatgcc

SEQ ID NO: 4421 - DNA, 3359 bp, Homo sapiens
gtcatcacgtcgcgcggccgcaggggccagacccggacggctccagagcctccagagcctccgggtctgggcggcgcttcggctcctcccgagccgcctgctagccccgcgccgcactccatccccacaggctggggacgggcccggtgcggctgtgtgggttcgggagcggagttgcagaatccaaggacccattttgttctttctccgcactgctttatgggaggcattatggcccccaaagacataatgacaaatactcatgctaaatccatcctcaattcaatgaactccctcaggaagagcaataccctctgtgatgtgacattgagagtagagcagaaagacttccctgcccatcggattgtgctggctgcctgtagtgattacttctgtgccatgttcactagtgagctctcagagaaggggaaaccttatgttgacatccaaggtttgactgcctctaccatggaaattttattggactttgtgtacacagaaacagtacatgtgacagtggagaatgtacaagaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgatgcaagcagctgaggtttttagccagaagcattttcctgaagtggtacagcatgaagagttcattcttctgagtcaaggagaggtggaaaagctaatcaagtgcgacgaaattcaggtggattctgaagagccagtctttgaggctgtcatcaactgggtgaagcatgccaagaaagagcgggaagaatccttgcctaacctgctacagtatgtgcggatgcccctactaacccccaggtatatcacagatgtaatagatgctgagcctttcatccgctgtagtttacaatgcagggatctggttgatgaagcaaagaagtttcatctgaggcctgaacttcggagtcagatgcagggacccaggacaagggctcgcctaggagccaatgaagtgcttttggtggttgggggctttggaagccagcagtctcccattgatgtggtagagaaatatgaccccaagactcaggagtggagctttttgccaagcatcactcgtaagagacgttatgtggcctcagtgtcccttcatgaccggatctacgtcattggtggctatgatggccgttcccgccttagttcagtggaatgtctagactacacagcagatgaggatggggtctggtattctgtggcccctatgaatgtccgacgaggtcttgctggagccaccaccctgggagatatgatctatgtctctggaggctttgatggaagcaggcgtcacaccagtatggagcgctatgatccaaacattgaccagtggagcatgctgggagatatgcagacagcccgggaaggtgccggactcgtagtggccagtggagtgatctactgtctaggaggatatgacggcttgaatatcttaaattcagttgagaaatacgaccctcatacaggacattggactaatgttacaccaatggccaccaagcgttctggtgcaggagtagccctgctgaatgaccatatttatgtggtggggggatttgatggtacagcccacctttcttccgttgaagcatacaacattcgcactgattcctggacaactgtcaccagtatgaccactccacgatgctatgtaggggccacagtgcttcgggggagactctatgcaattgcaggatatgatggtaattccctgctaagtagcattgaatgttatgaccctatcatcgacagctgggaagtcgtgacatccatgggaacccagcgctgtgatgctggtgtttgtgttctccgcgagaagtgaccattgttggagcaccatccagagctagtgaccagtccagtggacagttagtgggagaatcaaaaatcctttccagaatgtctgtttctcactatgtgcaccgggtgattacaggcaccagtgcagtgatgattgtacttatttgacacatactccccgtcgtcctggttcttgttcctgagaagggtgggtaacagatattccaggaaaaagaatgcacattgaatggatgtgagagaccacattgcctctcccactgctttggggagcactttcctgtcatttctaacttaccacatgcttggtgtactatatgtatgttgtgcctcatatgttgcaaagaactaaggtgagtatagcctactagatatgggcaatatccagcctagatgattggaaagataccagtttaagtaaacttggtaaaatccaagtctttttttttttttccaggaacaactacattttctcatatacaggtagctaggggcaacacagttccattctagagggaaacaaaagggagagccccacaaaactttggggacaagggagagagagactcatctgacacttcttttggaggtcaggatttgtatatcagaattgaagttagaattaagtgaattaaactgaatttgattgtgagtgaacctagaacagcactgaagtattacataacctggaagactgagaagggtatattatttgaaggatctttttatttccccgaggtctttcgcactggagacagcataaaagagtgaacaaatgttgggatgagagaagatgacatcaatgtgggagttcagtataactggggataaactagaagaacctgtgattttacagtcatcttattacctgccagggctcatctagccatggcaatgtttgccttgaatgggggtgaaagcctttctttgttggatcaaatactactacactattacacttccacactatttatttggggatgggctgggagtgacagtagcctagtagttcagctacctgattactgccccattcttttagaagcacatgtctgccaaggagtggtttgtactgctgtgtttggtacatctagtcttttttctgctataagttttccttacctgtcctttagtgtagattttattcatcacaggacagaataatcaaggacaaccaaaatccttttgttagtttcagtacctcagctatcaacatttctgagctaccattcaatgttcctctgtgtcatggagtgaaattcttgttttgtgggtattaggagtgtgggaatgtgataacctaaacaacctttgctctgaaattccatttttccctctttccctgagttgtattgacctacagagttaatttcctttgtatttttttaagaaaatattaaaaatcaacggtctcaaatgccgagagtttgtggctaa

SEQ ID NO: 4422 - DNA, 1999 bp, Homo sapiens
agaggattctcgccgcagcgttgttcggcccgaaaaggccattgtggacaatggacgtgaataaatttgaggcctctgtgggttttctcgatgtcaaaaagttcctcagtacctggaagttgcagaatccaaggacccattttgttctttctccgcactgctttatgggaggcattatggcccccaaagacataatgacaaatactcatgctaaatccatcctcaattcaatgaactccctcaggaagagcaataccctctgtgatgtgacattgagagtagagcagaaagacttccctgcccatcggattgtgctggctgcctgtagtgattacttctgtgccatgttcactagtgagctctcagagaaggggaaaccttatgttgacatccaaggtttgactgcctctaccatggaaattttattggactttgtgtacacagaaacagtacatgtgacagtggagaatgtacaagaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgatgcaagcagctgaggtttttagccagaagcattttcctgaagtggtacagcatgaagagttcattcttctgagtcaaggagaggtggaaaagctaatcaagtgcgacgaaattcaggtggattctgaagagccagtctttgaggctgtcatcaactgggtgaagcatgccaagaaagagcgggaagaatccttgcctaacctgctacagtatgtgcggatgcccctactaacccccaggtatatcacagatgtaatagatgctgagcctttcatccgctgtagtttacaatgcagggatctggttgatgaagcaaagaagtttcatctgaggcctgaacttcggagtcagatgcagggacccaggacaagggctcgcctaggagccaatgaagtgcttttggtggttgggggctttggaagccagcagtctcccattgatgtggtagagaaatatgaccccaagactcaggagtggagctttttgccaagcatcactcgtaagagacgttatgtggcctcagtgtcccttcatgaccggatctacgtcattggtggctatgatggccgttcccgccttagttcagtggaatgtctagactacacagcagatgaggatggggtctggtattctgtggcccctatgaatgtccgacgaggtcttgctggagccaccaccctgggagatatgatctatgtctctggaggctttgatggaagcaggcgtcacaccagtatggagcgctatgatccaaacattgaccagtggagcatgctgggagatatgcagacagcccgggaaggtgccggactcgtagtggccagtggagtgatctactgtctaggaggatatgacggcttgaatatcttaaattcagttgagaaatacgaccctcatacaggacattggactaatgttacaccaatggccaccaagcgttctggtgcaggagtagccctgctgaatgaccatatttatgtggtggggggatttgatggtacagcccacctttcttccgttgaagcatacaacattcgcactgattcctggacaactgtcaccagtatgaccactccacgatgctatgtaggggccacagtgcttcgggggagactctatgcaattgcaggatatgatggtaattccctgctaagtagcattgaatgttatgaccctatcatcgacagctgggaagtcgtgacatccatgggaacccagcgctgtgatgctggtgtttgtgttctccgcgagaagtgaccattgttggagcaccatccagagctagtgaccagtccagtggacagttagtgggagaatcaaaaatcctttccagaatgtctgtttctcactatgtgcaccgggtgattacaggcaccagtgcagtg

SEQ ID NO: 4423 - DNA, 6272 bp, Homo sapiens
gtttcaactcttgcttgaatcaagaacagaagcctctctttagacaggacttatccagagggggctgcaggcgagcactctcgtgccccgccggagcgacccggctcgtgccgggagcggctgctcgtagacgtccgaggagcctgccgagtgccgtcccggcgcccgaccgcccacccatcggcccgctggcccggttcttcctgatgcagactgccgtccactagaggctggacaggaccccccgaggtgattcatggcaggggacgtggaaggattctgttcctccatccacgacaccagtgtctctgctgggttcagagcactgtatgaggagggattgcttcttgatgtcactctggttattgaagatcatcagttccaggcccataaagcactcttggccacccagagtgattacttcagaattatgtttactgcagacatgagggaacgagatcaggacaaaattcatttaaaaggtctaacagctaccggtttcagccatgtcctgcaatttatgtactatggaactatagagctgagtatgaataccgttcatgagattcttcaggctgccatgtatgttcaacttatagaagtggtgaagttctgctgctcttttctcttagcgaagatctgcctagaaaattgtgcagaaattatgagactcttagatgatttcggcgtaaacatcgagggagtcagggagaagttagacacctttctgctagacaactttgtgccactcatgtctaggcctgactttctgtcctatctgagctttgagaagctcatgtcttacttggataatgatcatctgagcaggttcccagagatagagctgtacgaggctgtgcagtcttggctgcggcatgatagaagacgctggagacataccgataccatcattcagaatatccggttttgcttgatgaccccaaccagcgtttttgagaaggttaagacatcagaattttatagatactcccgacagctccgttacgaagttgaccaagcattgaattactttcagaatgttcaccagcagcctttgttggatatgaagtcaagccgcatccgttctgcaaaaccgcaaactacagtatttcgaggaatgattggacatagcatggttaacagtaaaatacttctcttaaagaaaccaagagtctggtgggagctagaaggcccacaagtacctctgcgacctgactgccttgctatcgtcaataattttgtgttcctgttaggcggggaagagctgggcccggatggtgaattccatgcttcttccaaagtattcaggtatgacccgagacagaactcctggctgcagatggcagatatgtctgtaccacgctctgaatttgctgtaggtgttattgggaagtttatttacgccgtagcaggcagaaccagagatgagactttctattcaactgagagatatgacatcaccaacgataaatgggaatttgtggatccttatccagttaacaaatatggacatgaggggacagtgctcaataacaaattgtttatcaccggtggaatcacctcatcttccacctccaagcaagtgtgcgtgtttgaccccagcaaagaagggaccatagaacaacggaccaggagaactcaagtggttaccaactgttgggagaataagagcaagatgaattacgcgagatgctttcacaagatgatttcttacaatggcaagctttatgtcttcggtggtgtctgtgtgatcttgagggcctctttcgaatctcagggatgcccttctacagaagtatacaacccagagactgatcagtggaccatcttggcatccatgccgattggtagaagtggccatggtgtgactgtgctggacaaacaaataatggttcttggaggcctttgttataatggtcattacagcgattccatcctcacttttgatccggatgaaaacaagtggaaggaagatgagtaccctcggatgccctgcaagctggatggtttacaagtatgcaacctgcattttccggactatgtactggatgaggtcaggcgttgcaactaatgacatcctcctccctaaaaaaagaggcaaacaaagtatttgtttgcacagagtaattaattaaaacatataaagaaaaacctcaccagttttactatcaaagccattggtctaacattgtaagaatttttcattctgtgctagcatcctttttttcttttcagtggcctcaaactcatgcaataagttaattctaagtgctagctcttgaaactacttccagaagcagttgaatagaatgctccacttatctgggatattgattttctgctttaaacatttctttcagatgttagcgtaggagtcatgtgtcttctaagagaagacccgataagtgtcactggatgtgatttcagtctctgtctctatctgaaacctttttgaagatttatttcagtgtatttcagtctgttatactttttagttttattatttaaaagtttaaaactcttgacctttttgcatggctttttgctgaaaatgcaaaaatataaattttctacaaaattaactttttatattcaaaacactatttctaagctgccttctcttatccgcattgtgttagtgaaagcatattcatactcgcatacaacctataaatacacaaggcacatcccttttatgcgtggttaggattctatatttttaagctagtgcacttacttgcacacacagttcgccatacttgttgaattttagatgtaacgtcttttcacatattaacatttttagaaagttgaaataactggagtcctcatttgctatcaaagtagcctatcttcagtccatactgattcagtaatatttgaactccttatatttctgaaacatgtatggttatgaaaactaacactttatattttattttcaaaagtaaatgttagtgttctttgtcgatgtatgtcttttctttttgaaaatgtttttctttgcagtctgtttaacgttaccctgtttttagtgagaatcggagtggtatatgacaagttctggccctgcagcatgcaagcacttttaaagagcatttaggtaataccagactcctaaatcaaggccccttaaaagtaagtgcaactcccattttttacattcagtaaggctgctgcatttgttattgaatggaaggtagaaactcttagaaaatttgacctcagttttgacttagaggtaagaaatagaattataatgttactggttttatctacttgtttattttgtacaaaatacccagcgacactagggatgtaagccctcagtttttgttttatttactgaaagctattagcatgaaggatagtaaccacaaagttcagaatggatcaagaatagctgtttaaaagcatttataataagtgttttaggattagctgcacctttcaactctttaaatgcagaggaaaaaacatagttgacaaagttaagcaagaataacctgggagtggatcattgaaattgatgccatttgcgcatgagtagtctatatctgatacagactagatctatactggcaaaacttgccagatcttagaatattggtgcaatattgcaatgccttctatatggctgctgatgtataaattttctagtttcactttgtttggtgttttttgtttttttgtttgtttgtttgtttttttgctgctgccaccattgaacataaaatggaagtgtgaagtcatggaaatgtgaagactttggtttttgggggttttttgggcagttattagacatactatgagattaaacctgatcttcaaactccagaattggaggcatttgggtttaagaaaccaggtacataagtagcttttgaaaaaaccattggcattgatttcaaaaatcaataataatcttattttatatatgagacttatattttcattaactagtcctgtcatttacttacagtttccaaacatgaaatttggtatcttgtttcccatggtaatatgggtaaaagtctttttctacatttaaaaaatacattattttatttttgaaagttaggaataagttagccatttaatttttttctacattagtttagtggctttgtatgtgtgctattttgctttaaagaaaataacgtcttcattattttcctcattgatgtcttttgctagaaaagaccaagaaagagccatcaggccaggtatccacatcaaagcctttacactatagtggtggttctctttaattgcttagatatgacttcatgaccctagtcagggtgacatctgggcaaacatttgagtattcttggtcttccattttaaagacagaggccaagatcaaagttcatgttttgtaaaattcgtaaaatcttaacttgaactaactctgggttcagctttacgtaagtcacgtcggacctgatgttagctgtaatcagttttgagctttaaggatagttgctgttgcttgggttctgaatgtatgagaaaactccctgtttatatgtagttctaatttaggttattttaaatccatgattaacttacattcccttttaaaattatggttttattgctgcaagagatttatttttgttatactaaactatggaaaagtttttcatagcatttttttcaagtttattttttgtgtgcttcatttggagtttttgtttatatacattgcgctcaaaaaagtagttttttgaaaaattcagtaagatttgaatctatacagtttaactgttatgacctttatgcgtgttgttttcactttatatctcaaatgccagagttcacaaaaatagctgatcttcattaattacatcttaattagaaccatttgttctcttccgtgtctttgaccttctaagttttgattttaaagaaattccttgcactacagccttttcttaaaatgcaagattctcactttgaaggttttgtgttggaagaaatgctactggtttttaaaaagcaaagcttaactaatagaattattagcttttcttgagacagctttctgtgtcctcattactctgctctgtgtgagtgttactagaatttgtgaaatactgactgagcccttcacttatcttttctaaagcagcacctttggacacctcattctgggaagcctgctcgagtcatagtaaaggacacacgctttatgtggggagaagtggtaaaaatggagttttgtcttaattacatgaaactaagctttaaaatattttataacagattatttgagctgcataatctaaacatgtcaaacgttcagtgggactatttttatatatgtatatgtgggtgtaggtcataacatttcagtttataatataaattgttatttcagtttataagctatctctcagaggagactagctcttttgagaattcataatttaaagttttagactgaagtaaaatgcaacatagataatagtgtaaatcagatataattgagggctatatggcagtaaaactgctagtgccagttttcttgtttgcctgttatacatttttgatttttgtttttgtattctgaacattttgagagatcatatgtttgttcaattacatttagagttggtttgggaataaatatcttctaaaaagagatttatcttaaaaatggaagtcctaaaaattagtttatccagagtttataaagtcaaatattcagtaggcatagactggaatagataaattcatggaaatcatatcctttcagtacaccgtataacttcaatattacacaagtaacattgaggagaatgccatcagctttgttctcccttaaattctttggttttctttttacattttgggaacaactgcatttaaaatgttattagtcagtatatagtaaggattaggtgtttgctttctgaaggaatggtccagtgaggtgattgggagaggttattttctacctaacttgtatatgccctatacctcttgggcatactttgtctatagaaaaatattttgacctttaggtacattttgggccagtagtcaaataatcctagggccgatataaaaatcttagaataatttaaggtttgccttttatacctgttttgaaagcctttacatttttgtcaggtaatttttcccaagccgtggatataatctattcaaacatgtttatgctatccattctgtttttaaattgaaaaaaatgttaaaagtgtttatgaagaaaagtttaaataaaatatttttaatctttaaaa

SEQ ID NO: 4424 - DNA, 4620 bp, Homo sapiens
agttgcagcggccggggaagatggtggaggacggcgcggaggagctggaggatctggtgcacttctccgtgtctgagttgcctagtcgcggctacggcgtcatggaggagatccggcggcagggcaagctgtgcgacgtgaccctcaagattggggaccacaaattcagtgcccaccggattgtcttagcagcctcgatcccgtatttccatgctatgtttacaaatgacatgatggagtgcaagcaggatgagattgtaatgcaaggaatggacccaagtgccctggaggctctgatcaactttgcctacaacggcaaccttgccattgaccagcaaaatgtccagtcattgctgatgggggcgagcttcctgcagctgcagagcatcaaagacgcctgctgcacattccttcgagaacggcttcacccaaaaaactgcctgggtgtgcgccagtttgctgagacaatgatgtgtgctgtgctgtacgacgctgccaacagcttcatccaccagcactttgtggaggtgtccatgtcagaagagttcctggccctgcccttggaagacgtgcttgagctggtgtctcgggatgagctgaatgtcaaatctgaggagcaggtctttgaagctgcattggcctgggtcagatacgaccgggagcagaggggtccctacctgcctgagctgctgtccaatatccgcctgcccctctgtcggccccagttcctttcagacagagtacagcaggatgacctggtgcgttgctgccacaaatgcagggacctggtagacgaagcaaaggactaccacctcatgccagagcgccggccccacctgccagctttcagaacccggccacgctgctgcacatccatcgctggacttatctacgctgtagggggcctcaactcagcaggtgattccctgaatgtggtggaagtgttcgaccccattgccaattgctgggagagatgccgtcccatgacaacagcccgcagccgcgttggcgtggctgtggtgaacgggcttctctatgccatcggaggatatgacggccagctacggctgagcactgtggaggcctacaacccggagacagacacatggaccagagtggggagcatgaatagcaagagaagtgccatggggacagtcgtgctggatgggcagatctacgtctgtgggggctacgatggcaactcttccctcagctccgtggagacctactcacctgagacggacaaatggacagtggtgacctcgatgagctcgaatcgcagtgctgctggggttacagtctttgagggcaggatatatgtgtcaggcggccatgatggtttgcagatcttcagcagtgtggaacactacaaccaccacacagccacctggcaccctgcagctggcatgctcaacaagcgctgccggcacggagccgcctccctggggagcaagatgtttgtctgcgggggctacgatggctctggcttcctcagcattgccgagatgtacagctctgtggcagaccagtggtgcctgattgtccccatgcacacgcgcaggagccgggtctccctggtggccagctgtgggcgcctctacgctgttgggggctacgacggacagtcaaacctaagctcagtggagatgtatgacccagagacagactgctggacattcatggcccccatggcgtgccatgagggaggggtcggtgtgggctgcatccctctcctcaccatctaaggcagaggatgggatgtggtggggcagggatctggtacagacataggcgcttccttccaggaacagtccctcaggagaggcagtggaccagaagagatggcgaaacgtgagctcgccggaggtacagtttttccaggtgcttaagccctcccccactgtgccacccttgtgaccttcaggcttgggtcatcaagatgcacagcatggaacacaagctcctctggatcctgcagctggtgacatggaactgttttctggtccacatgaacacaggctccatccaggcccagctcctacccaccgcctctctgtgggccagctgttcacagaaggccttccatctgatgctccccatcgcctgcttgctctccagccgagtctggccaatttgccatggggaggctgcagtgtccaagcctgctggaaactgggatgtagctggggacgaaaggacagacccaagcgttctccctgcctgagatggtgtggccacagcagtggaaggctgcacacaggcacattccttcttccacagtggggcaccaaggattctgtcctcattgctgggtaagcagggagaagagaagttttccccatgtctaattttgggatttcagtgaggccttttgatctgtccaggagaacagaagggaaaaaaagatacttgaaagaaactgaaggaaatttaaacaaagaaacacttgaaagaaactggaaagaaaaataatttttttatgtgaacaaattttgcaagaagaaaaaagcataaaagacactaacggcaaatctatgtttaaatggaaaatcgtctaactggagaagggcggtatccaccccacattcggatcccagggtcctgaggcctcgcattgagctgggggttccctctgagccccagtgtgtgtggaatcagtgcactcttgactgggcctgtagtaaggtgctcatggggtttgtcttctcacccaccatcagaggacttttaaaatcataggcgtagagagttaggctatctgctgaattactgccactcttcttggtgggggctcctagctgtggctgggggctccaggcgcccctgtgattacctcctactgccaccatggcgctcattcagattccccactctcactaacattgcttccttttttgaccagcaggaaacagcaggtctggccagattctcacttgcccatcaatctcgttcttggatgatttccctcattgtgatgcttctggggcacgttgaccatatgcacctctagaacctaaccagggcttccttctaccagctgtgggcgggcttggtctggtaaccttgtctgctctgccattccactgctcctccatccactcgccaatcccaagagtctggcctccctccagccctgggcagactgaccagcaaggtggacctttacattcaagcacagctggcttttatgacataaagaactaaaggccgaaagaatctcttgctgctgcaaagaacagattttatatttcttcctctaatcttggcaaatgacctttaccttttggaaagatttcatattgcttcctcctccctggataggacctaatgtagcacagcgggactcaaagaggaggacattttctcttgccagtgcactgggcagtggggctgtccttcaactgctgctgccaaaattggttttctaaaattcttccagtagagactaaaagaagattcaattcctgtaacccaagactgagtcttagggctccagtctccacctgcttggtttcctatcctttgctgcctgcctggggtggcctggaagcctgttcagaaaggcacaatgtggagcctggggtgtctcccccaccccaggaccgtcaggtttaccagtgtgtgcaatcgccatgtattcagagggaagtacctttgttacctacaacttaggagctaggcctctgctacaagcacttgaaaatgatatttttatttttaacgtctcaacaatctgatatcggatgtcgtttaacctgggctcgtggtagggctccagcatttctccctccttcctggtttgcctgtaggggtagactcggaaggtgggtggggtgtgcatttcctgttaggagtgtatcagtgcttgtcttattataagcccctttcttttgtgaatttgaagtagcaccaacaagcctggattgtgaaggtattaagaatcggtctgtgggctactgagtgggtccttaggatactggcccagattttgccactgggtatggcagatcattttctaccatggcctgctgctcttgtagtggacttcctgagtccaatcccacctcctggtgtagaatttacactgctgcacctgaggtcgatgtttcaaagtaagatcaagccagtgttttgatctgggctctgagcacaagtcaggaaacaccaacatattcacactctcccagtaggttcctcagtccgatggtgaatggctattcgtaaatggctggtctggctctttggtgttggagcctttccaatagccccatgaaaagaagcatcacccaaggatattgtaaaaaggatgtaacaaggagatagggtagacattgtactcagtgggccttggggcctagcccagctctgagcagaggactgtggcattcactgtccttgagtgtttcaccttcttggataacacacgggccttctcttctggatttcatcagagattacagccagatgggggctgaagaccatcctcttgaccacagaggtgtgactgtgggaattcctcccaatttatggtttcccagaaaatcttagttccttttatttatagaatgcatgtcttttgtgttaagaaaccaaagagaaataaagagaacactcctaata

SEQ ID NO: 4425 - DNA, 2249 bp, Homo sapiens
gttgcagcggccggggaagatggtggaggacggcgcggaggagctggaggatctggtgcacttctccgtgtctgagttgcctagtcgcggctacggcgtcatggaggagatccggcggcagggcaagctgtgcgacgtgaccctcaagtgccctggaggctctgatcaactttgcctacaacggcaaccttgccattgaccagcaaaatgtccagtcattgctgatgggggcgagcttcctgcagctgcagagcatcaaagacgcctgctgcacattccttcgagaacggcttcacccaaaaaactgcctgggtgtgcgccagtttgctgagacaatgatgtgtgctgtgctgtacgacgctgccaacagcttcatccaccagcactttgtggaggtgtccatgtcagaagagttcctggccctgcccttggaagacgtgcttgagctggtgtctcgggatgagctgaatgtcaaatctgaggagcaggtctttgaagctgcattggcctgggtcagatacgaccgggagcagaggggtccctacctgcctgagctgctgtccaatatccgcctgcccctctgtcggccccagttcctttcagacagagtacagcaggatgacctggtgcgttgctgccacaaatgcagggacctggtagacgaagcaaaggactaccacctcatgccagagcgccggccccacctgccagctttcagaacccggccacgctgctgcacatccatcgctggacttatctacgctgtagggggcctcaactcagcaggtgattccctgaatgtggtggaagtgttcgaccccattgccaattgctgggagagatgccgtcccatgacaacagcccgcagccgcgttggcgtggctgtggtgaacgggcttctctatgccatcggaggatatgacggccagctacggctgagcactgtggaggcctacaacccggagacagacacatggaccagagtggggagcatgaatagcaagagaagtgccatggggacagtcgtgctggatgggcagatctacgtctgtgggggctacgatggcaactcttccctcagctccgtggagacctactcacctgagacggacaaatggacagtggtgacctcgatgagctcgaatcgcagtgctgctggggttacagtctttgagggcaggatatatgtgtcaggcggccatgatggtttgcagatcttcagcagtgtggaacactacaaccaccacacagccacctggcaccctgcagctggcatgctcaacaagcgctgccggcacggagccgcctccctggggagcaagatgtttgtctgcgggggctacgatggctctggcttcctcagcattgccgagatgtacagctctgtggcagaccagtggtgcctgattgtccccatgcacacgcgcaggagccgggtctccctggtggccagctgtgggcgcctctacgctgttgggggctacgacggacagtcaaacctaagctcagtggagatgtatgacccagagacagactgctggacattcatggcccccatggcgtgccatgagggaggggtcggtgtgggctgcatccctctcctcaccatctaaggcagaggatgggatgtggtggggcagggatctggtacagacataggcgcttccttccaggaacagtccctcaggagaggcagtggaccagaagagatggcgaaacgtgagctcgccggaggtacagtttttccaggtgcttaagccctcccccactgtgccacccttgtgaccttcaggcttgggtcatcaagatgcacagcatggaacacaagctcctctggatcctgcagctggtgacatggaactgttttctggtccacatgaacacaggctccatccaggcccagctcctacccaccgcctctctgtgggccagctgttcacagaaggccttccatctgatgctccccatcgcctgcttgctctccagccgagtctggccaatttgccatggggaggctgcagtgtccaagcctgctggaaactgggatgtagctggggacgaaaggacagacccaagcgttctccctgcctgagatggtgtggccacagcagtggaaggctgcacacaggcacattccttcttccacagtggggcaccaaggattctgtcctcattgctgggtaagcagggagaagagaagttttccccatgtctaattttgggatttcagtgaggccttttgatctgtc

SEQ ID NO: 4426 - DNA, 2616 bp, Homo sapiens
acgtgacggcccaggcccccgccccgccggctcctctcgcccagcctcccgcctcgcgcctcccgcctcccgcctcccgcctccctccagctgcgagtgcggcctcggctggcggcggcaccaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggaccccagccctttgagggacacagtggccagcgccctcatgtaccaccggaacgagagcctacagcccagcctgcagagcccgcaaacggagctgcggtcggacttccagtgcgttgtgggcttcgggggcattcactccacgccgtccactgtcctcagcgaccaggccaagtatctaaaccccttactgggagagtggaagcacttcactgcctccctggccccccgcatgtccaaccagggcatcgcggtgctcaacaacttcgtatacttgattggaggggacaacaatgtccaaggatttcgagcagagtcccgatgctggaggtatgacccacggcacaaccgctggttccagatccagtccctgcagcaggagcacgccgacctgtccgtgtgtgttgtaggcaggtacatctacgctgtggcgggccgtgactaccacaatgacctgaatgctgtggagcgctacgaccctgccaccaactcctgggcatacgtggccccactcaagagggaggtgtatgcccacgcaggcgcgacgctggaggggaagatgtatatcacctgcggccgcagaggggaggattacctgaaagagacacactgctacgatccaggcagcaacacttggcacacactggctgatgggcctgtgcggcgcgcctggcacggcatggcaaccctcctcaacaagctgtatgtgatcgggggcagcaacaacgatgccggatacaggagggacgtgcaccaggtggcctgctacagctgcacgtctggacagtggtcatctgtctgcccactccctgctgggcacggtgagcctggcattgctgtgctggacaacaggatctatgtgttaggtggccgctcacacaaccgcggcagccgcacaggctacgtgcacatttacgatgtggagaaggactgctgggaggaagggccccagctggacaactccatctcaggcctggcggcctgtgtgctcaccctgccccgctccctgctccttgagccgccccgcgggacccctgaccgcagccaggccgacccggactttgcctctgaggtgatgagtgtgtctgactgggaggagtttgacaactccagtgaggactaggctccctgtgcctggcatcagagggaagggaggctggggctgcagggcagtgaaacccacgcagcctaggccagagcactttactccaggcagggcccctgcccctgttggccacagcttatgggccctgccctctttcttcacaccagccccttggccagcctgccgcaggcatctcagggccatgcagatcccaggctgtggattacgtcactgcaggaactgcttctgaaaggctttggccttcctcagtgagccctggaggggttggccttctctcctccctgcctagatcagtccttctccaaaaggacctgggagctggcagcctgggcaggggggctgaggcacgtggtagccctctttctgtgaatggggtggggctgtgggggcagctggggttggaggatgagagctcctgaggggcagaggagcagagatgcatcagctcgcctgggactggctctgtgataaaaagacccctcccgctgggttttcagaccccatgttgttggtcaatgaaataaagcatcttacagaaggtgttaactgtt

SEQ ID NO: 4427 - DNA, 2220 bp, Homo sapiens
agctgcgagtgcggcctcggctggcggcggcaccaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggaccccagccctttgagggacacagtggccagcgccctcatgtaccaccggaacgagagcctacagcccagcctgcagagcccgcaaacggagctgcggtcggacttccagtgcgttgtgggcttcgggggcattcactccacgccgtccactgtcctcagcgaccaggccaagtatctaaaccccttactgggagagtggaagcacttcactgcctccctggccccccgcatgtccaaccagggcatcgcggtgctcaacaacttcgtatacttgattggaggggacaacaatgtccaaggatttcgagcagagtcccgatgctggaggtatgacccacggcacaaccgctggttccagatccagtccctgcagcaggagcacgccgacctgtccgtgtgtgttgtaggcaggtacatctacgctgtggcgggccgtgactaccacaatgacctgaatgctgtggagcgctacgaccctgccaccaactcctgggcatacgtggccccactcaagagggaggtgtatgcccacgcaggcgcgacgctggaggggaagatgtatatcacctgcggccgcagaggggaggattacctgaaagagacacactgctacgatccaggcagcaacacttggcacacactggctgatgggcctgtgcggcgcgcctggcacggcatggcaaccctcctcaacaagctgtatgtgatcgggggcagcaacaacgatgccggatacaggagggacgtgcaccaggtggcctgctacagctgcacgtctggacagtggtcatctgtctgcccactccctgctgggcacggtgagcctggcattgctgtgctggacaacaggatctatgtgttaggtggccgctcacacaaccgcggcagccgcacaggctacgtgcacatttacgatgtggagaaggactgctgggaggaagggccccagctggacaactccatctcaggcctggcggcctgtgtgctcaccctgccccgctccctgctccttgagccgccccgcgggacccctgaccgcagccaggccgacccggactttgcctctgaggtgatgagtgtgtctgactgggaggagtttgacaactccagtgaggactaggctccctgtgcctggcatcagagggaagggaggctggggctgcagggcagtgaaacccacgcagcctaggccagagcactttactccaggcagggcccctgcccctgttggccacagcttatgggccctgccctctttcttcacaccagccccttggccagcctgccgcaggcatctcagggccatgcagatcccaggctgtggattacgtcactgcaggaactgcttctgaaaggctttggccttcctcagtgagccctggaggggttggccttctctcctccctgcctagatcagtccttctccaaaaggacctgggagctggcagcctgggcaggggggctgaggcacgtggtagccctctttctgtgaatggggtggggctgtgggggcagctggggttggaggatga

SEQ ID NO: 4428 - DNA, 742 bp, Homo sapiens
agctgcgagtgcggcctcggctggcggcggcaccaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcac

SEQ ID NO: 4429 - DNA, 2087 bp, Homo sapiens
aagagaggcgcctgcgcttgcgagctgggcttgtgagtggggctgccgagagggcaggcgtggggcgaggccaaaggactgaacccgcaggagcgtcacgggcgccggggcggctgccgacggcgggactgggttttctatcagatgttccacgtaataatgctggagttaagaagtttccattattttgctccaaaccagaagactctgttccctgtatatagaataggagtaatatttgaaaacaactggctgatgtttaaaactgaagattgtcatgattgtttatcctaatcccaatgctgaagtaagattgtcttggaaatactaagttggccatggctctaaaaggacaagaagattatatttatcttttcaaggattcaacacatccagtggattttctggatgcattcagaacattttacttggatggattatttactgatattactcttcagtgtccttcaggcataattttccattgtcaccgagccgttttagctgcttgcagcaattattttaaggcaatgttcacagctgacatgaaagaaaaatttaaaaataaaataaaactctctggcatccaccatgatattctggaaggccttgtaaattatgcatacacttcccaaattgaaataactaaaagaaatgttcaaagcctgcttgaggcagcggatctgctacagttcctttcagtaaagaaggcttgtgagcggtttttggtaaggcacttggatattgataattgtattggaatgcactcctttgcagaatttcatgtgtgtccagaactagagaaggaatctcgaagaattctatgttcaaagtttaaggaagtgtggcaacaagaagaatttctggaaatcagccttgaaaagtttctctttatcttgtccagaaagaatctcagtgtttggaaagaagaagctatcatagagccagttattaagtggactgctcatgatgtagaaaatcgaattgaatgcctctataatctactgagctatatcaacattgatatagatccagtgtacttaaaaacagccttaggccttcaaagaagctgcctgctcaccgaaaataagatccgctccctaatatacaatgccttgaatcccatgcataaagagatttcccagaggtccacagccacaatgtatataattggaggctattactggcatcctttatcagaggttcacatatgggatcctttgacaaatgtttggattcagggagcagaaataccagattataccagggagagctatggtgttacatgtttaggacccaacatttatgtaactgggggctacaggacggataacatagaagctcttgacacagtgtggatctataacagtgaaagtgatgaatggacagaaggtttgccaatgctcaatgccaggtattaccactgtgcagtcaccttgggtggctgtgtctatgctttaggtggttacagaaaaggggctccagcagaagaggctgagttctatgatcctttaaaagagaaatggattcctattgcaaacatgattaaaggtgtgggaaatgctactgcctgtgtcttacatgatgttatctacgtcattggtggccactgtggctacagaggaagctgcacctatgacaaagttcagagctacaattccgatatcaacgaatggagcctcatcacctccagtccacatccagaatatggattgtgctcagttccgtttgaaaataagctctatctagtcggcggacaaactacaatcacagaatgctatgaccctgaacaaaatgaatggagagagatagctcccatgatggaaaggaggatggagtgcggtgccgtcatcatgaatggatgtatttatgtcactggaggatactcctactcaaagggaacgtatcttcagagcattgagaaatatgatccagatcttaataagtgggaaatagtgggtaatcttcccagtgccatgcggtctcatgggtgtgtttgtgtgtataatgtctaattgaatctgcagaaatgaccaagcaatcacttttttggagtatagttttataaaaaaagaatgcagggtttg

SEQ ID NO: 4430 - DNA, 4077 bp, Homo sapiens
acggcccggcgacgggggagttcccgcgagtggcctcgcgcccagaccgtgcggggggctgttcgggtggaggcgggggagccgccgggacaccaaaataggagctgcttgtggggtggagcggcactagctggcggcttccgagcgcctcttccaaagatggtcagaggggccggaggcgtccccgctcccgctcgctactagcccgcgggccagcgccgcgtcccgagccccggcgggagccatggctctaaaaggacaagaagattatatttatcttttcaaggattcaacacatccagtggattttctggatgcattcagaacattttacttggatggattatttactgatattactcttcagtgtccttcaggcataattttccattgtcaccgagccgttttagctgcttgcagcaattattttaaggcaatgttcacagctgacatgaaagaaaaatttaaaaataaaataaaactctctggcatccaccatgatattctggaaggccttgtaaattatgcatacacttcccaaattgaaataactaaaagaaatgttcaaagcctgcttgaggcagcggatctgctacagttcctttcagtaaagaaggcttgtgagcggtttttggtaaggcacttggatattgataattgtattggaatgcactcctttgcagaatttcatgtgtgtccagaactagagaaggaatctcgaagaattctatgttcaaagtttaaggaagtgtggcaacaagaagaatttctggaaatcagccttgaaaagtttctctttatcttgtccagaaagaatctcagtgtttggaaagaagaagctatcatagagccagttattaagtggactgctcatgatgtagaaaatcgaattgaatgcctctataatctactgagctatatcaacattgatatagatccagtgtacttaaaaacagccttaggccttcaaagaagctgcctgctcaccgaaaataagatccgctccctaatatacaatgccttgaatcccatgcataaagagatttcccagaggtccacagccacaatgtatataattggaggctattactggcatcctttatcagaggttcacatatgggatcctttgacaaatgtttggattcagggagcagaaataccagattataccagggagagctatggtgttacatgtttaggacccaacatttatgtaactgggggctacaggacggataacatagaagctcttgacacagtgtggatctataacagtgaaagtgatgaatggacagaaggtttgccaatgctcaatgccaggtattaccactgtgcagtcaccttgggtggctgtgtctatgctttaggtggttacagaaaaggggctccagcagaagaggctgagttctatgatcctttaaaagagaaatggattcctattgcaaacatgattaaaggtgtgggaaatgctactgcctgtgtcttacatgatgttatctacgtcattggtggccactgtggctacagaggaagctgcacctatgacaaagttcagagctacaattccgatatcaacgaatggagcctcatcacctccagtccacatccagaatatggattgtgctcagttccgtttgaaaataagctctatctagtcggcggacaaactacaatcacagaatgctatgaccctgaacaaaatgaatggagagagatagctcccatgatggaaaggaggatggagtgcggtgccgtcatcatgaatggatgtatttatgtcactggaggatactcctactcaaagggaacgtatcttcagagcattgagaaatatgatccagatcttaataagtgggaaatagtgggtaatcttcccagtgccatgcggtctcatgggtgtgtttgtgtgtataatgtctaattgaatctgcagaaatgaccaagcaatcacttttttggagtatagttttataaaaaaagaatgcagggtttgaagttccttacctgataattgtgtctggcacatgataggggatcagtaaattgtaattcctaaccctactgtactcccaaacatggtgattcatggtcaagaaaaatcttatatatatatatatatacacacacacatatatgtgttcatatatatgtatacatatatatgtgtatatatacgtatgtatacatatatgtgtatatatacgtatgtatgtatacatatgtgtatatatagtatgtatgtatacatgtatgtgtatatatacgtatgtatgtatacatatatgtgtatacatatatatgtgtgtatatatatacacatatatacgtatatatgtgtatatatatacacagttgaatcagtgggattaatacctataatctctggttttcaaaggtaatatagaatatttgacacttggtaaaaggtgaactacctttgtagtgaatcttttcctcttggtagcatcaacactggggataaatcagaaccattctgtggaatgaaatgtttctcaagagcctataatatagtagatagtgcatattaagatgtctggctgggcatggtggctcatgcctgtaatcccagcactttgggaggctgaggcgggaggatcacttgagcctagaagttggagactaacctggcgagaccctgtctcaaaaaaaaaaaaaaatcaatttagctagcaggaatttgacatttaaagagggaatcttctctacctctacaaaatcaacccttaacacttttttcaccttcagaattatttagaatgtggatttactttgtctagttttttcctttatagtgtaatttattgttactctctatttactgactaccagagatatacaaaatactgtgcaaaagattgttactgttcaaagagcttacaaactaaatttaaaagaatagcaagtctgaaaaatagaagatagtcaaatatttgtttatgctaagaactgtttttaattttcagctttgatgtaaattgctagcttagttgtctttagttcaagcatgttaggaaatcctctttattcttaaatatagatacatgtctgcatatatgattgaattttagagccagaaagcatgtagagcagttgtgattagtagaaaatacactgacaagaagatatttgcatttatttcccaaagctgccagtaactagattttgtgacttaagtcatttaacctctccttgattagagcttcctgagccatgcacactggcactgcaaatcacagacaggcctagatacagatcccctcaccccttgctacatccaaaggtggcctgggtggctggagcctctgggccagaaccacctttgtccattttcctcagtgtgcctacagcatcgctttccatgtgtgccataacttgggaatagttgggatgtgttgcttaactcctttacaccattagttatctgtgagaccatctattccacactcttcattttttaaaaagagacaataattatttttaactcactgaagtttaaaactacctagcatttctgattaaaaaaaatttagaaggaaaattttaatgcatttatttcagatggcgttttaaatagatacaaccctttggaaacacaatatggtactacatagcaagggctgtaaaaatgaccatatcctttgccccataaattctacttctatacttttaaccttaaaaataattcagaaaaaagataaatgcatgaagacatttatgtctgcattctttataataacaaaaattggggaaaaaaactccatgtcaagaaagtgggataagaaaaatagtgaagtattatactgccattaaaataattatttggaagactgtagaaacgtggacatgtttgatatggtaagtaaaatgagcacaatacaaaatagtatgcatactatgattgtgactttgtaaaatctttatgcatgtggaaggtaatctgcaaaacaaattcattgtgttagtgtagcgggatatggaatgactttatttatttaaatcttttctttaatattactttgtattttcaataaaaataaatcactgtacatagtaaga

SEQ ID NO: 4431 - DNA, 3122 bp, Homo sapiens
actcgaacgcgcgacggcggggggaagatggcggagtccggcggtagcagcggtggtgctggtggcggcggcgctttcggcgcgggcccgggccccgagcgcccgaacagcacggccgacaagaacggggccctcaagtgcaccttctcggcacccagccacagcaccagcctcctgcagggcctggccaccctccgcgctcagggccagctcctcgatgttgtgctgactattaacagagaggcctttcctgcacacaaggtcgtcctggctgcctgcagcgactacttcagggccatgttcaccggcggcatgcgggaggcaagccaggacgtcatcgagctgaagggcgtgtcggcccgtggcctgcggcacatcatcgacttcgcctacagcgccgaggtgacactggacctggactgcgtgcaggacgtgctgggcgcggccgtgttcttgcagatgctgcccgtggtggagctgtgcgaggagttcctgaaggcggccatgagcgtggagacctgcctcaacatcggccagatggccaccaccttcagcctggcctcgctgcgagagtcggtggatgccttcaccttccggcacttcctgcagatcgccgaggaggaggatttcctgcgcctgccactggagcgcctggtcttcttcctgcagagcaaccggctgcagagctgtgccgagatcgacctgttccgcgcggccgtccgctggctgcagcatgacccggcccggcggccgcgcgccagccacgtgctctgccacattcgcttcccgctcatgcagtcgtccgagctggtggacagcgtgcagacgctggacatcatggtggaggacgtgctgtgccgccagtatctgctggaggccttcaactaccaggtgctgcccttccggcagcacgagatgcagtctccgcgcaccgccgtgcgctcggatgtgccctcgctcgtcaccttcggcggcacgccctacaccgacagcgaccgctcggtcagcagcaaggtctaccagctgcctgagccgggagcccgccacttccgcgagctcacggagatggaggtaggctgcagccacacgtgcgtggccgtgctggacaattttgtgtacgtggccggggggcagcacctgcagtaccgcagcggcgagggcgcagtggacgcctgctaccgctacgacccccacctgaatcgctggctgcgcctgcaggccatgcaggaaagccgcatccagttccagctgaacgtgctgtgcggcatggtgtacgccacgggcggccgcaaccgagccggcagcctggcctccgtggagcggtactgcccccggcgcaatgagtggggctacgcctgctcgctgaagcgccgtacctggggccatgctggggccgcctcagggggccgcctctacatctcgggtggctacgggatctcagtggaggacaagaaggccctgcactgctacgaccccgtggccgaccagtgggagttcaaggcgcccatgagcgaaccccgcgtgctacacgccatggtgggtgccggcggccgcatctatgccctcgggggccgcatggaccacgtggaccgctgcttcgacgtgctggctgtggagtactatgtgccggagacggaccagtggaccagcgtgagccccatgcgggccggccagtcagaggccggctgctgcctgctggagaggaagatctacatcgtcgggggctacaactggcgtctcaacaacgtcacgggcatcgtacaggtgtacaacacggacaccgacgagtgggagcgggacctgcacttcccggagtccttcgcaggcatagcctgcgcccccgtcctgctgccccgggccgggaccaggaggtagcccccaagacccccgggaccctggcctgaccgcatgttgtctccaagtggggcttggcgaatgcacgtctgcctgagaaccccagtgccccccttcgcccgggctgcccttgaggggcctgctgcgttgataagcccccctcccaggggtccctccctccctccttcccaaagcagatcctggctgcgagtccatccgagggagcctgccggcaaagcgtctgacatgtggtggcagcaaattcgtccccggggtggtttcctcgcctggcccccgagtccccacgggctggcgggtggaatcccaggtctccagggggtccctgtgcagctccatctcacttctctactgcctcccagccccacggtttcaggcattcagatgtgagctcatcaacattgaacccaaagtcggtggtatatgactcaccctccttccaagtctcctgcgcgcgtgtttttaaaataaactcacccgaaacgtccgtaacacacggacctccaggagcagtgagaggtggcttagaagcccctggtttggggtgggtggaggaggagggcacgtgtctgcctcccctggggtgccctccttcccccatcccaagctgctgaggggaggccctggtcatgcctcagttcctgccttcatctgctttccggaggaaaaaccatatcaactcctagaaacgctccttaggggcttgggaccttccatttggcactgagcatcttgtggggccttaactggctgagacatcccggccctctacatttgccctgttggccaggcagtccccttcccgcaattggagggcgacgctaacttcagaatcccatagtggcgcttgccgcaggtctggtggggtgtcttttttctcctccctcctttccacccctccgcgccctgccactccctggcctgccctgtttttgggtcaacattgctacggagccagcagtgaggcctttcccttcaagggctctgtggtatctctggccacatttgttctaatgtctgaacctctaaatcttttctttttgattggttttactgtttttaagaagccagcactgctgtctcatagatgggatttgtactcttggggcaacttaaagtgtctctctcgctgctaacagacgattgatgtcttgtctctgtgacccactcaccatgtaaagaattaacctcctatcttagcagacatcgtctcctaatatttccctttatttaataaaaatgttatggtg

SEQ ID NO: 4432 - DNA, 989 bp, Homo sapiens
actcgaacgcgcgacggcggggggaagatggcggagtccggcggtagcagcggtggtgctggtggcggcggcgctttcggcgcgggcccgggccccgagcgcccgaacagcacggccgacaagaacggggccctcaagtgcaccttctcggcacccagccacagcaccagcctcctgcagggcctggccaccctccgcgctcagggccagctcctcgatgttgtgctgactattaacagagaggcctttcctgcacacaaggtcgtcctggctgcctgcagcgactacttcagggccatgttcaccggcggcatgcgggaggcaagccaggacgtcatcgagctgaagggcgtgtcggcccgtggcctgcggcacatcatcgacttcgcctacagcgccgaggtgacactggacctggactgcgtgcaggaggtagcccccaagacccccgggaccctggcctgaccgcatgttgtctccaagtggggcttggcgaatgcacgtctgcctgagaaccccagtgccccccttcgcccgggctgcccttgaggggcctgctgcgttgataagcccccctcccaggggtccctccctccctccttcccaaagcagatcctggctgcgagtccatccgagggagcctgccggcaaagcgtctgacatgtggtggcagcaaattcgtccccggggtggtttcctcgcctggcccccgagtccccacgggctggcgggtggaatcccaggtctccagggggtccctgtgcagctccatctcacttctctactgcctcccagccccacggtttcaggcattcagatgtgagctcatcaacattgaacccaaagtcggtggtatatgactcaccctccttccaagtctcctgcgcgcgtgtttttaaaataaactcacccgaaacgtccgtaacacacggacctccaggagcagtgagaggtggcttagaagcccctggtttggggtgggtggagga

SEQ ID NO: 4433 - DNA, 2395 bp, Homo sapiens
aagttgcccgccccacccgtaagagttagggtttgaccggagctagtgaggatccagcccaggctccagttgtccgcggttcctcctcctgtcgctgcccgtgtgattactgagactcagatggaccacacatccccgacctacatgcttgctaacttaacccacttgcattctgaacaacttctgcagggcttgaatcttcttcgccaacatcacgaactctgtgacatcattcttcgagtaggtgatgttaaaattcatgctcacaaagtggtacttgccagcgtcagcccgtatttcaaagctatgttcactggaaacctttctgaaaaagagaacagtgaggttgagtttcaatgcattgatgaaactgctctccaggccattgtggagtatgcctatacagggactgtttttatttctcaggacacagttgaatctctcctgccagcagcaaacctactccagataaaacttgtcctgaaagaatgttgtgcatttcttgaaagccaacttgatcctggtaattgtattggaatttctcgttttgcagaaacatatggttgccgtgacctttatttggcagccactaaatacatatgccagaattttgaagctgtttgccagactgaagagttttttgagcttacacatgctgacttggatgaaattgtttccaatgactgtttgaatgtagctaccgaagagactgttttttatgcattagagtcttggatcaagtatgatgtacaagaacgccagaaatacttagcacagttactaaacagtgtacgattaccattgttgagtgttaagtttctcactagactatatgaagcaaatcatcttattcgtgatgatcgcacttgtaaacatcttttgaatgaagccctaaagtaccactttatgcctgaacatagactctctcatcagacagtcttgatgacacgacctcgctgtgctcccaaagtactttgtgcagtaggagggaaatctggactctttgcctgtttggatagtgtggagatgtactttcctcagaatgactcttggattggtttggcacccctaaacattcctcgctatgaatttggaatatgcgttttagaccaaaaagtatatgttataggtggtattgcaactaatgtgcgtcctggcgtcactatcagaaaacatgaaaattcagtggaatgctggaatcctgatacaaatacttggacttctctagagagaatgaatgaaagccgaagtactcttggagtagtagtacttgcaggagaactttatgccttaggtggttatgatggacaatcttatttacaatctgtagagaagtacattcccaaaataagaaaatggcaacctgtggcaccaatgacgacaacaagaagttgttttgctgcagcggtattggatggaatgatatatgccattggtgggtatggtcctgcccacatgaacagtgtggagcgttatgatccaagtaaggactcctgggagatggttgcatccatggcagataaaaggattcactttggcgtgggtgtcatgctaggctttatttttgtggtgggtggacataatggagtctcacatttgtccagcattgaaagatacgatcctcatcaaaatcagtggactgtgtgtagaccaatgaaagaacctagaacaggagttggtgctgctgtaatcgataactacctttatgtcgtcggtggtcactcagggtcttcctatctgaatacagtgcagaaatatgatcctatctcagatacgtggctggattcagctggcatgatatactgtcgctgcaactttgggttaactgcactttgacaaatgtgaactctcggaaatagtatggtggtgaaacttgtactgcatgaacatccggatggcccagttttctgaaacccacaagctgcattgctttctttttaacttgaagtagcatgaaggctcaaaagttttgttgggtacttttaattgagaagtagttttggttgctcttgattacacagtaaatcaataatcaaaaagaaaaaagagaaaaaaaaaaagtaaagactttgccaattgaattctgcactttttcccccaagactgagatgtactagttttatgttcataagtgtacatgtagacaaaacgtggctgctttttttttttttttttttttattttagctctccttccctgataaccatgattttctaggatgagcgatgctttaggtgctggagtgtattgaatgaatggacagagtgctgatactgcttcttggatgtaaatgcttcacatttttcatttgttttaaaacaaacaaagggctgctttttattttggtacttttaaaggttgtaaataacatgccaataggtagtcatctgaatac

SEQ ID NO: 4434 - DNA, 546 bp, Homo sapiens
agtgttccagagagctaccaaagtgctttctgtgaggaagtcccatggtctggtttatatcttaacagcatcaatggctgttatatgagatggagtaataatgcaagcatggaaaccggtgatgaaactacaatagccatgtgggagataattacggcatgaactagagggatggcagcagagactgcagtagccaactgtcctttgtaatctgctccaccttttttggagggcacagtggaatttgggaggagaggagaaaactaactatacctcgtattttgctccaatgagatggaccacacatccccgacctacatgcttgctaacttaacccacttgcattctgaacaacttctgcagggcttgaatcttcttcgccaacatcacgaactctgtgacatcattcttcgagtaggtgatgttaaaattcatgctcacaaagtggtacttgccagcgtcagcccgtatttcaaagctatgttcactggaaacctttctgaaaaagagaacagtgaggttgagtttcaatgcattgatgaaact

SEQ ID NO: 4435 - DNA, 859 bp, Homo sapiens
ggaagttgcccgccccacccgtaagagttagggtttgaccggagctagtgaggatccagcccaggctccagttgtccgcggttcctcctcctgtcgctgcccgtgtgattactgagactcaggtattttccttttgctgtcctccagcggtgcaggctttggcagtgttttgcccgaatgccactggtgctagagtaagaggcaaaggactgagcggagcaggtggaaagagaggcgacatcttcttgtgcagggctcgtcacccttgtaaacgcgttactctctaccaccctgagtaactgcgatcctttcctcttgccatctgcttatcaggacagaagatctggaccacggccaagctcacaaatcggatggaccacacatccccgacctacatgcttgctaacttaacccacttgcattctgaacaacttctgcagggcttgaatcttcttcgccaacatcacgaactctgtgacatcattcttcgagtaggtgatgttaaaattcatgctcacaaagtggtacttgccagcgtcagcccgtatttcaaagctatgttcactggaaacctttctgaaaaagagaacagtgaggttgagtttcaatgcattgatgaaactgctctccaggccattgtggagtatgcctatacagggactgtttttatttctcaggacacagttgaatctctcctgccagcagcaaacctactccagataaaacttgtcctgaaagaatgttgtgcatttcttgaaagccaacttgatcctggtaattgtattggaatttctcgttttgcagaaacatatggttgccgtgacctttatttggcagccactaaatacatatgccagaa

SEQ ID NO: 4436 - DNA, 656 bp, Homo sapiens
tgaccaaaccgattgcttccatggtgatgtacccagcgcggacctcttgacccggaaatccacttgccgtgatgaatgctgggttatgtagtccacgtcaggtgttgagactaggccaaagtctcctggaagaggaagtcagaacgttgtaaacgcagctacagcggagaagggaggaggggtgaagccatttgacggatgtgacgctttccttgctctgggcggaagttgcccgccccacccgtaagagttagggtttgaccggagctagtgaggatccagcccaggctccagttgtccgcggttcctcctcctgtcgctgcccgtgtgattactgagactcagacatccaggaatattgaacgtcagtgtgaattctgtaaactattaagaattttgtgtagtttgagaagttattgtgaagaaatgctatgcaaatgaaagttgctattaatattaacaaacaatcataataataccatgttttgagtatttgctatgtgccatgcaccatgctagatggaccacacatccccgacctacatgcttgctaacttaacccacttgcattctgaacaacttctgcagggcttgaatcttcttcgccaacatcacgaactctgtgacatcattcttcgagtaggtgatgttaaaat

SEQ ID NO: 4437 - DNA, 5287 bp, Homo sapiens
ggtccccgcgccgcggccgcgccagcccccgcgccgccgccgccgtccccgccaccgcggatctcgccgcagctccagccccggccccggctccgcagcgcccgtccgcagccccggcggtcgccgcgcttgagcgcagcccccgcccggagcccgagccgcgagcccggagccagccccagccccgcggccgccgcggctgcggggagagggcgggggcgatgctgccggagccgccgccgccgccgccgcctcgatgagagccgcgccgcaccgctcatagccgcacaggctgacaggcaggaggaccgacttccctctcccgggcatcctccctgggctgccgggaggcggcggcggcggaggaggaggaggaacgaggggagaaggcggagagcaggaacgcgaggaggaggacctggatccgtttcctccggccaggacccgagcggccccagccaccgctacccgccggcgctgtccgctctccatcagccctcctgcgcccacccgcgaccccgggctctctgcgcgtcgggccggggccggagccgcgcgccggagactatctggcttcctggtgatgctcacgctttgctaagtgttggcggccatcgtggttttcgcatcctggggacgaatcctgagcttgccagagacgggcggcgcaaggtccgggctctgtttccctgtgagaagccgcctcggcccaccgagatgtcccggcaccatagccgcttcgaaagagattaccgggtgggctgggaccgccgcgaatggagcgtcaacgggacgcatgggaccaccagcatctgcagtgtcacctcgggggccggtggcggcacagccagcagcctcagcgtccggcccggcctcctgccgctgcccgtggtgccctcccggctgcccaccccggctacagctcctgctccctgcaccaccggcagcagcgaggccatcaccagcctcgtggccagctctgcgtctgcggtcaccaccaaggctcccggcatctccaaaggggacagtcagtcccagggactggcgaccagcatccggtgggggcagacgcctatcaatcagtccacaccctgggacactgatgagccaccctccaaacagatgagagagagtgacaatccaggcacagggccatgggtgaccacggtggccgccgggaaccagcccaccctgattgcacactcctatggagtggcccagcctcccaccttcagcccggctgtgaacgtccaggccccggtcattggggtgaccccctcactgcctccccacgtggggccccagctcccgctgatgccaggccactactcgctccctcagccgccctctcagccactgagcagcgtggtggtcaacatgcctgcccaggccctgtatgccagccctcagcccctggccgtgtccacactgcccggtgtggggcaggtggcccgcccaggacccaccgctgtgggcaacggccacatggcagggcccctgctgcctccaccgccgccagcccagccgtccgccactctccccagtggtgcccctgccaccaatgggccccccacaaccgactcggcccacgggctgcagatgctgcggaccattggcgtggggaagtatgagttcaccgacccggggcaccccagagaaatgttgaaggaattgaaccagcaacgcagagcgaaagcgtttacagacctgaaaattgttgttgaaggcagagagtttgaagtccaccaaaatgttctagcttcctgcagcttgtatttcaaggacctgattcaaaggtccgtgcaagacagcggccagggcggccgggagaagctggagctcgtcctgtcgaacctgcaggcagacgtcctggagttgctgctggagtttgtctacacgggctccctggtcatcgactcggccaacgccaagacactgctggaggcggccagcaagttccagttccacaccttctgcaaagtctgcgtgtcctttctcgagaagcagctgacggccagcaactgcctgggcgtgctggccatggccgaggccatgcagtgcagcgagctctaccacatggccaaggccttcgcgctgcagatcttccccgaggtggccgcccaggaggagatcctcagcatctccaaggacgacttcatcgcctacgtctccaacgacagcctcaacaccaaggctgaggagctggtgtacgagacagtcatcaagtggatcaagaaggaccccgcgacacgcacacagtacgcggctgagctcctggccgtggtccgcctccccttcatccaccccagctacctgctcaatgtggttgacaatgaagagctgatcaagtcatcagaagcctgccgggacctggtgaacgaggccaaacgctaccatatgctgccccacgcccgccaggagatgcagacgccccgaacccggccgcgcctctctgcaggtgtggctgaggtcatcgtcttggttgggggccgtcagatggtggggatgacccagcgctcgctggtggccgtcacctgctggaacccgcagaacaacaagtggtaccccttggcctcgctgcccttctatgaccgcgagttcttcagtgtagtgagtgcaggggacaacatctacctctcaggtgggatggaatcaggggtgacgctggctgatgtctggtgctacatgtccctgcttgataactggaacctcgtctccagaatgacagtcccccgctgtcggcacaatagcctcgtctacgatgggaagatttacaccctcgggggacttggcgtggcaggcaacgtggaccacgtggagaggtacgacaccatcaccaaccaatgggaggcggtggcccctctgcccaaggcagtacactctgctgcagccacagtgtgtggcggcaagatctacgtgtttggtggggtgaacgaggcaggccgagctgccggcgtcctccagtcttacgttcctcagaccaacacgtggagcttcatcgagtccccaatgattgacaacaagtatgcccccgctgtcacgctcaatggcttcgttttcatcctgggcggggcttatgccagagctaccaccatctacgaccctgagaaaggaaacattaaggcgggcccaaacatgaaccactctcgccagttctgcagtgctgtggtgcttgatggcaagatttatgcaactggaggtattgtcagcagtgaagggcccgcgctgggcaacatggaggcctacgagcccacaaccaacacatggaccctcctcccccacatgccctgccctgtgttcagacacggctgcgtcgtgataaagaaatatattcaaagcggctgacatcagcagaaagcccacgataagactgtggacaagtctggtgaggcaagtgccacgcaatgataattttccagcgacaccaacaagaggccaacaaaacacaatcaaggaactcactgcgctcaacatgttgaatattctctacattgaatgtagaaaatcatcctcgcctttggatgaaacggaggcaccgcgcttggagccgcaggaaccacgatcccgccatggggctggctgcctcctgaacaggggcgctcgctctgccaggtgcaatagagtttcacgtatttttcaactgggagagagaagctgttttttccttcctgcagagcaagcttgatccctaaacaaccatagatcagttatcttatgacaacattaggcatcaggctctcttggaataagatcaaagtgtccttatcactttgattcctacttttgttttttaaccgatctacactttcagtggccgacagaaaacgagggacaatactgtgcatcacaaggcctaggaggctgctggtccccactggggctgaagagaagcccagctgcccacgcggagccaggggtggcagctgtgggacagccggggagcagggacagcggtctgtccttcacaggtttttctactgtgtttttgctggagaaggacagtgattgcgctagctttctcttacccggtatgaattatttagatttctgaggcattttcttgataaacaaaaggctatttttaagtactgagaggaggagcaggccacaagagggataatgttgtgggaattcccaaagctctttgtaggtagtgccagaggggggcttttgctctcatttttctatgtgcagaatagaggatctctcctggggtgggcgatgcccccattttatttttagaaaaagtaactcccagacagccccataaaagctgtgcccaaggaagaagagtctgctctagaaggagcccggttctggctcaggacaccggcccagctccctccatgaggtcaagctgaggaccaggccagtgggaagggaaggagggagaattagcgtctataaagcacaggagactatttttgatattcatagctatatattaaggcacctgccacaagagctctcaggatggggacagccttcttagtggagccatggcagcaaggcctgagggcatgaacagaaccactcttcttgtcacatacgaacctgagaaaagggaagccaggagggaggtcacaccatggctcaaaagggaaaggccttcccacttgtccttagcccctcaaacctcacacggtcaacagtttccattccagggcaggagaatgctgccgccactgcgctgttgagttgaagttggtaccaaatacacatttaccacttttatatctgggaagtcaacttgccatcgtttcatgataacaaccatttataagagaaaaagacaggacacgctttccatcgttcagtatttgatgacacaaaattccagttctaacgttgggcatcaacttctagcactacgagtgtggctcccacttggacaagataccgagcttcgttatgcagtttttaatattatttattattttaaaaagtaataagcacaaaactacatacattgtatgtcatttaaagtatttatgtcaaacagggtgcaagtgtgaacccaaggactggagcacaaattcctaactgcctggggcagggctaatgttagcattggtgtgcgtctgcctccaaaggaggttctagttgtcagcgagactcaacacagatgacattgaaattcgtttctctcctcatctatcacactggagcaaaactggctatttctgtgaatgatataaaacagggttctctgtaatggtattgtacatagtatatgtttactgttaagttcttgttatattataataaatatatttatagatctaga

SEQ ID NO: 4438 - DNA, 3685 bp, Homo sapiens
ctgtgttctcagcttcgaggtccaggctgagtgagaggagctcgggcggctccaggcacttcttcccttgagtgggtggactactgaggtcccctgggcacggcgtcatggtgcggaacgtggatgacctggatttccacctgccctcgcatgcccaggacatgctggatggcctgcagcgcctgcgctctcagcccaagctggccgacgtcacactgctggtgggcggccgggagctgccatgccaccgcggcctcctggcgctcagcagcccctacttccatgccatgtttgcgggtgacttcgccgagagcttctctgcgcgcgtggagctgcgggacgtggagcccgccgtggtgggacaactggtggacttcgtgtacacaggccggctgaccatcacgcagggcaacgtggaggcgctgacacgcacggctgcgcgcctgcacttcccctcggtgcagaaggtctgcggccgctacctgcagcagcaactggatgccgccaactgcctgggcatctgtgagttcggggagcagcaagggctgctgggcgtggctgccaaggcctgggccttcctgcgagagaactttgaggctgtggcacgtgaggacgagttcctgcagcttccccgagagcggctggtcacttgtctggccggcgacctgctgcaggtacagccggagcaaagccgactcgaggccctgatgcgctgggtgcgccatgacccgcaggcccgggccgcccacctgcccgagctgctcagcctagtgcacctggacgccgtgcccaggccctgcgtgcagcaactgctggcctcagagcccctgatccaggagtcagaggcatgccgggcagccctgtcccagggccatgatggggcaccactcgccctccagcagaagctggaggaggtcctggtggtggtgggcgggcaggcgctggaggaggaggaggcaggtgaggagcccacccccggccttgggaactttgccttctacaacagcaaggccaagaggtggatggcacttccagacttccccgactatcacaagtggggtttctccctggcggccctgaacaacaacatctatgtcacaggtggctctcggggcacaaagacagacacctggtcaaccacccaggcctggtgcttccccctgaaggaggcctcctggaagcccgtggcgcccatgctgaagccccgcaccaaccacgccagcgcggccctcaatggggagatctacgttatcggcggcaccaccctggacgtggtggaggtggagagctatgacccctacacggacagctggacgcccgtcagcccggccctcaaatacgtcagcaacttctcggctgccggctgccggggccggctctacctggtgggctccagcgcctgcaagtacaacgccctggccctgcagtgctacaaccctgtcacagatgcgtggagtgtgatcgcctcgcccttcctgcccaagtacctgtcctcgcctcgctgtgctgcactgcacggggagctctacctcattggggacaacaccaagaaggtctacgtgtacgaccccggggccaacctgtggcagaaggtgcagtcacagcacagcctgcatgagaatggcgcgctggtgccactgggtgatgcgctgtacgtgacgggcggccgctggcagggcatggaaggtgactaccacgtggagatggaggcctacgacacggttcgggacacctggacccgccacggcgccctgccccggctctggctctaccacggggcctccaccgtcttcctggatgtctccaagtggacccagccctccggccccacccaggagcactaaaccagggccagggtccccggggaggagtccccacagcggcccctcatcagcctgtggaacggcccctttcattttcgcttatttgttcactcggagctaccattccttccaagctgcgctcaggccaccaggggtgatcagacggcatggcttggaggacacagccttggtctctgtggccaccacactaaactctgagctgagcagtgacaagggcctgagtgccagacgctggcataacagggacaggaagctctgctgcccctggggttcccgagacctcagagaggggagccgggggccgggccagcattcccagagcttgcgagccccactcctgcccctggaccccagcaggggcttttggagcagttgcatgaatgtggggtgaacacggagcgtcccagaaagctgaggctgctggggaaggcaggccccggagatgggatcagcaccaggtcctcgtgggcctgcttctgcccagctcacggcagcgtaactgtggccagccacctcccctctctgggcttcaagctccgcgtccaccacacacggggctggctgtgtgggctttgggtccccactcaggctttgcatgttggtgctgtgtttctgcttctgtggacaaaggaggcccccacccatctcttgcacccagagggcggtgcccacagaggcaccaggaaggagggaggcagggcgtggggcggggctggagggtcccagggaggtgagcagttttgctctcagaagggattgcctccgtctctgtgtgtcagaacaaaggctcttcattagaatggaatttcccaccaggggacgactcttgggtgcattggtggcagcctcctgagggtgaggggtagcatccgatgggcccctgccagcatgcagcccgactccggctggctcaggctccgagtggcttctccctcatcctgaatgaggcacccacctttgcagctaaggagacaatgaaggactctccctgggtgcccaatggcgtgtccctcctgtcacaggctccgccctgggacatggggctagaagtcaggagtcgggcccggccaggcacaggccctggtgttgccccagaggccctgggcagctccggtctcccgccggatccaggcttcctctccaggaccagcccctgggttcctccttaacaccccccgcccctggggaccagaggggcctctgacatccttgggttctgaggacggaaacccctgagcctcttgagcttctgtaggtagggatctgctttgctcccagacctgcctctcatagcttttttttttttttttttttttttttgagacggagtctcgctcttgtcgtccaggctggagtgcaatgctgagatcttggctcactgcaacctccacctcccgggttcaagagattctcctgccttagcctctcaagtagctgggattacaggcactcgccaccacgcctgactaatttttgtatttttagtagaaacagggtttcaccatgttgaccaggctggtcttgaactcctgacctcaggtgatccgcccgcctcagcctcccaaagtgctgggattacaaggtgtgggagaagtgagttgaccctggagggccagacagagtggggcctctgggtgctaccaaaggaacaagagcccagagctgaggagaccttcggtggcagatggattggatgaagcaagggtgagggtttctggggccctgggctctgtttccatgtggaaatctgaaatgttttctagacagtgatggaaggaggtcagccaaagggctgtttaaaaacaaagcctccatgtaaaccatttctgcaagaatatttt

SEQ ID NO: 4439 - DNA, 3726 bp, Homo sapiens
ctgtgttctcagcttcgaggtccaggctgagtgagaggagctcgggcggctccaggcacttcttcccttgagtgggtggactactgaggtcccctgggcacggcgtcatggtgcggaacgtggatgacctggatttccacctgccctcgcatgcccaggacatgctggatggcctgcagcgcctgcgctctcagcccaagctggccgacgtcacactgctggtgggcggccgggagctgccatgccaccgcggcctcctggcgctcagcagcccctacttccatgccatgtttgcgggtgacttcgccgagagcttctctgcgcgcgtggagctgcgggacgtggagcccgccgtggtgggacaactggtggacttcgtgtacacaggccggctgaccatcacgcagggcaacgtggaggcgctgacacgcacggctgcgcgcctgcacttcccctcggtgcagaaggtctgcggccgctacctgcagcagcaactggatgccgccaactgcctgggcatctgtgagttcggggagcagcaagggctgctgggcgtggctgccaaggcctgggccttcctgcgagagaactttgaggctgtggcacgtgaggacgagttcctgcagcttccccgagagcggctggtcacttgtctggccggcgacctgctgcaggtacagccggagcaaagccgactcgaggccctgatgcgctgggtgcgccatgacccgcaggcccgggccgcccacctgcccgagctgctcagcctagtgcacctggacgccgtgcccaggccctgcgtgcagcaactgctggcctcagagcccctgatccaggagtcagaggcatgccgggcagccctgtcccagggccatgatggggcaccactcgccctccagcagaagctggaggaggtcctggtggtggtgggcgggcaggcgctggaggaggaggaggcaggtgaggagcccacccccggccttgggaactttgccttctacaacagcaaggccaagaggtggatggcacttccagacttccccgactatcacaagtggggtttctccctggcggccctgaacaacaacatctatgtcacaggtggctctcggggcacaaagacagacacctggtcaaccacccaggcctggtgcttccccctgaaggaggcctcctggaagcccgtggcgcccatgctgaagccccgcaccaaccacgccagcgcggccctcaatggggagatctacgttatcggcggcaccaccctggacgtggtggaggtggagagctatgacccctacacggacagctggacgcccgtcagcccggccctcaaatacgtcagcaacttctcggctgccggctgccggggccggctctacctggtgggctccagcgcctgcaagtacaacgccctggccctgcagtgctacaaccctgtcacagatgcgtggagtgtgatcgcctcgcccttcctgcccaagtacctgtcctcgcctcgctgtgctgcactgcacggggagctctacctcattggggacaacaccaagaaggtctacgtgtacgaccccggggccaacctgtggcagaaggtgcagtcacagcacagcctgcatgagaatggcgcgctggtgccactgggtgatgcgctgtacgtgacgggcggccgctggcagggcatggaaggtgactaccacgtggagatggaggcctacgacacggttcgggacacctggacccgccacggcgccctgccccggctctggctctaccacggggcctccaccgtcttcctggatgtctccaagtggacccagccctccggccccacccaggagcactaaaccagggccagggtccccggggaggagtccccacagcggcccctcatcagcctgtggaacggcccctttcattttcgcttatttgttcactcggagctaccattccttccaagctgcgctcaggccaccaggggtgatcagacggcatggcttggaggacacagccttggtctctgtggccaccacactaaactctgagctgagcagtgacaagggcctgagtgccagacgctggcataacagggacaggaagctctgctgcccctggggttcccgagacctcagagaggggagccgggggccgggccagcattcccagagcttgcgagccccactcctgcccctggaccccagcaggggcttttggagcagttgcatgaatgtggggtgaacacggagcgtcccagaaagctgaggctgctggggaaggcaggccccggagatgggatcagcaccaggtcctcgtgggcctgcttctgcccagctcacggcagcgtaactgtggccagccacctcccctctctgggcttcaagctccgcgtccaccacacacggggctggctgtgtgggctttgggtccccactcaggctttgcatgttggtgctgtgtttctgcttctgtggacaaaggaggcccccacccatctcttgcacccagagggcggtgcccacagaggcaccaggaaggagggaggcagggcgtggggcggggctggagggtcccagggaggtgagcagttttgctctcagaagggattgcctccgtctctgtgtgtcagaacaaaggctcttcattagaatggaatttcccaccaggggacgactcttgggtgcattggtggcagcctcctgagggtgaggggtagcatccgatgggcccctgccagcatgcagcccgactccggctggctcaggctccgagtggcttctccctcatcctgaatgaggcacccacctttgcagctaaggagacaatgaaggactctccctgggtgcccaatggcgtgtccctcctgtcacaggctccgccctgggacatggggctagaagtcaggagtcgggcccggccaggcacaggccctggtgttgccccagaggccctgggcagctccggtctcccgccggatccaggcttcctctccaggaccagcccctgggttcctccttaacaccccccgcccctggggaccagaggggcctctgacatccttgggttctgaggacggaaacccctgagcctcttgagcttctgtaggtagggatctgctttgctcccagacctgcctctcatagcttttttttttttttttttttttttttgagacggagtctcgctcttgtcgtccaggctggagtgcaatgctgagatcttggctcactgcaacctccacctcccgggttcaagagattctcctgccttagcctctcaagtagctgggattacaggcactcgccaccacgcctgactaatttttgtatttttagtagaaacagggtttcaccatgttgaccaggctggtcttgaactcctgacctcaggtgatccgcccgcctcagcctcccaaagtgctgggattacaaggtgtgggagaagtgagttgaccctggagggccagacagagtggggcctctgggtgctaccaaaggaacaagagcccagagctgaggagaccttcggtggcagatggattggatgaagcaagggtgagggtttctggggccctgggctctgtttccatgtggaaatctgaaatgttttctagacagtgatggaaggaggtcagccaaagggctgtttaaaaacaaagcctccatgtaaaccatttctgcaagaatattttaaaataaataaaaataaaactgaagacatgaaatgtcaaaa

SEQ ID NO: 4440 - DNA, 708 bp, Homo sapiens
tgattcctctgcacacttctaaggctgagaacctgaggaacccagctggaaaatgccgtctgaacgctgcctcagtattcaagaaatgctgacaggccagaggctctgccactccgaatctcacaatgacagtgtcctggcagcgctgaatcagcagaggagtgatggcatcctctgcgacatcaccctgattgctgaggaacagaaattccatgctcacaaggcagtcctagcagcatgcagtgactatttccgggcaatgttcagtctttgtatggtggaaagtggagctgatgaggttaatttgcacggtgtgaccagccttggcttaaagcaggctctggagtttgcatacacaggacagattttgctggagccaggtgtgatccaggatgtgctagcagcgggcagtcacctacagctgttggagcttctcaatttatgctcccactatctcatccaggtggagtaactaatacggcacaatatcagaacaggctaatggtgtatgaacctaaccagaataagtggataagccgtagccccatgctgcagagaagggtctaccattccatggctgctgtacaaaggaagctttatgttcttggaggcaatgacctagactacaataatgaccggatccttgtgcgccatatagattcttacaacatagacactgaccagtggacacgttgtaatttcaacctg

SEQ ID NO: 4441 - DNA, 3886 bp, Homo sapiens
ggcgtctgaacccgccccgggggtgccaaggtgcgtctccagtctgacgcgaccgcctggggcggagtcagcgggacgtgccacctgcagtgctggctagggctttttatttactagggagcagtttccccgcgcgacagttcgggagcgcgcaggcagtcgcgcgcacacacgcacgcaggcacacacacacacacacacacacacacacacacactttcgcacacacaaacacgctaggacgctcgtcttcgctactgcatccccgaaccagcagagcgaagctactgcgggttctgttaacctcagcatcgtggggcgaagcagagccattgtgcatcaaggagaggccggtgcctgcgctgccgtctctggcacctaacccagcagaccgctcaccccatcggctggaatgcttgctgattcctctgcacacttctaaggctgagaacctgaggaacccagctggaaaatgccgtctgaacgctgcctcagtattcaagaaatgctgacaggccagaggctctgccactccgaatctcacaatgacagtgtcctggcagcgctgaatcagcagaggagtgatggcatcctctgcgacatcaccctgattgctgaggaacagaaattccatgctcacaaggcagtcctagcagcatgcagtgactatttccgggcaatgttcagtctttgtatggtggaaagtggagctgatgaggttaatttgcacggtgtgaccagccttggcttaaagcaggctctggagtttgcatacacaggacagattttgctggagccaggtgtgatccaggatgtgctagcagcgggcagtcacctacagctgttggagcttctcaatttatgctcccactatctcatccaggaattaaatagctttaattacttggatctgtacagacttgctgacctctttaacctcactttgttggagaaggcagtgatcgatttcttagtgaaacatctctctgaactcctgaagagccgcccagaagaagttctaacgcttccctattgcctgcttcaggaggtgctgaagagcgaccgcctgacctccctgagtgaagagcagatctggcagaagtgtggaatttgtgctgccttttgtgcactgaggggagactggtgccctggcttacctcaatgggatgacaagactgctagctgtgaggtggttggaacacaactgccactaccagtacatggacgagctcctgcaatacatccgctttggcctaatggatgtggatactctccatacagttgccctgtcccacccccttgtccaagcaagtgagactgcaacagcccttgtcaacgaggccctggaataccaccagagcatctatgcacagcctgtctggcagactcgcaggaccaaaccacgattccagtcagacactctgtatatcattggtgggaaaaagcgcgaggtctgcaaggtcaaggaacttcggtacttcaatcctgttgatcaggagaatgctctcatagctgccattgccaactggagtgagctggctcccatgcctgtgggaaggagccaccattgtgtggcagtcatgggggacttcctgtttgtggcaggaggggaagttgagcatgccagtggccggacgtgtgctgtgaggactgcctgtcgctatgacccccgcagtaattcctgggcagagatagcacccatgaaaaactgccgggagcattttgtgctgggtgccatggaggaatacctctatgcagttgggggcagaaatgaactgcgccaggttctgcctacagttgagcgatattgccccaagaagaacaaatggacttttgttcagtcctttgacagatccctttcatgccatgctggatatgtggctgatggtcttctttggatatcaggtggagtaactaatacggcacaatatcagaacaggctaatggtgtatgaacctaaccagaataagtggataagccgtagccccatgctgcagagaagggtctaccattccatggctgctgtacaaaggaagctttatgttcttggaggcaatgacctagactacaataatgaccggatccttgtgcgccatatagattcttacaacatagacactgaccagtggacacgttgtaatttcaacctgctgactggccaaaatgaatctggagttgctgtccataatgggagaatatatttagttggtggatattcaatttggacaaatgagcctctggcttgtatccaggtactggatgtaagcagagaaggcaaagaagaagtattctatgggcctacactcccttttgcttccaatggaatagcagcatgcttccttccagctccatattttacatgccctaaccttcaaactcttcaagtgcctcatcacaggattggcaccatctgaaaagccaagccatcatgaacaggaggaaaacatagctctgactgttggatactgggcatgaaaagactcagtgctccatgcttccttgtcttgctttataggtcttatattcggataaatttaagcaaaaaatgaacaattttctaaaatacgttattgaaaactcgtcacccttctcagtgtatgtcaacattcaatatgtatgacttttattgtggtatagcttagtgccaatttaaggtatattgtgttccatgggtctttagagcattctttgtacactttttctaatcagcactgtcttaagacaacataacactgttagtaaggcaatttattggacacaatggcatcgatgatcttaaaaatatatatattctgtacttaatccctttattatttaaagccgggcttgtaatttttctttttaaaatttaacattatgcagccctgctcagtagagactcactcagcattatgacatcataaatttttaaatgccatattttattcaaggtgatacgaataataatagacatacactggaacagcagttgttgaaatacccagatttttcaccttggttactctgaccttgggtcagaacctaactttacagtgcttcagttttcccaccttttaaggaggataattactgatttccacgttaatttaaaagaacattatgaggattaggcgaacactttgtaatactttgcccaagaaaaagaaaaatgttgttactgaaattataaggtattttattgtctttagaaccttgtaattgaacagggagattatttttgaagtttaaaaattactagatagaatttggaaacatgttgtggaataaatgattctaaaaagcatgtgaaagagacacacaatgaggaaatagggagtttctcaaaatctaaacttgtacaggtatctaaacttgcctcaagtaactctcagatgtcttatttaaaatcatttagtgaaaaatgacatttaaagctaaaaaataatttagttgtactaattatggtaccataaagtgctttgacataaatttgaacctagaattggcagttctaataaaagtttttccactttgttaaaggttatgtcaatcttgagtgcttgtggaattcttcaccaccaatacatattttattactatctcttttaataatgcataggaattcttttttagactagtttttgggtttgctttgtctataacaaaaaataaatacaacaacttaataatcacatttgaaaacaaatttaacaagtataatgtgagtttttcttttttcctaacttcctcaggacctaggtcacctttattaaaaggaagaattcactcttttttccttggcagtttaatcattcaggaatccctctcttaaaggaaattgttattttattcatgtaacctttttttgtaatcaaaagtgaataaaaacgatctttttgtcttacag

SEQ ID NO: 4442 - DNA, 3698 bp, Homo sapiens
tttactagggagcagtttccccgcgcgacagttcgggagcgcgcaggcagtcgcgcgcacacacgcacgcaggcacacacacacacacacacacacacacacacacactttcgcacacacaaacacgctaggacgctcgtcttcgctactgcatccccgaaccagcagagcgaagctactgcgggttctgttaacctcagcatcgtggggcgaagcagagccattgtgcatcaaggagaggccggtgcctgcgctgccgtctctggcacctaacccagcagaccgctcaccccatcggctggaatgcttgctgattcctctgcacacttctaaggctgagaacctgaggaacccagctggaaaatgccgtctgaacgctgcctcagtattcaagaaatgctgacaggccagaggctctgccactccgaatctcacaatgacagtgtcctggcagcgctgaatcagcagaggagtgatggcatcctctgcgacatcaccctgattgctgaggaacagaaattccatgctcacaaggcagtcctagcagcatgcagtgactatttccgggcaatgttcagtctttgtatggtggaaagtggagctgatgaggttaatttgcacggtgtgaccagccttggcttaaagcaggctctggagtttgcatacacaggacagattttgctggagccaggtgtgatccaggatgtgctagcagcgggcagtcacctacagctgttggagcttctcaatttatgctcccactatctcatccaggaattaaatagctttaattacttggatctgtacagacttgctgacctctttaacctcactttgttggagaaggcagtgatcgatttcttagtgaaacatctctctgaactcctgaagagccgcccagaagaagttctaacgcttccctattgcctgcttcaggaggtgctgaagagcgaccgcctgacctccctgagtgaagagcagatctggcagctagctgtgaggtggttggaacacaactgccactaccagtacatggacgagctcctgcaatacatccgctttggcctaatggatgtggatactctccatacagttgccctgtcccacccccttgtccaagcaagtgagactgcaacagcccttgtcaacgaggccctggaataccaccagagcatctatgcacagcctgtctggcagactcgcaggaccaaaccacgattccagtcagacactctgtatatcattggtgggaaaaagcgcgaggtctgcaaggtcaaggaacttcggtacttcaatcctgttgatcaggagaatgctctcatagctgccattgccaactggagtgagctggctcccatgcctgtgggaaggagccaccattgtgtggcagtcatgggggacttcctgtttgtggcaggaggggaagttgagcatgccagtggccggacgtgtgctgtgaggactgcctgtcgctatgacccccgcagtaattcctgggcagagatagcacccatgaaaaactgccgggagcattttgtgctgggtgccatggaggaatacctctatgcagttgggggcagaaatgaactgcgccaggttctgcctacagttgagcgatattgccccaagaagaacaaatggacttttgttcagtcctttgacagatccctttcatgccatgctggatatgtggctgatggtcttctttggatatcaggtggagtaactaatacggcacaatatcagaacaggctaatggtgtatgaacctaaccagaataagtggataagccgtagccccatgctgcagagaagggtctaccattccatggctgctgtacaaaggaagctttatgttcttggaggcaatgacctagactacaataatgaccggatccttgtgcgccatatagattcttacaacatagacactgaccagtggacacgttgtaatttcaacctgctgactggccaaaatgaatctggagttgctgtccataatgggagaatatatttagttggtggatattcaatttggacaaatgagcctctggcttgtatccaggtactggatgtaagcagagaaggcaaagaagaagtattctatgggcctacactcccttttgcttccaatggaatagcagcatgcttccttccagctccatattttacatgccctaaccttcaaactcttcaagtgcctcatcacaggattggcaccatctgaaaagccaagccatcatgaacaggaggaaaacatagctctgactgttggatactgggcatgaaaagactcagtgctccatgcttccttgtcttgctttataggtcttatattcggataaatttaagcaaaaaatgaacaattttctaaaatacgttattgaaaactcgtcacccttctcagtgtatgtcaacattcaatatgtatgacttttattgtggtatagcttagtgccaatttaaggtatattgtgttccatgggtctttagagcattctttgtacactttttctaatcagcactgtcttaagacaacataacactgttagtaaggcaatttattggacacaatggcatcgatgatcttaaaaatatatatattctgtacttaatccctttattatttaaagccgggcttgtaatttttctttttaaaatttaacattatgcagccctgctcagtagagactcactcagcattatgacatcataaatttttaaatgccatattttattcaaggtgatacgaataataatagacatacactggaacagcagttgttgaaatacccagatttttcaccttggttactctgaccttgggtcagaacctaactttacagtgcttcagttttcccaccttttaaggaggataattactgatttccacgttaatttaaaagaacattatgaggattaggcgaacactttgtaatactttgcccaagaaaaagaaaaatgttgttactgaaattataaggtattttattgtctttagaaccttgtaattgaacagggagattatttttgaagtttaaaaattactagatagaatttggaaacatgttgtggaataaatgattctaaaaagcatgtgaaagagacacacaatgaggaaatagggagtttctcaaaatctaaacttgtacaggtatctaaacttgcctcaagtaactctcagatgtcttatttaaaatcatttagtgaaaaatgacatttaaagctaaaaaataatttagttgtactaattatggtaccataaagtgctttgacataaatttgaacctagaattggcagttctaataaaagtttttccactttgttaaaggttatgtcaatcttgagtgcttgtggaattcttcaccaccaatacatattttattactatctcttttaataatgcataggaattcttttttagactagtttttgggtttgctttgtctataacaaaaaataaatacaacaacttaataatcacatttgaaaacaaatttaacaagtataatgtgagtttttcttttttcctaacttcctcaggacctaggtcacctttattaaaaggaagaattcactcttttttccttggcagtttaatcattcaggaatccctctcttaaaggaaattgttattttattcatgtaacctttttttgtaatcaaaagtgaataaaaacgatctttttgtcttacag

SEQ ID NO: 4443 - DNA, 791 bp, Homo sapiens
attttgctggagccaggtgtgatccaggatgtgctagcagcgggcagtcacctacagctgttggagcttctcaatttatgctcccactatctcatccaggaattaaatagctttaattacttggatctgtacagacttgctgacctctttaacctcactttgttggagaaggcagtgatcgatttcttagtgaaacatctctctgaactcctgaagagccgcccagaagaagttctaacgcttccctattgcctgcttcaggaggtgctgaagagcgaccgcctgacctccctgagtgaagagcagatctggcagaagtgtggaatttgtgctgccttttgtgcactgaggggagactggtgccctggcttacctcaatgggatgacaagactgctagctgtgaggtggttggaacacaactgccactaccagtacatggacgagctcctgcaatacatccgctttggcctaatggatgtggatactctccatacagttgccctgtcccacccccttgtccaagcaagtgagactgcaacagcccttgtcaacgaggccctggaataccaccagagcatctatgcacagcctgtctggcagactcgcaggaccaaaccacgattccagtcagacactctgtatatcattggtgggaaaaagcgcgaggtctgcaaggtcaaggaacttcggtacttcaatcctgttgatcaggagaatgctctcatagctgccattgccaactggagtgagctggctcccatgcctgtgggaaggagccaccattgtgtgg

SEQ ID NO: 4444 - DNA, 2403 bp, Homo sapiens
acacgcacgcaggcacacacacacacacacacacacacacacacacactttcgcacacacaaacacgctaggacgctcgtcttcgctactgcatccccgaaccagcagagcgaagctactgcgggttctgttaacctcagcatcgtggggcgaagcagagccattgtgcatcaaggagaggccggtgcctgcgctgccgtctctggcacctaacccagcagaccgctcaccccatcggctggaatgcttgctgattcctctgcacacttctaaggctgagaacctgaggaacccagctggaaaatgccgtctgaacgctgcctcagtattcaagaaatgctgacaggccagaggctctgccactccgaatctcacaatgacagtgtcctggcagcgctgaatcagcagaggagtgatggcatcctctgcgacatcaccctgattgctgaggaacagaaattccatgctcacaaggcagtcctagcagcatgcagtgactatttccggattttgctggagccaggtgtgatccaggatgtgctagcagcgggcagtcacctacagctgttggagcttctcaatttatgctcccactatctcatccaggaattaaatagctttaattacttggatctgtacagacttgctgacctctttaacctcactttgttggagaaggcagtgatcgatttcttagtgaaacatctctctgaactcctgaagagccgcccagaagaagttctaacgcttccctattgcctgcttcaggaggtgctgaagagcgaccgcctgacctccctgagtgaagagcagatctggcagctagctgtgaggtggttggaacacaactgccactaccagtacatggacgagctcctgcaatacatccgctttggcctaatggatgtggatactctccatacagttgccctgtcccacccccttgtccaagcaagtgagactgcaacagcccttgtcaacgaggccctggaataccaccagagcatctatgcacagcctgtctggcagactcgcaggaccaaaccacgattccagtcagacactctgtatatcattggtgggaaaaagcgcgaggtctgcaaggtcaaggaacttcggtacttcaatcctgttgatcaggagaatgctctcatagctgccattgccaactggagtgagctggctcccatgcctgtgggaaggagccaccattgtgtggcagtcatgggggacttcctgtttgtggcaggaggggaagttgagcatgccagtggccggacgtgtgctgtgaggactgcctgtcgctatgacccccgcagtaattcctgggcagagatagcacccatgaaaaactgccgggagcattttgtgctgggtgccatggaggaatacctctatgcagttgggggcagaaatgaactgcgccaggttctgcctacagttgagcgatattgccccaagaagaacaaatggacttttgttcagtcctttgacagatccctttcatgccatgctggatatgtggctgatggtcttctttggatatcaggtggagtaactaatacggcacaatatcagaacaggctaatggtgtatgaacctaaccagaataagtggataagccgtagccccatgctgcagagaagggtctaccattccatggctgctgtacaaaggaagctttatgttcttggaggcaatgacctagactacaataatgaccggatccttgtgcgccatatagattcttacaacatagacactgaccagtggacacgttgtaatttcaacctgctgactggccaaaatgaatctggagttgctgtccataatgggagaatatatttagttggtggatattcaatttggacaaatgagcctctggcttgtatccaggtactggatgtaagcagagaaggcaaagaagaagtattctatgggcctacactcccttttgcttccaatggaatagcagcatgcttccttccagctccatattttacatgccctaaccttcaaactcttcaagtgcctcatcacaggattggcaccatctgaaaagccaagccatcatgaacaggaggaaaacatagctctgactgttggatactgggcatgaaaagactcagtgctccatgcttccttgtcttgctttataggtcttatattcggataaatttaagcaaaaaatgaacaattttctaaaatacgttattgaaaactcgtcacccttctcagtgtatgtcaacattcaatatgtatgacttttattgtggtatagcttagtgccaatttaaggtatattgtgttccatgggtctttagagcattctttgtacactttttctaatcagcactgtcttaagacaacataacactgttagtaaggcaatttattggacac

SEQ ID NO: 4445 - DNA, 2281 bp, Homo sapiens
actgcatccccgaaccagcagagcgaagctactgcgggttctgttaacctcagcatcgtggggcgaagcagagccattgtgcatcaaggagaggccggtgcctgcgctgccgtctctggcacctaacccagcagaccgctcaccccatcggctggaatgcttgctgattcctctgcacacttctaaggctgagaacctgaggaacccagctggaaaatgccgtctgaacgctgcctcagtattcaagaaatgctgacaggccagaggctctgccactccgaatctcacaatgacagtgtcctggcagcgctgaatcagcagaggagtgatggcatcctctgcgacatcaccctgattgctgaggaacagaaattccatgctcacaaggcagtcctagcagcatgcagtgactatttccgggaattaaatagctttaattacttggatctgtacagacttgctgacctctttaacctcactttgttggagaaggcagtgatcgatttcttagtgaaacatctctctgaactcctgaagagccgcccagaagaagttctaacgcttccctattgcctgcttcaggaggtgctgaagagcgaccgcctgacctccctgagtgaagagcagatctggcagctagctgtgaggtggttggaacacaactgccactaccagtacatggacgagctcctgcaatacatccgctttggcctaatggatgtggatactctccatacagttgccctgtcccacccccttgtccaagcaagtgagactgcaacagcccttgtcaacgaggccctggaataccaccagagcatctatgcacagcctgtctggcagactcgcaggaccaaaccacgattccagtcagacactctgtatatcattggtgggaaaaagcgcgaggtctgcaaggtcaaggaacttcggtacttcaatcctgttgatcaggagaatgctctcatagctgccattgccaactggagtgagctggctcccatgcctgtgggaaggagccaccattgtgtggcagtcatgggggacttcctgtttgtggcaggaggggaagttgagcatgccagtggccggacgtgtgctgtgaggactgcctgtcgctatgacccccgcagtaattcctgggcagagatagcacccatgaaaaactgccgggagcattttgtgctgggtgccatggaggaatacctctatgcagttgggggcagaaatgaactgcgccaggttctgcctacagttgagcgatattgccccaagaagaacaaatggacttttgttcagtcctttgacagatccctttcatgccatgctggatatgtggctgatggtcttctttggatatcaggtggagtaactaatacggcacaatatcagaacaggctaatggtgtatgaacctaaccagaataagtggataagccgtagccccatgctgcagagaagggtctaccattccatggctgctgtacaaaggaagctttatgttcttggaggcaatgacctagactacaataatgaccggatccttgtgcgccatatagattcttacaacatagacactgaccagtggacacgttgtaatttcaacctgctgactggccaaaatgaatctggagttgctgtccataatgggagaatatatttagttggtggatattcaatttggacaaatgagcctctggcttgtatccaggtactggatgtaagcagagaaggcaaagaagaagtattctatgggcctacactcccttttgcttccaatggaatagcagcatgcttccttccagctccatattttacatgccctaaccttcaaactcttcaagtgcctcatcacaggattggcaccatctgaaaagccaagccatcatgaacaggaggaaaacatagctctgactgttggatactgggcatgaaaagactcagtgctccatgcttccttgtcttgctttataggtcttatattcggataaatttaagcaaaaaatgaacaattttctaaaatacgttattgaaaactcgtcacccttctcagtgtatgtcaacattcaatatgtatgacttttattgtggtatagcttagtgccaatttaaggtatattgtgttccatgggtctttagagcattctttgtacactttttctaatcagcactgtcttaagacaacataacactgttagtaaggcaatttattggacacaatggcatcgatgatcttaaaaatatatatattctgtacttaatccctttattatttaaagccg

SEQ ID NO: 4446 - DNA, 1944 bp, Homo sapiens
acacgcacgcaggcacacacacacacacacacacacacacacacacactttcgcacacacaaacacgctaggacgctcgtcttcgctactgcatccccgaaccagcagagcgaagctactgcgggttctgttaacctcagcatcgtggggcgaagcagagccattgtgcatcaaggagaggccggtgcctgcgctgccgtctctggcacctaacccagcagaccgctcaccccatcggctggaatgcttgctgattcctctgcacacttctaaggctgagaacctgaggaacccagctggaaaatgccgtctgaacgctgcctcagtattcaagaaatgctgacaggccagaggctctgccactccgaatctcacaatgacagtgtcctggcagcgctgaatcagcagaggagtgatggcatcctctgcgacatcaccctgattgctgaggaacagaaattccatgctcacaaggcagtcctagcagcatgcagtgactatttccgggcaatgttcagtctttgtatggtggaaagtggagctgatgaggttaatttgcacggtgtgaccagccttggcttaaagcaggctctggagtttgcatacacaggacagattttgctggagccaggtgtgatccaggatgtgctagcagcgggcagtcacctacagctgttggagcttctcaatttatgctcccactatctcatccaggtggagtaactaatacggcacaatatcagaacaggctaatggtgtatgaacctaaccagaataagtggataagccgtagccccatgctgcagagaagggtctaccattccatggctgctgtacaaaggaagctttatgttcttggaggcaatgacctagactacaataatgaccggatccttgtgcgccatatagattcttacaacatagacactgaccagtggacacgttgtaatttcaacctgctgactggccaaaatgaatctggagttgctgtccataatgggagaatatatttagttggtggatattcaatttggacaaatgagcctctggcttgtatccaggtactggatgtaagcagagaaggcaaagaagaagtattctatgggcctacactcccttttgcttccaatggaatagcagcatgcttccttccagctccatattttacatgccctaaccttcaaactcttcaagtgcctcatcacaggattggcaccatctgaaaagccaagccatcatgaacaggaggaaaacatagctctgactgttggatactgggcatgaaaagactcagtgctccatgcttccttgtcttgctttataggtcttatattcggataaatttaagcaaaaaatgaacaattttctaaaatacgttattgaaaactcgtcacccttctcagtgtatgtcaacattcaatatgtatgacttttattgtggtatagcttagtgccaatttaaggtatattgtgttccatgggtctttagagcattctttgtacactttttctaatcagcactgtcttaagacaacataacactgttagtaaggcaatttattggacacaatggcatcgatgatcttaaaaatatatatattctgtacttaatccctttattatttaaagccgggcttgtaatttttctttttaaaatttaacattatgcagccctgctcagtagagactcactcagcattatgacatcataaatttttaaatgccatattttattcaaggtgatacgaataataatagacatacactggaacagcagttgttgaaatacccagatttttcaccttggttactctgaccttgggtcagaacctaactttacagtgcttcagttttcccaccttttaaggaggataattactgatttccacgttaatttaaaagaacattatgaggattaggcgaacactttgtaatactttgccc

SEQ ID NO: 4447 - DNA, 1863 bp, Homo sapiens
ccaggcccctggtcccaaggaaccttccctttccagccttgtccctagaggaagaagaggaagaggaagaagatgaagatgcggcagagcccgagtggctgcgcagcgaggagcatccgagccagtttttcgccgaggcccagcggctgcgggagcagagactgttgctggacgaagagtgcaccgagccgccctggcctgtggcagtgagttctttggggccatgctcctgagcgggatgagggaatcccagggcacagaggtatctctgcggacgatctccacccaggacctgcgactcctcgtctcttttgcttactccggagttgtgcgggcaaggtggccagggctactgagagctgcccaggctgctctgcagtaccagagctcttcctgcttggatttgtgtcagaaaggcttggcacggggcctcagccctgcccgttgcctggccctgttccccatggcggaagcccctgggttggagaggctctggagcaaagcccgtcactacctcctcacccacctgcctgctgtagccttgtgtcctgctttcccttctttaccagctgcctgcttggctgagctcctggatagtgatgagctccatgtgcaggaggagtttgaggcctttgtggctgcacggtgttggctggctgccaaccccgagacccaggagtcagaggccaaggccctgctgcgatgtgtccgctttggccgcatgtccaccagggagttgcggagggtgcgggcagccgggctacttccacccctgaccccagatctgttgcaccagctgatggtagaggctgatgttccaggccaagagagacggagggagcctgaccgggcactggtagtgattggcggggatgggctcagaccagacatggccctaagacaaccatcccgagcagtgtggtgggcccgggccttccgctgtggcgtgggactggtacgaactgttgagtgggggcagctgcctgccctgcctgcccccggacgcttccggcatggggctgcaagcctggcaggaagtgaactctatgtgtgtgggggacaagatttctacagtcactccaacaccctggcttcaactctcaggtgggagcccagtcaagaggactgggaggagatggctcctttgtcccaggctcgaagccttttctccttggtggcactggatggaaaactttatgccctgggtggaagacacaatgatgttgccctggactctgtggagacctacaaccctgagctcaatgtctggaggccagcacctgcacttccagcaccatgttttgcccacgcagctgcgattttggagggccagttgtacgtgagcggtggctgtggtgggactggccaatacctggcctcactgatgcactatgaccccaaacttgagaagccagggacgtttctgagccctatgggggtacctcgggctggccatgtcatggctgcattgggtgggaggttgtatgtggcaggtgggctgggtgagactgaggacctgctaagctttgaggcctatgaactaaggactgatagctggactcacctggcacccctaccctccccccatgtgggggctgcaagtgctgtgctgcagggggagctactggtgctcgggggctacagtcaccgtacttatgccctctctcaccttatccatgcctactgtcctggcctgggccgatggctctgcctgggaactctgccaaggcctcgggctgagatgcctgcctgcatcctgacactgcccgctgtgcagcacatagctttggttcccaccccacaccaaaccaaacctgctgggtgaagagggagcaacagtgtatggggagaggagggcataag

SEQ ID NO: 4448 - DNA, 2840 bp, Homo sapiens
agttgtccccggccttcgcgggtgcccgcagaacccgtcctcctcgtccaccccggagaggtcagagtcctcgccctgcactcccgggacgccgcatctgcgccgtcggacatccagcacccccggagtccaccggcaactcggttcttccaggtgatggtgtgcagccaccgccgcccctggcgtgcaggtgtgggctctccacattgggccggggaggggacttcgggcaacgcgctggaagcctcggcagtcgtggaaaccaagccccacactcccgggaagcctccaaattccgcgccctccgttactaggggcctccgaaaaccgtttccagactggatttgctctgagaggggcactgggcgatctgcaggtctggatgaaggagccctgggctttaaactgagcaggcagaaatgggcccctgctaggggctctgtggcttacgcgggggtcccgggagtgttgtgccccgggatgcctccggccctgcccagcaggcctctggtcccaccaggctgcttccagccctgggtagaatgagttacttcctgtcttactgcaaagctcatggcggcgcgctgctcaccggctaccaggccctgcgcgccgagggcttcctgtgcgacgtgacactggagaccgagggcagcgaattcccggcgcacaggtcgctcctggcgtgctccagtgactacttcagggccctgttcaagagccacacccaggaatcccgggcgcgcgtgatccacctgcacgtgccatcggcagccggcctgcagcgcctgctggacttcatctacactgcctggctgtcgctttccatggacactgtagaggacactctggaggccgccagctacctgcaggtcactgaggccctggggctctgtgggcgctacttggagcgccagctggctccagagaactgctgcttcgccgccaacgtggcagcgcgctttggcctggctcacacgctggacgcggccgagcgctgcatcgtgagccacttgcaggagctgctggcgcggggcgcgggccccgcgggactcctggagctcaaccctacatcgctgagggctgtactgggtgcccccgacgtggcgcgggtgcccgaggcccggctactgggcctggcgttagcttggttgcggcaggagcccacaactgagcgcctggcacactgtacagagttgctggagcgtgtccgctttggcctggttcccgccgacgtactgcggcgcgtgtactcgggctctggcctcgtgctgcccgcccgggtcaagggcctcatcatccaggccctcaactaccacacgacgccctcccgccagccgctcatgcagggcgagcagaccagcatccggagcccccagacccgcatcttgttggtgggggggcgcagggcacgggaggtggtgattgaggaggtcgcggccccgcagagggcagctaggggccaggtcgccgccccagagcccgaggaagaagaggaagagttggaggaagaggaggaggaggaggagtgggagctcacccagaacgtggtggccttcgatgtgtacaatcaccgctggcgcagccttacgcagctacccacaccactgctggggcacagcgtgtgcaccgcgggcaacttcctgtttgtcctgggtggggagagcccttccggcagtgcatcctctcccctggccgacgactcgcgggtggtcacggcccaagtgcaccgttacgacccgcgcttccacgcttggacggaagtgcccgccatgcgggaagcgcgggcccacttctggtgcggcgcggtgggcgagaggctcctggccgtcgggggcctgggtgcgggcggtgaggtgctggcctcggtggagatgtacgacctgcgtcgggaccgctggacggcggctggggcactaccgcgggctctgcacggtcacgcgggggccgtcggggaccgcggtgttgtgtacatctcggggggcaaggcagggagaggcgagggcggagcgagcagcctccgggacttatacgtcctgggccctgaggagcaggtttggagcaagaaggcacccatgggcaccgcacgtttcgggcaccacatggcagtgctgcgcggcgctgtgtttgcttttctggggcgatacgagcccttctctgagatcgagcgctacgaccccggcgccgaccagtggactcggttgcggccgctgccctacgaccgcttctgctatgggctggccgtggtcgaggagacagcgttgctgctgggcggcctcaagtggcgggactcgcgccaggtgcctacccgcaacgtagtgggctacgacctcgacctggaccgttgggaggacatcggctgcgcgttgccctgggcctggagcggcctgcggtgcgcagtgctgcagctggccgagggtggggacgacgagagggagggagaggttggagaggcgctagatttggtgctgggctgaatgggtcagtccggtttccttccgcaatggaggagaaagtcgcgcttggttagtcttacagagcaacggatgggctttttctaagaaagggattctgggagcagagtggcttctgaaggttaacaggcaaacaaggccttgagcaaagagaaacatttctccttgagctgagaatgggagacagcggggcggggggtcaaatagaaggctatatgaatcaacttcagtgagctggtgaaagaaaatttttagaaaggctcacgcaaggctagagaaggactttcacaaataaaatatgaccttattttccctcttacagttaaagtgtttccctaggtgcaaaacagtgattacttatgtgcc

SEQ ID NO: 4449 - DNA, 1500 bp, Homo sapiens
gagggccgcctgcgcgccgccaacagcctagcgctgcgccgcgtggccgccgccttctcgctggccccgctggccgagcgctgcggccgcgtcctgcgtcaggccttcgccgaggtggcgcgccacgccgacttcctggagctggcgcctgacgaggtggtggcgctgctggcggaccccgcgctgggcgtggcgcgcgaggaggccgtgtttgaagcggccatgcgctgggtgcgccacgacgcgccggcccgccgcggccagctgcgacgcctgctggagcacgtgcgcctgccgctactggcgcccgcttacttcctggagaaggtggaggcggacgagctgctgcaggcctgcggcgagtgccgcccgctgctgctcgaggctcgcgcctgcttcatcctgggccgcgaggccggtgcgctgcggacccggccgcggagattcatggacctagctgaagtgatcgtggtcatcggcggttgcgaccgcaaaggtctcctgaagctgcccttcgccgatgcctaccatccagagagccagcggtggaccccactgcccagcctgcccggctacactcgctcagaattcgccgcctgtgctctccgcaatgacgtctacgtctccggaggccacatcaacagtcatgatgtgtggatgtttagctcccatctgcacacctggatcaaggtagcctctctgcacaagggcaggtggaggcacaagatggcagttgtgcaggggcagctgttcgcggtgggtggcttcgacggcctgaggcgcctgcacagcgtggagcgctacgaccccttctccaacacctgggcggccgccgcgcccctcccggaggccgtgagctcggcggcggtggcgtcctgcgcgggcaagctcttcgtgattgggggcgccaggcagggcggcgtcaacacggacaaggtgcagtgctttgaccccaaggaggaccggtggagcctgcggtcaccagcacccttctcacagcggtgtctcgaggctgtctcccttgaggacaccatctatgtcatggggggtctcatgagcaaaatcttcacctatgatccaggcacagatgtgtggggggaggcagctgtcctccccagccctgtggaaagctgtggagtcactgtgtgtgacgggaaggtccacatccttggcgggcgggatgatcgcggagaaagcaccgataaggtcttcacctttgaccccagcagtgggcaggtggaggtccagccatccctgcagcgctgcaccagctcccacggctgtgtcaccatcatccagagcttgggcaggtgattcagatttggacagcctgagccaggaggcggagaggcaggcggagctcagatgcacactctgctccctcatggcacctccacgcaaacagcccttaacttaatggtcccttttcttgtataaataaaatcttgttgggtctgtgttccagctgcagtctgccctgcctggagatggaatgtctaa

SEQ ID NO: 4450 - DNA, 1936 bp, Homo sapiens
atgcggcaaggccatgcgccggaggagtcggagccgggctgcgaagcgccgtgcgcgggtccgtgccacgcgcagcgcgtgctgcaggccctgaacgcctaccggcggagcggcaccctcaccgacgtggtgctgcgcgccggcgggcgcgactttccgtgccaccgcgcggcgctcagcgcgggcagcgcctacttccgcagcttgttcgcggccgggcggcccgagcgcggcccggccgtggtgccagtggtgccagtagctcccgaggcgccaggcacgagcccggccggggcggcggcggcgctggccgtggtgctcgactacgtgtacggagcgggcgtgcggctgcgcgcggaggacgaggcggcggccgtgctggcgctggcggagcggctgggcgtggcgggcctgcgcgaggcctgcgtgcgctttctcgagggccgcctgcgcgccgccaacagcctagcgctgcgccgcgtggccgccgccttctcgctggccccgctggccgagcgctgcggccgcgtcctgcgtcaggccttcgccgaggtggcgcgccacgccgacttcctggagctggcgcctgacgaggtggtggcgctgctggcggaccccgcgctgggcgtggcgcgcgaggaggccgtgtttgaagcggccatgcgctgggtgcgccacgacgcgccggcccgccgcggccagctgcgacgcctgctggagcacgtgcgcctgccgctactggcgcccgcttacttcctggagaaggtggaggcggacgagctgctgcaggcctgcggcgagtgccgcccgctgctgctcgaggctcgcgcctgcttcatcctgggccgcgaggccggtgcgctgcggacccggccgcggagattcatggacctagctgaagtgatcgtggtcatcggcggttgcgaccgcaaaggtctcctgaagctgcccttcgccgatgcctaccatccagagagccagcggtggaccccactgcccagcctgcccggctacactcgctcagaattcgccgcctgtgctctccgcaatgacgtctacgtctccggaggccacatcaacagtcatgatgtgtggatgtttagctcccatctgcacacctggatcaaggtagcctctctgcacaagggcaggtggaggcacaagatggcagttgtgcaggggcagctgttcgcggtgggtggcttcgacggcctgaggcgcctgcacagcgtggagcgctacgaccccttctccaacacctgggcggccgccgcgcccctcccggaggccgtgagctcggcggcggtggcgtcctgcgcgggcaagctcttcgtgattgggggcgccaggcagggcggcgtcaacacggacaaggtgcagtgctttgaccccaaggaggaccggtggagcctgcggtcaccagcacccttctcacagcggtgtctcgaggctgtctcccttgaggacaccatctatgtcatggggggtctcatgagcaaaatcttcacctatgatccaggcacagatgtgtggggggaggcagctgtcctccccagccctgtggaaagctgtggagtcactgtgtgtgacgggaaggtccacatccttggcgggcgggatgatcgcggagaaagcaccgataaggtcttcacctttgaccccagcagtgggcaggtggaggtccagccatccctgcagcgctgcaccagctcccacggctgtgtcaccatcatccagagcttgggcaggtgattcagatttggacagcctgagccaggaggcggagaggcaggcggagctcagatgcacactctgctccctcatggcacctccacgcaaacagcccttaacttaatggtcccttttcttgtataaataaaatcttgttgggtctgtgttccagctgcagtctgccctgcctggagatggaatgtct

SEQ ID NO: 4451 - DNA, 1979 bp, Homo sapiens
tcctggcggagccatggctgcgcagcgggctggccgggggtctcctgaacccgggccccgccgccccgaccgcccggccccgccgccggggctgtccccgccgcgtccgtagcgcgtcctgccagggctgaaatctctttaatgatggagggaagcaggcagacgcgagtgtctcggccatacaagatcagcgaatcatcaaaggtataccgctgggccgaccactcaagcacggtgctgcagcggctgaacgagcagcgtctccgcgggctcttctgcgacgtcgtcctggtggccgatgagcagcgtgtgccagcccatcgcaacctgctggccgtgtgcagcgactacttcaactccatgttcaccatcggcatgcgggaagctttccagaaggaggtggagctgatcggcgcctcctacattgggctcaaggccgtggtggacttcctgtacggcggggagctggtgctggatggcggcaacattgactacgtcctggagacggctcacctgctgcagatctggacggtggtagacttctgctgtgagtacctggagcaggaggtgagcgaggacaactacctgtacctgcaggagctggcctccatctacagcctcaagcggcttgatgccttcatcgatggcttcatcctgaaccacttcggcacgctgtcctttacgcccgacttcctgcagaacgtctccatgcagaagctgtgtgtctacctgagcagcagcgaggtgcagcgggagtgtgagcacgacctcctgcaggccgccctgcagtggctgacgcagcagcccgagcgcgaggcccacgcccgccaggtgctggagaacatccacttcccgctcatccccaagaacgacctgctgcaccgcgtcaagccggccgtgtgctcgctgctgcccaaggaggccaactgcgagggcttcatcgaggaggccgtgcgctaccacaacaacctggcggcccagcccgtcatgcagaccaagcgcacggcgctgcgcaccaaccaggagcgcctgctgtttgtgggcggcgaggtctccgagcggtgtctggagctcagtgacgacacctgctacctggacgccaagagcgagcagtgggtcaaagagacgccgctgcccgcccggcggagccaccactgtgtcgcggtgctggggggcttcatcttcatcgccggcggcagcttctcacgggacaacggaggggatgcggcctccaatcttctttataggttcacgtacggccacgcgggcaccatctacaaagacttcgtgtacatctcggggggccacgactaccaaattggcccctaccgcaagaacctgctatgctacgaccaccggacagacgtgtgggaggagcggcggcccatgaccacggcgcgcggctggcacagcatgtgcagcctgggtgacagcatctactccatcgggggcagcgatgacaacatcgagtccatggagcgcttcgacgtgctgggcgtggaggcctacagcccgcagtgcaaccagtggacccgcgtggcgccgctgctgcacgccaacagcgagtcgggcgtggcagtgtgggagggccgcatctacatcctgggcggctacagctgggagaacactgccttctccaagaccgtgcaggtgtacgaccgcgaggccgacaagtggagcaggggcgtcgacctgcccaaggccatcgctggcgggtccgcctgtgtctgcgccctggagccacggccagaggacaagaagaagaaaggcaaaggcaagaggcaccaggaccggggccagtgaccctagctgcgcctcttgggaccatcctcaccgtcacctcccagggctctgtagaccagcagcaacttcttagtattccggaaacattatgtacaacttagcagctttttttacttttatgattcttggtatttctatgatatcacagtaaccaattaaatactatctgtaacttt

SEQ ID NO: 4452 - DNA, 7569 bp, Homo sapiens
cgcctccgccctcggcctcgcacttcctggcggagccatggctgcgcagcgggctggccgggggtctcctgaacccgggccccgccgccccgaccgcccggccccgccgccggggctgtccccgccgcgtccgtagcgcgtcctgccagggctgaaatctctttaatgatggagggaagcaggcagacgcgagtgtctcggccatacaagatcagcgaatcatcaaaggtataccgctgggccgaccactcaagcacggtgctgcagcggctgaacgagcagcgtctccgcgggctcttctgcgacgtcgtcctggtggccgatgagcagcgtgtgccagcccatcgcaacctgctggccgtgtgcagcgactacttcaactccatgttcaccatcggcatgcgggaagctttccagaaggaggtggagctgatcggcgcctcctacattgggctcaaggccgtggtggacttcctgtacggcggggagctggtgctggatggcggcaacattgactacgtcctggagacggctcacctgctgcagatctggacggtggtagacttctgctgtgagtacctggagcaggaggtgagcgaggacaactacctgtacctgcaggagctggcctccatctacagcctcaagcggcttgatgccttcatcgatggcttcatcctgaaccacttcggcacgctgtcctttacgcccgacttcctgcagaacgtctccatgcagaagctgtgtgtctacctgagcagcagcgaggtgcagcgggagtgtgagcacgacctcctgcaggccgccctgcagtggctgacgcagcagcccgagcgcgaggcccacgcccgccaggtgctggagaacatccacttcccgctcatccccaagaacgacctgctgcaccgcgtcaagccggccgtgtgctcgctgctgcccaaggaggccaactgcgagggcttcatcgaggaggccgtgcgctaccacaacaacctggcggcccagcccgtcatgcagaccaagcgcacggcgctgcgcaccaaccaggagcgcctgctgtttgtgggcggcgaggtctccgagcggtgtctggagctcagtgacgacacctgctacctggacgccaagagcgagcagtgggtcaaagagacgccgctgcccgcccggcggagccaccactgtgtcgcggtgctggggggcttcatcttcatcgccggcggcagcttctcacgggacaacggaggggatgcggcctccaatcttctttataggtatgacccccgctgtaaacagtggatcaaggtggcctccatgaaccagcgccgtgtggatttctaccttgcctccatcgaagacatgctggtggccatcggcggccggaatgagaacggagcgctctcttcagtagagacgtacagtcccaagactgactcctggtcctatgtggccggcttgccaaggttcacgtacggccacgcgggcaccatctacaaagacttcgtgtacatctcggggggccacgactaccaaattggcccctaccgcaagaacctgctatgctacgaccaccggacagacgtgtgggaggagcggcggcccatgaccacggcgcgcggctggcacagcatgtgcagcctgggtgacagcatctactccatcgggggcagcgatgacaacatcgagtccatggagcgcttcgacgtgctgggcgtggaggcctacagcccgcagtgcaaccagtggacccgcgtggcgccgctgctgcacgccaacagcgagtcgggcgtggcagtgtgggagggccgcatctacatcctgggcggctacagctgggagaacactgccttctccaagaccgtgcaggtgtacgaccgcgaggccgacaagtggagcaggggcgtcgacctgcccaaggccatcgctggcgggtccgcctgtgtctgcgccctggagccacggccagaggacaagaagaagaaaggcaaaggcaagaggcaccaggaccggggccagtgaccctagctgcgcctcttgggaccatcctcaccgtcacctcccagggctctgtagaccagcagcaacttcttagtattccggaaacattatgtacaacttagcagctttttttacttttatgattcttggtatttctatgatatcacagtaaccaattaaatactatctgtaactttacatatcttgcttgaataactaaccctgggcccaggcagtgagcaaccccttgtatcttcacaggtctttgccccgtgttatgattcctcatgggtccttgctgactgtccccctgagagtagctggcacgtgggtaacacagaaatttctgtagtgaagcttgggcctcaaagggttctcttaggccacctagtccaagcctccccaaacctggctgaacttttaagaatacagatgcgtgagccccgctcagaattatggaatccaaaaccaccaggaacggggaggaggtggtgcccagaagctgtattttaactagttcttggaattctgggtattagtcacatctgggaatcactggcaaggtccagtgtgtttgttttataaatgagtgcacagagaccacccatgagggtgagtgagtgagtgaccaggggccacgcagctcgctagactgtcagatgagacatgatgacttcccgctggggagctgttctccgtatcaggtgaacgctgtttctgaataattccgtctttcctcattggaaaccttcttgaattctaaaacgttacaggtaaccaaaaacgaaaaaaggtatgaagctctttatacatatttttttgtaatttgtgcatttttttccttttttttttttctgaacccactgtcttttatattactgatgtactgagctcccaaatctgtttatttctcaggaaagaaaaagtgagtgctatggaatttgccatcgttctctgtgactctatcttgaggcgctgttgaaagttcctgcacagaggagcacatgtggatccctgagaaggcagtggagggctccctaactcccacgccaggtcctgccccagttttctgcttctaagtagtttcgtgctgctgggcaaattctcgaacaagtccgtgtgttccctcatccaccccgcttagccacaggattagatggaataccctccaggctcctcccgggtgatagggccattcagcctctgagctgttcgtacccggatggcatccccttcaggatgtggagctggcctgcactgactcctgcaaacagttcctaaagcaggtgtcagggtcgcttgccctttaagagggctcttagctgcccgagtggatgagaaacgtgcagaactatgggaggataggagtgtgatgggttttaagcatgagccaaggaaggcatgaatgagctgtacctcacccagcatccgatggcagagatcagtaaacttcaagatgtgcttcatcttcaatcctagtctaacaccagtcttcctgcagacagttccgagagcaggtctcgatgtcacttgccctttaagagggctctcagctgctcgagtggatgaggatcaatgtgttaagattgatattagactaggaaaaaaatcttagttaactttaatttccatttcttctgcttctttgctgcccctcctttcccttcccttcagggtttactgtggttctcactggtctgtttatgtagccatccagaagagatgagagcattttggggactgaaagcttcaatagccaacttactgccctctgtggttagtgaggagggcagtctgcatgttcagctagctagttatttgcatgtgaagtccctggaggcttacaaactgttgagaggttctgcgaggcatacaaacaaacagaccaaaaggctggaaactctgcttggagctctgcagcattccggtgtatgaaaggttccgagaagtctcaacccagcatttccaaacttctttgagcctaaaagtcgtttgtctcatacctagtcccagacccccacaaaacatgttttgcagaacttctgccaactttgggatagcttacccccttcctattcgggaaaggttttattgcttgtagacccctcagaaggcagggtagggtgtacgtgggctgttctccccatctcagcctgggtcatgaacaaacgggcagttgtttggcctgaatctcggggcaagttggggagagcacatagaaagactctgtgagtgatttggggagtgggatagctttgaccttggagagaggagagccattggttttcagcctaagccagctcttttatgttttgcttctgggacttgtccctggaaatgtgtgagcttctggcctctattctgattttcttgtgcctcatgagttacatacgacgtcctgcgcttcatattttgtggtgtctctcctgatactatgaaggtggtttgtaattgacatggctttgaccctaatattactaaggttgggaccacccttttaaagggaggataaacaagtttcatcttgtgggtcaacttctaatatttgatggtggctacactgtgacaagaaaggtttttgagcttgttggggtcagtggatgggcacaagggcacccagtggtggtgcccgggccaggtttttgttacttgtctttttaagttgaaaattcaccctactgtgcatgaaaatggaactgaaaatggaagagaccatgcctgggcaacatggcaaaaccccatctctacaaaaaaattacaaaagattagccagggatggtggggcatgcagtagtcccagctgcttaggaggctgaggtgggagaatcacctgagcctgggaggttgaggctgcagtgagctatgaccacaccactgcactctaacctgggtgacggagtgagaccctgtctcaaaagaataaaatgttttttaactcagatgggcagagtttgggctgtgcttatgcagtggccatttgaaccgcacagtcacgaatgtggggttttaaactagagtgatgaaggcacaggtgcttgcaggctgccattttgagagggaaacagccacacatgtcatcatgttaaactttcagtgtttcaagctattctgcttgaattttgaagacacctggatctttttttttttttaacatttcaaaataagcatggcaggcttctattgaggtttggacttctctcatttctaaagaattagagttgtaacttcatattagttgtaagtttggggtttggtcctcacccaagttggaaagctgtttgcttaagacatagatgtattataataatagaagggagggagtagaaagctgatgaacccttgttacttatagcaaacttcctgctgttttaaatgcacagagattattttatcaactgtggttagcacgcaattggtatttttattgttctgccattttattgaggctatcaagtgggacttcagacctggctctgagcaggaccacacgtgtgtatttatattgagtgccctcactcatgataaggtgacttcatggagacccagaaactcaccctaaggggtgttcacctttgaggtgggcatccagatgctgaggggaagtggggtccatcctctgaggtccaggggcctactttgtgagctcagttgtgttcacctgtggttcagtgtacctcggcccctaagccaagtgatcgttcagtgacttgcagcaatgtgggaagtgaggggacccctgccacaccccccaccaccccctgtagagtcactgaccttcatccttcaccctggtcctccatggtgcagcagcatctcatgggccttgtggctgtcagagcccgtggttggaaccccgtccactggtcccaaacctggaggggcagctgcagatgaggtttagacctcctggtgtctccgtggattctgagtgcccaggaggggaggggagggggtggcatcctggcctctaggataaatgcctggagtatagggcagcgccacgggcacttggagaccctgtcctgcgcatctgccaagcctggcagtttttagagttttttgaaatgttttgatactttttgatacaatttgctaataactgttttgtagaatgcctgccggggttttccacctcatccctttcctccggccccttgatttgtgctggacaacaaatggcagcaccaggacctcgcctcatgtggctttgtcttggatcttgcccttctccatcgctgatgtgatacagctctagaatttcgtgaagttgcatgcaaagttgcatgcagcccgtgggtatgactgtctcaggcccccagctcatttgccaagaggaaaccttaacccccctgagagggtctgcgtttcttctagagctcctacctcagtggtgtgcacagagttggagacacctgagggctggtccacgtctcacctttgccatacgggtcatttcttgatcaaatatatgactggggtcctggtttactcccgcccaccctttcttttaaagtattcttaacatgaaatccacaaaagcggaaacaatgaaccattcttgcactttacagaatcattgtccttagctttagaggttgttaatttcttgtttttaacatgaacagaatgtgtggttctgaaggtgtgtgggggtctcaagaaattgtcctttggggccgggcgcagtggctcacgcctgtactcccagcactctgggaggccaagggggacggatcacctgaggtcaagagtttgagaccaccctgaccaacatggtgaaaccccgtctctactaaaatacaaaaattaggcagtcgtggtcgcctgtaatctcagctcttccggaggctgaggcaggagaatcgcttgaacccaggaggcagaggttgcagtgagccgaggttgcgccactgcactccagcctgggtgaccgagtaagactgtctcaaaaaaaaaaaaaaaaaagaaaagaaattgtcctttggttgccttagttaccagagttgaatgaatgtacacatttcggtagtgggggggcagagcggataaccccttccttgtctgtttcctttgagaaaggacactccaccttttcaaaggtacttaaagccatctttacagattgcttgtaatgtaaggaaagagtcatgtcctttggattgattgaggttaaatcatcaaccactagccccctttcaaaatcagcgagatatttgatgattaagtgattcattgggtatgttctggctactgatgttactgaaatctgcaatcgtgtatgttttttaatttgttgcttttgtatttgtaattttatgacatttcgaagtttctgtgtcttaactctttttaattaattttctgcacgttgcttttttctctttgtttttaattccatacagagtattcaattcttgaaacacattaaaataatttgcttgctagggtatggtttattttataattacattcctagtcttgtgtggttattgtaatgatgtctggtcctaatttctctgcccgtatgaaaaagaaccccttgcctgttgatcctaaatataatttggaaattaa

SEQ ID NO: 4453 - DNA, 2173 bp, Homo sapiens
tcctggcggagccatggctgcgcagcgggctggccgggggtctcctgaacccgggccccgccgccccgaccgcccggccccgccgccggggctgtccccgccgcgtccgtagcgcgtcctgccagggctgaaatctctttaatgatggagggaagcaggcagacgcgagtgtctcggccatacaagatcagcgaatcatcaaaggtataccgctgggccgaccactcaagcacggtgctgcagcggctgaacgagcagcgtctccgcgggctcttctgcgacgtcgtcctggtggccgatgagcagcgtgtgccagcccatcgcaacctgctggccgtgtgcagcgactacttcaactccatgttcaccatcggcatgcgggaagctttccagaaggaggtggagctgatcggcgcctcctacattgggctcaaggccgtggtggacttcctgtacggcggggagctggtgctggatggcggcaacattgactacgtcctggagacggctcacctgctgcagatctggacggtggtagacttctgctgtgagtacctggagcaggaggtgagcgaggacaactacctgtacctgcaggagctggcctccatctacagcctcaagcggcttgatgccttcatcgatggcttcatcctgaaccacttcggcacgctgtcctttacgcccgacttcctgcagaacgtctccatgcagaagctgtgtgtctacctgagcagcagcgaggtgcagcgggagtgtgagcacgacctcctgcaggccgccctgcagtggctgacgcagcagcccgagcgcgaggcccacgcccgccaggtgctggagaacatccacttcccgctcatccccaagaacgacctgctgcaccgcgtcaagccggccgtgtgctcgctgctgcccaaggaggccaactgcgagggcttcatcgaggaggccgtgcgctaccacaacaacctggcggcccagcccgtcatgcagaccaagcgcacggcgctgcgcaccaaccaggagcgcctgctgtttgtgggcggcgaggtctccgagcggtgtctggagctcagtgacgacacctgctacctggacgccaagagcgagcagtgggtcaaagagacgccgctgcccgcccggcggagccaccactgtgtcgcggtgctggggggcttcatcttcatcgccggcggcagcttctcacgggacaacggaggggatgcggcctccaatcttctttataggtatgacccccgctgtaaacagtggatcaaggtggcctccatgaaccagcgccgtgtggatttctaccttgcctccatcgaagacatgctggtggccatcggcggccggaatgagaacggagcgctctcttcagtagagacgtacagtcccaagactgactcctggtcctatgtggccggcttgccaaggttcacgtacggccacgcgggcaccatctacaaagacttcgtgtacatctcggggggccacgactaccaaattggcccctaccgcaagaacctgctatgctacgaccaccggacagacgtgtgggaggagcggcggcccatgaccacggcgcgcggctggcacagcatgtgcagcctgggtgacagcatctactccatcgggggcagcgatgacaacatcgagtccatggagcgcttcgacgtgctgggcgtggaggcctacagcccgcagtgcaaccagtggacccgcgtggcgccgctgctgcacgccaacagcgagtcgggcgtggcagtgtgggagggccgcatctacatcctgggcggctacagctgggagaacactgccttctccaagaccgtgcaggtgtacgaccgcgaggccgacaagtggagcaggggcgtcgacctgcccaaggccatcgctggcgggtccgcctgtgtctgcgccctggagccacggccagaggacaagaagaagaaaggcaaaggcaagaggcaccaggaccggggccagtgaccctagctgcgcctcttgggaccatcctcaccgtcacctcccagggctctgtagaccagcagcaacttcttagtattccggaaacattatgtacaacttagcagctttttttacttttatgattcttggtatttctatgatatcacagtaaccaattaaatactatctgtaactttacata

SEQ ID NO: 4454 - DNA, 1982 bp, Homo sapiens
ggggcttccttccctctttgtaggatggacgaggagtcactagatgggctgctcttcaaagaccacgacttctcttctgacttgttgaggcagctcaacagcttaaggcaaagcaggatcctgactgatgtgagcatctgtgccggtgcccgggagatcccctgccaccgcaacgtgctggcctccagcagcccctacttcagggctatgttctgcagcagcttccgggagaagagtgaagccaaagtgcagctgaaaggcattgaccccccaaccctggaccagatcgtctcctacgtgtatacgggggaggcacatattgccactgacaatgtcctccccgtgatggaggccgcctccatgctacagttccccaagctgtttgaggcctgctcctcgtacttgcagagccagttggcccccagcaactgcctgggtatgatcagactctcagaaatcttaagctgcgagaccctcaagaagaaagccagggaggtggcactgacgtccttcccagaggtggccgcatcggccgacctgaaggagctctgtgccttggagttgagggactatctcggagatgatgggctctgtggggaggaggaaaaggtgtttgaggccctcatggtttggatcaagcatgacctccaggcccggaagcgatacatgcaggaactgttcaagcaggtcaggctgcagtacatccacccagccttctttcaccacttcatcgccaacgatgccctcctgcagtcctcgcctgcatgccagatcatcttggagaccgccaagagacagatgttctctttgtgtggcaccaccgtcccagactgcaaactcctgttgcatgtccctccaagaaactcttaccaagatttcctcatcctcttgggcggaaggaaggacagccagcagaccaccagggacgtcctactgtacagcaaacagaccggccaatggcagagccttgccaaactcccgacacggctgtacaaggcctctgccatcaccttgcaccgcagcatctatgtgctggggggcatggctgtcagctcagggaggagtctggtcagtcacaatgtctacatcttctccctgaaactcaatcagtggaggctgggggagcccatgctggtggcccgctactcccacagaagcactgcccataagaacttcatcttctccatcggggggattggagaagggcaggagctcatgggctccatggaaaggtatgacagcatctgcaatgtctgggagagtatggccagcatgcccgtgggggtgctccaccccgcagtcgctgtgaaagaccaaagactctatctctttggaggagaggacatcatgcagaaccctgtgcgccttatccaggtttatcacatttccagaaactcgtggttcaaaatggagacaagaatgatcaagaacgtgtgtgcccctgcagtggtgcttggggagcggattgtcattgtgggaggttacacaaggaggattcttgcttatgaccctcaatccaacaaatttgtcaaatgtgcggacatgaaagaccggaggatgcaccatggggccacagtgatgggaaacaaactctacgtgacgggcgggcggcggctgaccacggactgcaacattgaggactccgcctccttcgattgctacgaccccgagacggacacctggacatcccagggacagctgccgcacaagctctttgaccatgcctgcctcactctccagtgcataccccgcacgtctggcctcccatgaggtcgacaagaaaccttctgccctagtcaaaatgccttctgtcgccagggacacaaacccagctccaaagggcttaacccttaaaggctgcagggagagctcacaagactgaggtaccagagtcgggaggcctggaactaggcattgcattgccagaactctctctctccttctctgcctctctccttatctctctcccccacctccatctg

SEQ ID NO: 4455 - DNA, 5710 bp, Homo sapiens
ggaaggagcggctcggtgttggggctaggccggtattctaggcccaagcccaggcccaggcctgtgttcccggcccttgctcaaagacaggccggtggccgctgcgacactctaggtacagcggagggcgcagcgggccgttcgctgaggtgtccggacccgccgccgagcgggccgtggagccacagtacgtggcggcgcctcttccttgcccgaagcggaactgctgaaggagcggcagcgcaggccggacgaggtgaaccaggtcatttaaccgccttcaggtgatgaatcatctgtctaataatcagatttgaggtccacagccctttgtggtcctgctacagggtgattttcagtggatgactgactggcgtggcccgaggggtgccgcagtgactgccttcccttgataaggaaacgagctttctgttctttctggacacctcgttacctgtaaaacattccggttataacttctttatccggcttgcatctctgtgcaagaggaaagctttcacatgaaagtgtcccttggtaacggcgaaatgggcgtctctgcccatttgcagccttgtaaggcaggaaccacacgcttttttaccagcaatactcacagttcggtggtattgcaaggctttgatcagcttagaatagaaggattgctttgtgatgtgaccctggtaccaggtgatggagatgaaatcttccctgttcacagagctatgatggcgtctgctagtgattatttcaaagccatgttcacaggtggaatgaaagaacaagatttgatgtgcattaagcttcatggggtgaacaaggttggtctgaagaaaatcattgattttatttatactgcaaaactttctcttaatatggacaatcttcaggacacacttgaagctgctagctttttacaaatattacccgttttggatttctgtaaagtatttcttatatcaggagtctctttggataactgtgttgaggttggacgaattgctaacacctacaatcttatagaagtggataaatatgttaataatttcatcctgaagaactttcctgctttattgagtactggggagtttctaaaactcccttttgaacgacttgcatttgtgctttccagtaatagtcttaagcactgtaccgaacttgaactctttaaggcagcctgtcgctggctaaggttggaagaccctcggatggattatgctgcaaagttaatgaagaatattcgatttccactgatgacaccacaggatctcatcaattacgtgcagacagtagatttcatgagaacagacaatacctgcgtgaatttgcttttggaagctagcaattaccaaatgatgccatatatgcagccagtgatgcagtcagatagaactgccattcgatctgactccactcacttggttacattaggaggagttttgaggcagcagctggttgtcagtaaagaattacggatgtatgatgaaagggcacaagaatggagatctttagccccaatggatgctccccgttaccagcatggtattgctgtcattggaaactttctttatgtagttggtggtcagagtaattatgatacaaaaggaaaaactgctgttgatacagttttcagatttgatcctcggtataataaatggatgcaggttgcatcattaaatgaaaagcgcacattctttcacttgagtgccctcaaaggacatttgtatgcagttggtgggcgcagtgcagctggtgaactggccacagtagaatgttacaacccaagaatgaatgagtggagctatgttgcaaaaatgagtgaaccccactatggtcatgctggaacagtatatggaggcttaatgtatatttcaggaggaattacccatgacactttccaaaatgagctcatgtgttttgacccagatacagataaatggatgcaaaaggctccaatgactacagtcagaggtctgcattgcatgtgtacagttggagataagctctatgtcattggtggcaatcacttcagaggaacaagtgattatgatgatgttctaagctgtgaatactattcaccaacccttgaccagtggaccccaattgccgccatgttaagaggccaaagtgatgttggagttgccgtctttgaaaataaaatctatgttgttggtggatattcttggaataatcgttgtatggtagaaattgtccagaaatatgacccagaaaaagatgagtggcataaagtttttgatcttccagagtcacttggtggcattcgagcctgtacactcacagtttttccacctgaagaaaaccctgggtcaccttctagagaatcacctctttcagcaccttcagatcattcttaggtctaaggtgtaacacctttgcagtacgtcatgggtgatctaatacttccccttcagttgtatcttcttacagtgattggtacagttattagatataaaggtaactgatgttattcgtcttgtatggcttttagtatgtttatcaagtggctaacaaatgcattctgaaaatgtatttaacatagctgttttaacaaatgaaaaaaagacgtagaaaaatgtttagatgtctttttgtgatgttatataaaattgtagatgactgtggtaaatgtgtaattatgtccattatgcttcaaagttgagttttcatctttgactccaaaatgtcagagggaggccgctctaaactaaaaataacgaaaggttgccaagtattaatactagttacctccctcttttcgtagtttttgtcatgtctgtcaacttactcgattgtgtggttgcattcagaatatttgaagtttcttacgtagacagaaataataaaaatattaactaggaaaaaacagtatagcaccaagccagtatttggtatctctctctagagcgagcaagagagggagagaggaggaaaaaatacacataatacaaacatacatgcatgcacacatacatacatatgtatacacacacataatttgaaaactgattggcacttcaacgatgctgaaattgtttttaaattgaagtttctttcttccacaaagcagccgtttctattcaaatggaaattcagtaccagagaataaatgtctatgtagtcatactgaatttagatagataagggctacagcatactaaatcgacaaccaaatttgtcatgtgactaaaccgttacttcagatgaagcttacattactgttttctgcttgtgtattttctgtagagtacttttacacagattggtaaagttcaggtttcagagaactgcttttgtgcagaaaatttaggttcttttttccacctttttggtcagtaaaacttaatgaaaaaagcaaagaaaaaaatattctgaacaaagctatagggttttaagttcagcctcccaacttagtcatcctaacatgattattttgtgatttggggtgcttgccctggtgctgttccagtccatgtgcatcctgagctgtgtgatctgcctcgaggctatgatctgagcaagcaggagataacattttcttctgcatcaagtgaggaaaaatgtgcttttggccatgtctcaaagacaggaccaacttcagattcccaaagaagccagctacagagcctctggaacactatggtcttacaagcagtactaaaatcaaccctcagcctcttcaatgccaaaggtatccctattggttgagaaccacatggtaatttttaatgggacttttatcagcaaatggagttacaggaattctctgtaatgagtgattctgaagaggtactttcctggaataattgtctacctgaagaaaaaaaatttatatatacattgtgtgtgtgtgtaatacacacacacaaccccctatacctggaagattgtcagcatgtaaatcaggaacaactttctccttattgacaatcccataataaaactcaggaaccaaggcaaaatgaattggcttctaggggtctgaaccttactgcccatacaagtgttgattcattttaatgctgtttatgatttctgcattggcagaaattttcatactttctatgtttttttaattactcagttttttattactaaaaatagcacatttgagtacatttgaaaagtagaaaaattagaaattattaactttattgaataagcaagaagtgcatcctaatcctttgattattaatgaggttgaatatttgtgtgctatcggtagctgtgtttctttgatcagatgttcctgtccttttgcccttctgttatctgttggagttgctttgtttttcgtatcaagttataggatctctttatataataaatgtaatttaacttgcatttgcttgcatttatttcttccctcaatctgttgtagttttacaaaggcaacgctgttcagttaatttttgagatcaaatttgtctttttttttttttgagacagggtctcactgttgtgcagtctggagtgcaatggcacgatgtgtgctcactgaaacctctgcctctcatgttcaggcgattctcccacctcagcctcccgattagctgggattacaggcatgtaccaccaagcccggctaattttgtatttttagtagagatggggttaggggataattttgatatggtttattttttatgtagtatttcagtgcttattctgacatatcaaggtgatactgccctgcctctattttgtacaggcttttccttttattgaaaaaaagtactttttattacatcttatgtctgaacctggtgcttcctattgaaataagtattgctttactaggtaaactgctctatctacatcccccacctccagcttcacccaccctgcctctcatttttttactttcccgtattctgcagttgacagttctcttggtaatcatacaggtagctgactaatgctatgctaatacaggttgagcagccctaatccaaaaatccaaattgctccaaaatttaaaactttttgagggccaacaggatgccacaagtagaaaattccacaccagagctcatgtgacaggttacactcaaaacacagtgaagacttgtttcatgcacaacattattaagactattataattaccttcagactacgtgtctgaaacgtgaaatataaccgaagttttaagtaatattgtttagacttgggtccctcccccaggatacgtcatgtacatgcaaatattccaaaatccaaaacacttctggtcccaagcatttcagataagggatattcaatctgtactgctcattaaacctggagtttcttatagagagaaattttaggtggttgaaatgattaaatggaaagagatttattttcataagctggtaattttttaaagaaagttcagactggaaaaatatttagaggataaaaactaaaagcacataaagcattatgttaacatttcttgttttagtttttcggaaagtattcaaaaattaacatttgttagcttttttgatatgtctattatagaacgtacaggaaaataaaagcaaactaatttatcagtgattccacatgttgaagataatttctattaatagtatattatatatatatatatacgtacatatgtgcaggcatttgtcaaatatttttcaagtatgccagaccttaggctaaaagctggataatgaaaataaatccaccttccaaaga

SEQ ID NO: 4456 - DNA, 3259 bp, Homo sapiens
gttcgctgaggtgtccggacccgccgccgagcgggccgtggagccacagtacgtggcggcgcctcttccttgcccgaagcggaactgctgaaggagcggcagcgcaggccggacgaggtgaaccaggtcatttaaccgccttcagagctatgatggcgtctgctagtgattatttcaaagccatgttcacaggtggaatgaaagaacaagatttgatgtgcattaagcttcatggggtgaacaaggttggtctgaagaaaatcattgattttatttatactgcaaaactttctcttaatatggacaatcttcaggacacacttgaagctgctagctttttacaaatattacccgttttggatttctgtaaagtatttcttatatcaggagtctctttggataactgtgttgaggttggacgaattgctaacacctacaatcttatagaagtggataaatatgttaataatttcatcctgaagaactttcctgctttattgagtactggggagtttctaaaactcccttttgaacgacttgcatttgtgctttccagtaatagtcttaagcactgtaccgaacttgaactctttaaggcagcctgtcgctggctaaggttggaagaccctcggatggattatgctgcaaagttaatgaagaatattcgatttccactgatgacaccacaggatctcatcaattacgtgcagacagtagatttcatgagaacagacaatacctgcgtgaatttgcttttggaagctagcaattaccaaatgatgccatatatgcagccagtgatgcagtcagatagaactgccattcgatctgactccactcacttggttacattaggaggagttttgaggcagcagctggttgtcagtaaagaattacggatgtatgatgaaagggcacaagaatggagatctttagccccaatggatgctccccgttaccagcatggtattgctgtcattggaaactttctttatgtagttggtggtcagagtaattatgatacaaaaggaaaaactgctgttgatacagttttcagatttgatcctcggtataataaatggatgcaggttgcatcattaaatgaaaagcgcacattctttcacttgagtgccctcaaaggacatttgtatgcagttggtgggcgcagtgcagctggtgaactggccacagtagaatgttacaacccaagaatgaatgagtggagctatgttgcaaaaatgagtgaaccccactatggtcatgctggaacagtatatggaggcttaatgtatatttcaggaggaattacccatgacactttccaaaatgagctcatgtgttttgacccagatacagataaatggatgcaaaaggctccaatgactacagtcagaggtctgcattgcatgtgtacagttggagataagctctatgtcattggtggcaatcacttcagaggaacaagtgattatgatgatgttctaagctgtgaatactattcaccaacccttgaccagtggaccccaattgccgccatgttaagaggccaaagtgatgttggagttgccgtctttgaaaataaaatctatgttgttggtggatattcttggaataatcgttgtatggtagaaattgtccagaaatatgacccagaaaaagatgagtggcataaagtttttgatcttccagagtcacttggtggcattcgagcctgtacactcacagtttttccacctgaagaaaaccctgggtcaccttctagagaatcacctctttcagcaccttcagatcattcttaggtctaaggtgtaacacctttgcagtacgtcatgggtgatctaatacttccccttcagttgtatcttcttacagtgattggtacagttattagatataaaggtaactgatgttattcgtcttgtatggcttttagtatgtttatcaagtggctaacaaatgcattctgaaaatgtatttaacatagctgttttaacaaatgaaaaaaagacgtagaaaaatgtttagatgtctttttgtgatgttatataaaattgtagatgactgtggtaaatgtgtaattatgtccattatgcttcaaagttgagttttcatctttgactccaaaatgtcagagggaggccgctctaaactaaaaataacgaaaggttgccaagtattaatactagttacctccctcttttcgtagtttttgtcatgtctgtcaacttactcgattgtgtggttgcattcagaatatttgaagtttcttacgtagacagaaataataaaaatattaactaggaaaaaacagtatagcaccaagccagtatttggtatctctctctagagcgagcaagagagggagagaggaggaaaaaatacacataatacaaacatacatgcatgcacacatacatacatatgtatacacacacataatttgaaaactgattggcacttcaacgatgctgaaattgtttttaaattgaagtttctttcttccacaaagcagccgtttctattcaaatggaaattcagtaccagagaataaatgtctatgtagtcatactgaatttagatagataagggctacagcatactaaatcgacaaccaaatttgtcatgtgactaaaccgttacttcagatgaagcttacattactgttttctgcttgtgtattttctgtagagtacttttacacagattggtaaagttcaggtttcagagaactgcttttgtgcagaaaatttaggttcttttttccacctttttggtcagtaaaacttaatgaaaaaagcaaagaaaaaaatattctgaacaaagctatagggttttaagttcagcctcccaacttagtcatcctaacatgattattttgtgatttggggtgcttgccctggtgctgttccagtccatgtgcatcctgagctgtgtgatctgcctcgaggctatgatctgagcaagcaggagataacattttcttctgcatcaagtgaggaaaaatgtgcttttggccatgtctcaaagacaggaccaacttcagattcccaaagaagccagctacagagcctctggaacactatggtcttacaagcagtactaaaatcaaccctcagcctcttcaatgccaaaggtatccctattggttgagaaccacatggtaatttttaatgggacttttatcagcaaatggagttacaggaattctctgtaatgagtgattctgaagaggtactttcctggaataattgtctacctg

SEQ ID NO: 4457 - DNA, 1174 bp, Homo sapiens
acactacttggggcccctcttctttccagcccttctcctgtgtgcctgcctcctgccgccgccaccatgaccacctccatccgccagttcacctcctccagctccatcaagggctcctctggcctggggggcggctcgtcccgcacctcctgccagctgtctggcggcctgggtgccggctcctgcaggccgggatctgctggtggcctgggcagcgccctcgggggtagcagctactccagctgctacagctttggctctggcggtggctatggcagcagcagctttgagggcgttgatgggctgctggtcggaggtgagaaggccaccatgcagaacctcaatgaccgcctggcctcctacctggacaaggtgcgtgccctggaggaggccgacactgagctggaggtaaagatccgtgactggtaccagaggcaggccccggggcccgcccgtgactacagccagtactacaggataatcgaggagctgcagaacaagccaccgtggacaatgccaacatcctgctacatattgacaatgcccatctggctgctgctgacttccgcaccaaagtcctggcaaaatgaaggcaggtgagcagccaggacctggacctgcaattccaagcagcctgggctgaagtccctgattcccatggcaggtttgagacagagcaggccctgtgcctgagtgtggaggccgacatcaatggcccgtgcagggtgctggatgagctgaccctggccagagccgacctggagatgcacattgagaacctcaaggaggagctggcctacctgaagaagaaccacgaggagatgaacgccccgcgaggccaggtgggcggtgagatcaatgtggagatgggcgctgccccaggtgtggacctgagccgcatcctgaatgagatgcgtgagcagtatgagaagatggcagagaagaaccgcaaggatgccgaggattggttcttcagcaagacagaggagctgaaccgcgaggtggctaccaacagtgagctggtccagagcggcaagagcgagatttcggagctccggtgcaccatgcaggccttggagatcgagctgcagtcccagctcagcatgaaagcatccctggagggcaacctggcggagacagagaaccgctactgcatgcagctgtcccagatcca

SEQ ID NO: 4458 - DNA, 1546 bp, Homo sapiens
ctacactacttggggcccctcttctttccagcccttctcctgtgtgcctgcctcctgccgccgccaccatgaccacctccatccgccagttcacctcctccagctccatcaagggctcctctggcctggggggcggctcgtcccgcacctcctgccagctgtctggcggcctgggtgccggctcctgcaggccgggatctgctggtggcctgggcagcgccctcgggggtagcagctactccagctgctacagctttggctctggcggtggctatggcagcagcagctttgagggcgttgatgggctgctggtcggaggtgagaaggccaccatgcagaacctcaatgaccgcctggcctcctacctggacaaggtgcgtgccctggaggaggccgacactgagctggaggtaaagatccgtgactggtaccagaggcaggccccggggcccgcccgtgactacagccagtactacaggataatcgaggagctgcagaacaagatcctcacagccaccgtggacaatgccaacatcctgctacatattgacaatgcccatctggctgctgctgacttccgcaccaagtttgagacagagcaggccctgtgcctgagtgtggaggccgacatcaatggcccgtgcagggtgctggatgagctgaccctggccagagccgacctggagatgcacattgagaacctcaaggaggagctggcctacctgaagaagaaccacgaggagatgaacgccccgcgaggccaggtgggcggtgagatcaatgtggagatgggcgctgccccaggtgtggacctgagccgcatcctgaatgagatgcgtgagcagtatgagaagatggcagagaagaaccgcaaggatgccgaggattggttcttcagcaagacagaggagctgaaccgcgaggtggctaccaacagtgagctggtccagagcggcaagagcgagatttcggagctccggtgcaccatgcaggccttggagatcgagctgcagtcccagctcagcatgaaagcatccctggagggcaacctggcggagacagagaaccgctactgcatgcagctgtcccagatccaggggctgatcggcagtgtggaggagcggctggcccagcttctctgcgagatggagcagcagaaccaggagtacaagatcctcctggacatgaagatgcggctggagctggagatcaccacctaccaccgcctgctggagggcgaggatgcccacgagggcctcctggcccctacccactttaaattgcctgcttctcctgcagcggtgaccacctgtcaggtgcctaccattgtggaagaggtccaggatggtaaggtcatctcctcccgcgagcaggtccgccagaccacccgctgagcactcagctttcctggccggccccccaggaggcagggaggcagcggtcccatctgccccgcggtctccggcctctccaccctcagccccctgcttcagtcccttccccatgcttccctgcgtgatgacaataaagctcgttgactcagcta

SEQ ID NO: 4459 - DNA, 408 bp, Homo sapiens
cagctctcaacccaactcctgacaccatggccagctgttccaccagtgggacctgtggctccagctgctgccagccaagctgctgtgaaactagctgctgccagccaagctgctgccagaccagctcctgcggaaccggctgtggcattggtggtggcattggctatggccaggagggcagcggtggatctgtgagcacccgtatcaggtggtgccacccagattgccacgtggagggcacctgcctgcccccctgctacctggtaagctgcacacccccatcctgctgccagctgcaccacgccgaggcctcctgctgccgcccgtcctactgtggacagtcctgctgccgcccagcctgctgctgccactgctgtgagcccacctgctaaaagccaggttgctgat

SEQ ID NO: 4460 - DNA, 733 bp, Homo sapiens
accagcctcagacaccaccatgaccggctcctgctgcggctccaccttctcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgcggccagccgaccccttgcagcaccacctgcaggacctcctcctgctgagccaccacctgctgccagcctgtgtctgtgcagtccccctgcggccagccgaccccttgcagcaccacctgcaggacctcctcctgctgagcagcccgttatcacgaagggcccctcagaagatggccaggtccatcccgctgcccctcagggcttcaccgcagagcaatacacgtttccttgagaagcccatttctcatctcttcatactagctcacactatgcattgaagacaccttttcagaccaaccacagatgagaaatacttttcctaggactccagtctaactcctatatcatgttgtctgctttctaataaactcaatactcctaccatagaaa

SEQ ID NO: 4461 - DNA, 390 bp, Homo sapiens
atgaccggctcctgctgcggctccaccttctcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgcggccagccgtccccctgcggccagccgaccccttgcagcaccacctgcaggacctcctcctgctga

SEQ ID NO: 4462 - DNA, 938 bp, Homo sapiens
atggtcagctcctgttgtggctccgtgtgctctgaccagggctgcagccaagacctctgtcaggagacctgctgccgccccagctgctgtcagaccacctgttgcaggaccacctgctaccgccccagctgttgtgtgtccagctgctgcaggccccagtgctgccagtctgtgtgctgccaacccacctgctgtcgccccacctgctgtgagacgacctgctgccaccctaggtgctgcatctccagctgctgccgccccagctgctgtatgtccagctgctgcaagccccagtgctgccagtctgtgtgctgccagcccacctgctgccgccccagctgctgccgcccctgctgctgcctgcgtccagtctgtggccgagtctcctgccacaccacttgctatcgcccaacctgtgtcatctccacctgtccccgccccttgtgctgtgcctcctcttgctgctgagcccactgccctggctcacgtcccccttcaccactggcccacagatgtagacccttctactgtgctgaccattaggatacatgaagtggggttgatgtcattcaataggatggaccttatgcttccaaagagcccaccaccatttcactgactctgtgagaacattctggttcattttaaactccctcctttgctttctttttcttctggtggtggcaccaaatgtgaattaatttgtaatacactagctaagaaattattccaatcttctgatttccttattttctttatcactttaaggtacagattctccttctcagtgaggtagatattatctgcaggaccagttttgtcactgatgttgcaccctcagatccagccacccaattgtattctgtgtttctcctagggtgaatttcttatgctttgttgtatctctgctttctaataaacttttctgcacttaagaa

SEQ ID NO: 4463 - DNA, 660 bp, Homo sapiens
atgggctgctgtggctgctctggaggctgtggctccggctgtgggggctgtggctccggctgtgggggctgtggctctggctgtgggggctgtggctccggctgtgggggctgtggctccggctgtgggggctgtggctccagctgctgtgtgcccatctgctgctgcaaacctgtgtgctgctgtgtgccagcctgttcctgctccagctgtggctcctgtgggggctccaaggggggctatggctcttgtgggggttccaaggggggctgtgtctcctgtgggggttccaaggggggctgtggctcctgtgggggctccaaggggggctgtggctcctgtgggggttccaaggggggctgtggctcctgtgggggctccaaaggaggctgtggctcttgtggctgctcccagtgcagctgctgtaagccctgctgcttctcttcaggctgtgggtcatcctgctgccagtccagctgctgtaagccctcctgctgccagtccagctgctgcaagccctactgctgccagtccagctgctgtaagccctgctgctcctcctcaggttgtgggtcatcctgctgccagtccagttgctgcaatccctgctgctcccagtctagttgctgtgtccctgtgtgctgccagtgtaagatctga

SEQ ID NO: 4464 - DNA, 1181 bp, Homo sapiens
tctcatctgctcctctacctgctccaccctcaatccaccagaaccatgggctgctgtggctgctctggaggctgtggctccggctgtgggggctgtggctccggctgtgggggctgtggctctggctgtgggggctgtggctccggctgtgggggctgtggctccggctgtgggggctgtggctccagctgctgtgtgcccatctgctgctgcaaacctgtgtgctgctgtgtgccagcctgttcctgctccagctgtggctcctgtgggggctccaaggggggctatggctcttgtgggggttccaaggggggctgtgtctcctgtgggggttccaaggggggctgtggctcctgtgggggctccaaggggggctgtggctcctgtgggggttccaaggggggctgtggctcctgtgggggctccaaaggaggctgtggctcttgtggctgctcccagtgcagctgctgtaagccctgctgcttctcttcaggctgtgggtcatcctgctgccagtccagctgctgtaagccctgctgctcctcctcaggttgtgggtcatcctgctgccagtccagctgctgcaagccctactgctgccagtccagctgctgtaagccctgctgctcctcctcaggttgtgggtcatcctgctgccagtccagttgctgcaatccctgctgctcccagtctagttgctgtgtccctgtgtgctgccagtgtaagatctgaggctctggactcaggcctcatgtgagtcctgctaatcctgtcttccaaagctgtgacctgtccttcattgttgagccccaaatcattgctcagggtccattccctgctgtagaacgatgccatatctggctgccttttcctaagaagagtccaccctaattaatgtccattgtctctcctaacaaattctctccccaagtcaactgcaattgcagctgaatcacccctcacccactagcctcgcctttgctcatcttttcagaggcctgagctcctgaacccacttgcagtcctgtcttttccagctggagcagctgggcataagcgtcccacctgcaacaaggtgggcgtttaagaggcttccttggagtggctttgcatgtccaacactctgctgtatctttttttttttttttttttttttgagatggagtctcgcactgtcaccc

SEQ ID NO: 4465 - DNA, 351 bp, Homo sapiens
tgctgccacccaacttgctgtcaaaacacctgctgcaggaccacctgctgccagcccacttgtgtggccagctgctgccagccttcctgctgcagcacaccctgctgccagcccacctgctgtgggtccagctgctgtgggaccacctgctgccagcctacctgctgccagcccacctgctgcaggaacacctcttgccagcccacctgctgtgggtccagctgctgccagcctccttgctgccgtcccacctgctgccagaccacctgctacaggaccacctgttgccgccccagctgttgctgcagtccttgctgtgtctccagctgctgccagccttcctgctgctaa

SEQ ID NO: 4466 - DNA, 303 bp, Homo sapiens
agaccattttgttgccacacaccctgttgccagccctcctgctgtgtgcccagctgctgccagccttgctgccacccaacttgctgtcaaaacacctgctgcaggaccacctgctgccagcccacttgtgtggccagctgctgccagccttcctgctgcagcacaccctgctgccagcccacctgctgtggccaaacctgcaatgagtccagctattgtctgccttgctgccgtcccacctgctgccagaccacctgctacaggaccacctgttgccgccccagctgttgctgcagtccttgc

SEQ ID NO: 4467 - DNA, 753 bp, Homo sapiens
atgacccactgctgttccccttgctgtcagcctacatgctgcaggaccacctgctgcaggacaacctgctggaagcccaccactgtgaccacctgcagcagcacaccctgttgccagccctcctgctgtgtgcccagctgctgccagccttgctgccacccaacttgctgtcaaaacacctgctgcaggaccacctgctgccagcccacttgtgtggccagctgctgccagccttcctgctgcagcacaccctgctgccagcccacctgctgtgggtccagctgctgtggccaaaccagctgtgggtccagctgctgtcagcctatttgtgggtccagttgctgtcagccttgctgtcacccgacttgctatcaaactatctgcttcaggaccacctgctgccagcctacctgctgccagcccacctgctgcaggaacacctcttgccagcccacctgctgtgggtccagctgctgccagccttgctgccacccaacatgctgtcaaaccatttgtagatccacctgctgccaaccatcctgtgtgaccagatgctgcagcacaccctgttgccagccaacctgtggtgggtccagctgctgtagccaaacctgcaatgagtccagctattgtctgccttgctgccgtcccacctgctgccagaccacctgctacaggaccacctgttgccgccccagctgttgctgcagtccttgctgtgtctccagctgctgccagccttcctgctgctaa

SEQ ID NO: 4468 - DNA, 1303 bp, Homo sapiens
tcacctctgaacagaagcccaccctccacccctgacaacatgacccactgttgctcccctggctgtcagcctacctgctgcaggaccacttgctgcaggactacctgctggcagcccaccattgtgaccacctgcagcagcacaccctgctgccagccctcctgctgtgtgtccagctgctgccagccttactgccacccaacttgctgtcaaaacacctgctgcaggaccacctgctgccagcccacctgtgtgaccagctgctgccagccttcctgctgcagcacaccctgctaccagcccatctgctgtgggtccagctgctgtggccaaaccagctgtgggtccagctgtggccagagcagctcctgtgcacctgtgtactgcagaagaacctgctaccaccccacgactgtctgcctgcctggttgcctcaaccagagctgtggatccagctgctgccagccctgctactgcccagcctgctgtgtgtccagctgctgccagcattcttgttgctgagcagcaccacagaggaccatcatcctcacacaacaaccttctgctcaactgaccttttttttcttttgagacggagcctcactgtcacccaggctggagtgcagtagcacgctctcggctcgctgcaacctccatcttctgggttcaagtgattctcctgcctcagcctcctgagtagctgggattacatgcctgtgccaccacgcctggctaattttttgtatttttagtatttttagtagttttcaccatgttgatcagacttgtctggaactcctgccctcaggtgatccacctgcctcagcctcccaaagtgctgggattacaggtgtgagctaccacacccagacccaactcacttatctttcagaagacagatttactttcaaactttactgatacacagtatgctttcaccaattttttttatttctttgcctgtttaaaatcttgggaatcagcttgagggagggcagaatacttcatcctgattcttttttccttacactttgtggatcatgtgccagcttcatgtgttctcaatgtggagacatggtctccattcgactctaaagtcaagagcttcattctctccttctaagaaacttaggtttctgcaactgatcaataatctttgcaatcatatttttgttttcaattttgtcctcatgtttcttttacccttctttcttcttttcattgtaactttgggctatgtccctagtagcagggattcttacctatatatttctgaataaattctgaaccatccttcatctca

SEQ ID NO: 4469 - DNA, 1039 bp, Homo sapiens
tcacctctgaacagaagtccaccctccacccctgacaccatgacccactgttgctccccttgctgtcagcctacctgctgcaggaccacctgctggaagcccaccactgtgaccacctgcagcagcacaccctgctgccagccctcctgctgtgtgtccagctgctgccagccttgctgccacccaacttgctgtcaaaacacctgctgcaggaccacctgctgccagcccacctgtgtgaccagctgctgccagccttcctgctgcagcacaccctgctgccagcccatctgctgtgggtccagctgctgtggccaaaccagctgtgggtccagctgctgccagcccagctcctgtgcacccatctactgcaggagaacctgctaccaccccacgagtgtctacctgcctggttgcctaaaccagagctgtggctccagctgctgccagccgtgctgccgcccagcctgctgtgagactacctgctgcaggaccacttgcttccagcccacctgtgtgaccagctgctgtcagcctgcttgctgctgatcagttccgcagaggaccatcatccccatacagtaaccctctggcaaaagatttaccttctgggggacaaatttactttcaaactgtgatgaaaaccaacaaagtgaacttagggtgaactttgctcaccctaatttttatgacttctctgcatgtttaacattttgtgaatcagcttgagtgagggtagagtacttcatcctgattcttttttccttacaccttgtggatcatgtgccaccttcatgtattttcaatttggagtcatggtctcagcttgactctaaagtcaagagcttcattccctttctctaagaaacttaggttttgcaactgatcaataatcttcacaatcatgttttcattttcagtgtcctcctcgtggttcttttatccttattcctttcatgatcattttgggttatctccctagaaacagggactcttacctatatgtttcttaataaactcaaagctgtccttcatctca

SEQ ID NO: 4470 - DNA, 981 bp, Homo sapiens
ccatgacccactgttgctccccttgctgtcagcctacctgctgcaggaccacctgctggaagcccaccactgtgaccacctgcagcagcacaccctgctgccagccctcctgctgtgtgtctagctgctgccagccttgctgccgcccagcttgctgtcaaaacacctgctgcaggaccacctgctgccagcccacctgtctgaccagctgctgccagccttcctgctgcagcacaacctgctgccagcccatctgctgtgggtccagctgctgtggccaaaccagctgtgggtccagctgtggccagagcagctcctgtgcacctgtgtactgcagaagaacctgctactacccgacgactgtctgcctgcctggttgcctcaaccagagctgtggatccagctgctgccagccctgctgccgccccgcctgctgtgagaccacctgctgcaggaccacttgcttccagcccacctgtgtgtccagctgctgccagccttcttgctgctgatcaagtcccaagagaacaaccatcttcacacaacaaccttctgctcaactgacttatcttttggaggactaatttaccttactgctgacagcaaccatgttctcacccaaatttttatgaattctctgcatatttaaaatcttgtgaatcagcttgagggagggcagaatacttcatcctgattctctttttcttataccttgtgaatcatgtgccagcttcatgtgttctcaattttgagtcatggtctcagctttgactcaaaagtcaagagcttcattctcttcacttaagaaacttaagttgctgcaaatgattaagaatcttcacaactatgttttcttttcaatatactcatgattcttgtatcctgcttccttcttttaatgatcactttgggttatctccctataaccagggatcttacctatatatttcttaataaataaatttggaactattattcata

SEQ ID NO: 4471 - DNA, 528 bp, Homo sapiens
atgacccactgttgctccccttgctgtcagcctacatgctgcaggaccacctgctgcaggaccacctgctggaagcccaccactgtgaccacctgcagcagcacaccctgctgccagccctcctgctgtgtttccagctgctgccagcctccttgctgccgcccagcttgctgtcaaaacacctgctgcaggaccacctgctgccagcccacctgtctgaccagctgctgccagccttcctgctgcagcacaacctgctgccagcccatctgctgtgggtccagctgctgtggccaaaccagctgtgggtccagctgtggccagagcagctcctgtgcacctgtgtactgcagaagaacctgctactacccgacgactgtctgcctgcctggttgcctcaaccagagctgtggatccagctgctgccagccctgctgccgccccgcctgctgtgagaccacctgctgcaggaccacttgcttccagcccacctgtgtgtccagctgctgccagccttcttgctgctga

SEQ ID NO: 4472 - DNA, 6225 bp, Homo sapiens
gggagagaaaggagggatgaagccgcctgcccactggacgggagggctgcagccagagcttcagggcagccctgctggatgggacagcactgagggctggacctggggggatggagaacatgggctgggggcagcagccatgcctacctggggggcccgccccgcgtccccagatcgctttgcggtgtctgcggaggctgagaacaaggttcgggaacagcagccccatgtggagcgcatcttcagcgtgggggtgagcgtccttccgaaggactgtccggacaacccccacatctggctgcagctggagggccccaaggaaaacgccagcagagccaaggagtacctgaagggcctctgcagcccagaactgcaggatgaaatccactacccgcccaaactgcactgcatctttctgggagcccagggcttcttccttgactgcctggcctggagcacgtcagcccatctggtgcccagggcgccaggctcactgatgatcagtggcctgactgaagcctttgtcatggctcagagccgggtagaagagctggcagagcggctgagctgggacttcacgccaggaccatcttccggagcctctcagtgtactggagtgctgagagacttctctgccctgctgcagtccccgggggatgcccatagagaggctctgttgcagttgcccctggctgtccaggaggagctgctgagtctggtgcaggaggcgtctagtgggcaggggccaggagcactggcttcttgggaggggcggagctcagccttgctgggtgctcagtgccaaggagtgagagctccccctagtgacggcagggagtccctggacactggatctatgggacccggagattgcaggggagcaaggggagacacttacgctgtggagaaggagggagggaaacagggtggtcccagggagatggattgggggtggaaggagttgcctggggaagaggcgtgggagagagaagtggccctcaggccacagtcagtgggtggaggggcaagggagtcagcacccctgaaagggaaggccctggggaaggaggagatagctctgggaggaggagggttctgtgtccaccgtgagcctcccggtgcccatggctcctgtcacagggcagctcagtcccgaggagcctccctcctccagcggctccacaatgggaatgcctctcctccgagggtgcccagccctccacctgcaccggaacccccatggcactgtggagaccggggtgactgcggagaccggggagacgtgggggacaggggagacaagcagcagggcatggcacggggtcgggggcctcaatggaaacgaggcgcccgagggggcaacttggtgactggcacacagcgtttcaaggaggccctgcaggatcctttcaccctgtgccttgccaatgtgcctggccagccagacctccgccatattgtcattgacggcagcaacgtggccatggtgcatggcctccagcactacttctccagccggggcattgccattgctgtgcagtacttctgggaccgtggtcaccgtgacataactgtctttgtgcctcagtggcgcttcagtaaggatgccaaagtcagagagagtcacttcctgcaaaagctgtattccctcagcctgctctccctcacaccctcacgagtcatggatggcaagaggatctcctcctatgatgacaggttcatggtgaagctggctgaagagacagatgggataattgtctccaatgaccagttccgggacctggcggaggagtctgagaagtggatggcaatcatcagagaacgcctgctgccctttacctttgtgggaaacctcttcatggtacctgatgacccactggggcgaaacggccccaccctggatgaatttctgaagaagccagccaggacacaggggtcttctaaggctcagcatccttccaggggctttgcagaacatggtaaacagcagcaggggagagaagaggaaaaaggtagtggtggcattcggaagacccgggaaacagagcggctccggcggcagctgctggaggtgttttggggtcaggatcacaaagtggacttcatcctgcagcgggagccatactgccgggacatcaaccaactgtctgaggccctgctcagtcttaacttttgagcctcacctgcttgagtggctgccgccctgtcagctccagccgcctccagctcagccctttctgtgagagtccctctgctgctcactctgatccagaggcaccctgagttggtgctttggatcagggaagccactttgggacaggtccataaagtgaactgatcttaccgagtcaggacctcagccagctctcaagaggttctgctcagccttaacttctcaactttgccttagcacagggtttctgtagggagtgggggctgctagaggggattagttccggagactgagactgttggctccacctccaagctgagctagggtggagggcagggtgggcaggaagtgacaggaagttaagctgttcctctccctggctgctgctctggatggccagagaacaagatgctcccttgctgagctcctgggagcgtggaaggagatgctaggccctggcacagtgttatgtggactgggccacgatagggtggagtgagctagtgaagaaggcagagggagacttggcttctggtctcagctatgcctgttttgtgaccttgattgagttgcttgggctttacttctgcctacaaatcaggggtaaaaatacctgttgggaggagaaatgagaacatagaggaaagcctcttggaggaaaggtgcttggaccaagtctcaggtgtgtctgcctgtggctgcacaggctctctaaccgaaacctcactttcagagagatgtgggtcctttgtctccaggatccacaccctagattttaacactgcattctcactataacgtgccctataatggctgcatcccttttgagcaacctccaaaatctacatttacacagtaggtaaattagggatgactgcattatcaaaatactctcagggttcctataaatggcagctctcctgttgtattcaggtgttgtttacagactaacaaatgtgttggcaaatccctggttagatgcacttcctggtgttgagatgaacacgtcgatttttcaccaatcgatgaagccatgctctgcaatgacaatattaatgtgatccgaccctaacattttctctatggaagacgtatgttgcataaagcaaggcacacttctgctttatgtgtgtgtgtatggggatgggaggacttaacggaagttgaaccagttggttctagatgaaccaattatctggaaaatgaaagaaccagagttggaaggcacttgactggccaccagaccaactctgctgttactgacatgctttcttcaccctgattcctagaggtcattgccctggatctgcttgaagtcctcctgtgccagggaatttactatctccagggtagcacattccctgtgtagacggtattaatcagtactccttactttagtgcagcctaaagtatgcttttctgttacatccacctttgaggctggtcatacctccaggaacaatacagagccagtcaacttcctggaatccaagaccagataaagaagtaggacaggtgcccctgggttctgttctgtgtgggcctgtggggagtctctagacaagatcttttccaggccctgacttctgcctccctctgagtggcacagggagttgaatactgcatggcgagtgtaatgatgatggggagggtccttgtgtcctcaccccttcctttttggtgatttacaccactgtaccatactgacccaggctgggggcaggtgtgttggagacaggctggtcaaagaggtgacaatgattaagagataacccagcggtccctgagaagagattggttagtatggcctgaactggtggctgggggaactgtgtctggtcaagttatggcagatgtcacagctttaggtaggtaaaaagggtcctagatgaaaaccttggagtttttttttttcctgatagggttgtttatacttcttgattggtttcttgccattttcactttcagtgatggtgggtgtgcagtagaccaaaagtgtcttctgcccttttgtgctaagggccctggttgactgagtggccccagtcagatgagaggcaagtcctaagcttcttatagacagggatgttgactttgttctgctgcagcctgataaactgggaccactgtgtggttagtaatgcacttgccatttggtgacacagactgaaggctatcctacacctgggccttacctcttcctctactggcatcctaatggcactctgacagcatccagggtgactacagggcccattggaaatggatcatcattctctcttctagtgtctatctttatcataacctgatgtcccaaacttgtgacaagttcttttggcaactgaaggaccaagaagggaaacggtgatgagagagactgctcattgtaactttcaaaaccccgtctttggggaagaatcatctagggtgacattccttgaagtaaatcccaggagaatctaggccaaagagatgagccaaggttagtgagacaatttatttttattgcctaaactgcagagcattctctacacagcgtaaaggagaagtggggcagctgcaggacatgtagagaaaccaaactgggaaatcttacaaggagttgaaaagattaatgtcccaacctgatgagattacggccttgagacaataaggtggagcaacagaacaatgggaaagaggactgggagaggaatctaagaaccagatggcttcagctctctagaggagctgagcctattcacagtgcctaacctggaagcctgtgaggaacaggcctcaggcccttgccacgacctacttaggctacaatttcctttaaggcagcccctagctctgggaaggaatactggtagccagtggccagtgttcgctgtgggatcaccttctggccctccagcagcatgatggcacgctgtcgcccaaagacagcttgcaccacagcgctggggagagggatgaaggctcggcggcccagggcagcacccaaggtctgggcaaactcagcattagtggcggaggatggagccactccattcaggaccccgtgcacgtggtttgcttcaagggcatgggtcaggattcctgccaggtccccgatgtgtatccaggggaagaattggtggcctgagccgatggggccccccaggcccaggcgaaagggcagcagcatgtggcccatggcaccacccccacggcccagcacaacccctagagcaggaaagagggaaggtacaggggtcctctcagccttgaaggagcccactgctcctcctggtttctgtttccccttcctcactctccccatgctgacttggctctgtaacagaagtgagcagtatggctgtctttaagacctcacaccttctcatctgcaggttggctagaagtggtggcatcctctcactctgtaattgtaatctcagctctcctaatcccatcacttccccagcccagagaagacattccaaccctgtctgatacccaggcccgtttctcacctgagcgcaccaccacctggcgtgtagaatctccaggaagcctggctgcagcttcccatttggttacgaggttggagaaaaagtcaaagtcccctcctgggctgtcttcatcatactccgcagtcagactgggctggtagtaagctgccggtggaacacaatcatttgccctgggtgtccttggtcctgcctggctctctgtagtggaggctccccttggcctcaccttctctggcccttaggatctccccatttggagacagagccatttggatattttccccttgaacttctccatgacctgaagcgttccttccctggaggaactctggttgcagggctaaacttagaggctgctagagtgtagtggttaagaacaggaacttgggtaccaggcgcctgaattttaatcagctccctcatttattaactctctgacttgatgcaagttacttaacctctctgtatagaattttcacatctttaaaatgggaataatagtacctacctcatagggttgttgtaaggaataaatgataataagcataaaac

SEQ ID NO: 4473 - DNA, 3359 bp, Homo sapiens
aagtgactcaagaaacagtttgcgtgcgatgtggacaagagaggtccccgctgggtgaggaacccgggaaggcccgcccagattcgggccccctgcccttgtcccctgggctgggggcgcgggcaaagcgggggcctggcgggcgctgagaggacctgaagccggcgcgggcggcggaggcgggctgggggcagcagccatgcctacctggggggcccgccccgcgtccccagatcgctttgcggtgtctgcggaggctgagaacaaggttcgggaacagcagccccatgtggagcgcatcttcagcgtgggggtgagcgtccttccgaaggactgtccggacaacccccacatctggctgcagctggagggccccaaggaaaacgccagcagagccaaggagtacctgaagggcctctgcagcccagaactgcaggatgaaatccactacccgcccaaactgcactgcatctttctgggagcccagggcttcttccttgactgcctggcctggagcacgtcagcccatctggtgcccagggcgccaggctcactgatgatcagtggcctgactgaagcctttgtcatggctcagagccgggtagaagagctggcagagcggctgagctgggacttcacgccaggaccatcttccggagcctctcagtgtactggagtgctgagagacttctctgccctgctgcagtccccgggggatgcccatagagaggctctgttgcagttgcccctggctgtccaggaggagctgctgagtctggtgcaggaggcgtctagtgggcaggggccaggagcactggcttcttgggaggggcggagctcagccttgctgggtgctcagtgccaaggagtgagagctccccctagtgacggcagggagtccctggacactggatctatgggacccggagattgcaggggagcaaggggagacacttacgctgtggagaaggagggagggaaacagggtggtcccagggagatggattgggggtggaaggagttgcctggggaagaggcgtgggagagagaagtggccctcaggccacagtcagtgggtggaggggcaagggagtcagcacccctgaaagggaaggccctggggaaggaggagatagctctgggaggaggagggttctgtgtccaccgtgagcctcccggtgcccatggctcctgtcacagggcagctcagtcccgaggagcctccctcctccagcggctccacaatgggaatgcctctcctccgagggtgcccagccctccacctgcaccggaacccccatggcactgtggagaccggggtgactgcggagaccggggagacgtgggggacaggggagacaagcagcagggcatggcacggggtcgggggcctcaatggaaacgaggcgcccgagggggcaacttggtgactggcacacagcgtttcaaggaggccctgcaggatcctttcaccctgtgccttgccaatgtgcctggccagccagacctccgccatattgtcattgacggcagcaacgtggccatggtgcatggcctccagcactacttctccagccggggcattgccattgctgtgcagtacttctgggaccgtggtcaccgtgacataactgtctttgtgcctcagtggcgcttcagtaaggatgccaaagtcagagagagtcacttcctgcaaaagctgtattccctcagcctgctctccctcacaccctcacgagtcatggatggcaagaggatctcctcctatgatgacaggttcatggtgaagctggctgaagagacagatgggataattgtctccaatgaccagttccgggacctggcggaggagtctgagaagtggatggcaatcatcagagaacgcctgctgccctttacctttgtgggaaacctcttcatggtacctgatgacccactggggcgaaacggccccaccctggatgaatttctgaagaagccagccaggacacaggggtcttctaaggctcagcatccttccaggggctttgcagaacatggtaaacagcagcaggggagagaagaggaaaaaggtagtggtggcattcggaagacccgggaaacagagcggctccggcggcagctgctggaggtgttttggggtcaggatcacaaagtggacttcatcctgcagcgggagccatactgccgggacatcaaccaactgtctgaggccctgctcagtcttaacttttgagcctcacctgcttgagtggctgccgccctgtcagctccagccgcctccagctcagccctttctgtgagagtccctctgctgctcactctgatccagaggcaccctgagttggtgctttggatcagggaagccactttgggacaggtccataaagtgaactgatcttaccgagtcaggacctcagccagctctcaagaggttctgctcagccttaacttctcaactttgccttagcacagggtttctgtagggagtgggggctgctagaggggattagttccggagactgagactgttggctccacctccaagctgagctagggtggagggcagggtgggcaggaagtgacaggaagttaagctgttcctctccctggctgctgctctggatggccagagaacaagatgctcccttgctgagctcctgggagcgtggaaggagatgctaggccctggcacagtgttatgtggactgggccacgatagggtggagtgagctagtgaagaaggcagagggagacttggcttctggtctcagctatgcctgttttgtgaccttgattgagttgcttgggctttacttctgcctacaaatcaggggtaaaaatacctgttgggaggagaaatgagaacatagaggaaagcctcttggaggaaaggtgcttggaccaagtctcaggtgtgtctgcctgtggctgcacaggctctctaaccgaaacctcactttcagagagatgtgggtcctttgtctccaggatccacaccctagattttaacactgcattctcactataacgtgccctataatggctgcatcccttttgagcaacctccaaaatctacatttacacagtaggtaaattagggatgactgcattatcaaaatactctcagggttcctataaatggcagctctcctgttgtattcaggtgttgtttacagactaacaaatgtgttggcaaatccctggttagatgcacttcctggtgttgagatgaacacgtcgatttttcaccaatcgatgaagccatgctctgcaatgacaatattaatgtgatccgaccctaacattttctctatggaagacgtatgttgcataaagcaaggcacacttctgcttta

SEQ ID NO: 4474 - DNA, 911 bp, Homo sapiens
cccggcccggcccctgggccctgggcggtgctcctggcccgacggagaggggcagcggacggctgggggaggggtgggagtggcttgaaccttggaaatggcagaccagggcccccagaggacagcctagttcaatcccctgctgaggattcgtccttaagaagcttcagagtgccccaggagactccttctggcctccaggccgagctggagcccccccacccttcttgctccggactgtggtcatccttttccaaagcccagacgcccactctcgatagacagccttgtttaccgggacttcctctccggagaggcctgcgtgacatacaccctccctacctccagtggactcagatgcttgtcacctcctggggctgtttaccagagccttaactaggtgcgacctgttgatagctggtgtagtcccaggaaccaggatttggatggagggtacaatgaggctctgagctgccttctccccttccagggctgggggcagcagccatgcctacctggggggcccgccccgcgtccccagatcgctttgcggtgtctgcggaggctgagaacaaggttcgggaacagcagccccatgtggagcgcatcttcagcgtgggggtgagcgtccttccgaaggactgtccggacaacccccacatctggctgcagctggagggccccaaggaaaacgccagcagagccaaggagtacctgaagggcctctgcagcccagaactgcaggatgaaatccactacccgcccaaactgcactgcatctttctgggagcccagggcttcttccttgactgcctggcctggagcacgtcagcccatctggtgcccagggcgccaggctcactgatgatcagtggcctgactgaagcctttgtcatggctcagagccgggt

SEQ ID NO: 4475 - DNA, 2443 bp, Homo sapiens
aggaagtgactcaagaaacagtttgcgtgcgatgtggacaagagaggtccccgctggggctgggggcagcagccatgcctacctggggggcccgccccgcgtccccagatcgctttgcggtgtctgcggaggctgagaacaaggttcgggaacagcagccccatgtggagcgcatcttcagcgtgggggtgagcgtccttccgaaggactgtccggacaacccccacatctggctgcagctggagggccccaaggaaaacgccagcagagccaaggagtacctgaagggcctctgcagcccagaactgcaggatgaaatccactacccgcccaaactgcactgcatctttctgggagcccagggcttcttccttgactgcctggcctggagcacgtcagcccatctggtgcccagggcgccaggctcactgatgatcagtggcctgactgaagcctttgtcatggctcagagccgggtagaagagctggcagagcggctgagctgggacttcacgccaggaccatcttccggagcctctcagtgtactggagtgctgagagacttctctgccctgctgcagtccccgggggatgcccatagagaggctctgttgcagttgcccctggctgtccaggaggagctgctgagtctggtgcaggaggcgtctagtgggcaggggccaggagcactggcttcttgggaggggcggagctcagccttgctgggtgctcagtgccaaggagtgagagctccccctagtgacggcagggagtccctggacactggatctatgggacccggagattgcaggggagcaaggggagacacttacgctgtggagaaggagggagggaaacagggtggtcccagggagatggattgggggtggaaggagttgcctggggaagaggcgtgggagagagaagtggccctcaggccacagtcagtgggtggaggggcaagggagtcagcacccctgaaagggaaggccctggggaaggaggagatagctctgggaggaggagggttctgtgtccaccgtgagcctcccggtgcccatggctcctgtcacagggcagctcagtcccgaggagcctccctcctccagcggctccacaatgggaatgcctctcctccgagggtgcccagccctccacctgcaccggaacccccatggcactgtggagaccggggtgactgcggagaccggggagacgtgggggacaggggagacaagcagcagggcatggcacggggtcgggggcctcaatggaaacgaggcgcccgagggggcaacttggtgactggcacacagcgtttcaaggaggccctgcaggatcctttcaccctgtgccttgccaatgtgcctggccagccagacctccgccatattgtcattgacggcagcaacgtggccatggtgcatggcctccagcactacttctccagccggggcattgccattgctgtgcagtacttctgggaccgtggtcaccgtgacataactgtctttgtgcctcagtggcgcttcagtaaggatgccaaagtcagagagagtcacttcctgcaaaagctgtattccctcagcctgctctccctcacaccctcacgagtcatggatggcaagaggatctcctcctatgatgacaggttcatggtgaagctggctgaagagacagatgggataattgtctccaatgaccagttccgggacctggcggaggagtctgagaagtggatggcaatcatcagagaacgcctgctgccctttacctttgtgggaaacctcttcatggtacctgatgacccactggggcgaaacggccccaccctggatgaatttctgaagaagccagccaggacacaggggtcttctaaggctcagcatccttccaggggctttgcagaacatggtaaacagcagcaggggagagaagaggaaaaaggtagtggtggcattcggaagacccgggaaacagagcggctccggcggcagctgctggaggtgttttggggtcaggatcacaaagtggacttcatcctgcagcgggagccatactgccgggacatcaaccaactgtctgaggccctgctcagtcttaacttttgagcctcacctgcttgagtggctgccgccctgtcagctccagccgcctccagctcagccctttctgtgagagtccctctgctgctcactctgatccagaggcaccctgagttggtgctttggatcagggaagccactttgggacaggtccataaagtgaactgatcttaccgagtcaggacctcagccagctctcaagaggttctgctcagccttaacttctcaactttgccttagcacagggtttctgtagggagtgggggctgctagaggggattagttccggagactgagactgttggctccacctccaagctgagctagggtggagggca

SEQ ID NO: 4476 - DNA, 635 bp, Homo sapiens
gtttgttagactttcccctattctgaatcaggtgggagcacagcatggccgtgggaacgagtgctctcagcaaggagccgtggtggaccctgcccgaaaactttcattctccaatggtgttccacatggaagaggaccaggaggagctcatcttcggacttgatgacacgtaccttcgctgcattgagctgcacagccacacccttattcagctggagaggtgtttcacagctacaggccagacacgtgtgactgtagtcggaccaccaatggcaaagcagtggctgctgctcatgttccattgcgtggggagccaggactccaagtgtcacgctcgaggtctgaagatgctagagcgtgtccgaagccagcccctgaccaatgatgacctggtcacctccgttagcctgccaccgtacaccggagactgatctcccctgggaagaggggatgagaggagaagtcttggcttcgcttttggtgagaaagacatgaaaaacactgaagaaagtttgaatttgtggccagacctgcccctctcaggccttctaggcatgtgtctgagggaagtctcctgagtgttagaagtgttattggcaaagcaatccaataaaataagctacctatgatgcaaa

SEQ ID NO: 4477 - DNA, 1742 bp, Homo sapiens
tctagtctgcagttttcagaaaccctcattcctcccttgactgattcaccacttgaacctcatatgacgtagaagaagcctacctatgtccccttcacatgttgtggtcaatgtgtcaactgcacgatccgggcccctcaccacatcctctgcaccggtcagtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 4478 - DNA, 1586 bp, Homo sapiens
gctgagctgagctggggcgcggccgcctgtctgcacagacagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagagaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactagcttacttcctagtctacctgaggctgcaatcacactgaggaactcacaattccaaacatacaagaggctccctcttaacacagcacttagacacgtgctgttccacctcccttcagactatctttcagccttctgccagcagtaaaacttataaattttttaaataatttcaatgtagttttcccgccttcaaataaacatgtctgccctcatg

SEQ ID NO: 4479 - DNA, 1586 bp, Homo sapiens
gctgaactgagctggggcgcagccgcctgtctgcaccggcagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagagaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactagcttacttcctagtctacctgaggctgcaatcacactgaggaactcacaattccaaacatacaagaggctccctcttaacacagcacttagacacgtgctgttccacctcccttcagactatctttcagccttctgccagcagtaaaacttataaattttttaaataatttcaatgtagttttcccgccttcaaataaacatgtctgccctcatg

SEQ ID NO: 4480 - DNA, 1601 bp, Homo sapiens
aggggtgcggccgcctgtctgcaccggcagcaccatgtcgctcatggtcatcagcatggcgtgtgttgcgttcttcttgctgcagggggcctggccacatgagggattccgcagaaaaccttccctcctggcccacccaggtcccctggtgaaatcagaagagacagtcatcctgcaatgttggtcagatgtcatgtttgagcacttccttctgcacagagaggggacgtttaaccacactttgcgcctcattggagagcacattgatggggtctccaagggcaacttctccatcggtcgcatgacacaagacctggcagggacctacagatgctacggttctgttactcactccccctatcagttgtcagcgcccagtgaccctctggacatcgtgatcacaggtctatatgagaaaccttctctctcagcccagccgggccccacggttctggcaggagagagcgtgaccttgtcctgcagctcccggagctcctatgacatgtaccatctatccagggaaggggaggcccatgaacgtaggctccctgcagggcccaaggtcaacagaacattccaggccgactttcctctggaccctgccacccacggagggacctacagatgcttcggctctttccgtgactctccatacgagtggtcaaagtcaagtgacccactgcttgtttctgtcacaggaaactcttcaaatagttggccttcacccactgaaccaagctccgaaaccggtaaccccagacacctacacgttctgattgggacctcagtggtcaaactccctttcaccatcctcctcttctttctccttcatcgctggtgctccaacaaaaaaaatgcatctgtaatggaccaagggcctgcggggaacagaacagtgaacagggaggattctgatgaacaggaccatcaggaggtgtcatacgcataattggatcactgtgttttcacacagagaaaaatcactcccccttctcagaggcccaagacacccccaacagataccagcatgtacatagaacttccaaatgctgagtccagatccaaagctgtcttctgtccacgagcaccacagtcaggccttgaggggatcttctagggagacaacagccctgtctcaaaaccgggttgccagctcccatgtaccagcagctggaatctgaaggcatcagtcttcatcttaggggatcgctcttcctcaaaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgaggaactcacaattccaaacatacaagaggctccctcttaacacagcacttagacacgtgctgttccaccttctctcatgcagttccacctcccctcagactatctttcagccttctgtcagcagtaaaacttataaattgtttttagtaatttcaatgtagttttccctccttcaaataaacatgtctgccctcatggtttcg

SEQ ID NO: 4481 - DNA, 687 bp, Homo sapiens
atgtcgctcactgtcgtcagcatggcgtgcgttgggttcttcttgctgcagggggcctggccactcatgggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggcct

SEQ ID NO: 4482 - DNA, 999 bp, Homo sapiens
atgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcgacacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatct

SEQ ID NO: 4483 - DNA, 6793 bp, Homo sapiens
ggtgcgcggcgcggccgcaggatgcaggccatggacccggccgcggcggatctttacgaggaggacggcaaagacctggacttctacgacttcgagccgctgcccaccctccccgaggacgaggagaacgtgtctctggctgacatcctctccctgcgggaccgcggcctcagcgagcaggaagcctgggccgtgtgcctggagtgcagcctgtccatgcggagcgtggcccacgccgccatcttccagagcctgtgcatcacgcccgacaccctggccttcaacaccagcgggaacgtgtgtttcatggagcagctcagcgacgaccctgagggtgccttcgttccccccgagttcgacgtgaccgggaacacctttgaggcgcacatctactctctgggggccacgctgaaggccgccctcgagtacgtggcagagcccacactggaacccaggctgagccaagacctcgaggcgctgctgagccggatgcaggcggaggaccccggggaccggccggaccttgagagcatcatcgcgctgtgtgaagagaagctgcagctcacatcctcctgtcgcgtgtgccggagcctctctgctgtggggaggagggtcctctccatcgagtccttcggagcgctgcaggatgtcagcgagagcagctggcgggagagacctgccccaggaaacgctgggcccaggaggccgcccggggaccccagcactgacccggaggttctgccgacccccgaaggcccggagtctgagacgagccggggccccagagcctccccaaccaaggctctgctgtccaccccggtgagaaatggcgagagccacagccgggaggggctggccggcctcgtcctggatgccgagcgcaccctcggggagctggacagagacgccctcaggagaagccgcctgcggaaggtgcagacgttccctaggctgctgtccgacagccccgaggccaccctctgcctgccgctgacccgcgggaaaagccagctgcccatatcggaattattctctccggaccccaggaaggcctttctggacaggaaaaatggcctttctagcttccaggctcagcccaaatgcaggctgtggccggagcaggagccggaacaccagctgggacgggttccctgtgcaggccgcagcacggacaggggccctggggtgcccggcagtccaggacagcccgagacttcacaccccagccaggggccagcagaggcccctgcagaccctcgagatgctagcggtgaagcccagactcccagggacgatgagagaattccagaaggagctaggcagctggaaagtgcagccgcggagcagtgggtgtccctgcaggacctcctgtcccagctgggccggcccttccgggagtacgagctgtgggccctgtgcctggcctgcctccgcgcactgcagacacgccctgagcacccagcctacctgtgtctggactccgtgctggttgctgaggacggggctgtgctcttccagccaccccctgccaacggttcctatgactcgttctttctggctcccgagctggcagaggagaggctggtaactgaaaaggcctctgtgtactgtgtggccgccgttctgtggaccgcagccaagttcagcgtcccccgcaaccacaagctggccctgccacgcaggctcaagaccctcctcctggacatggccaggcgcagtgccccggagcggccgtccgcggctgaggccatcaaggtgtgcggcagctacctcctccagcgaggcatggacagccggaaaatccttgcccacctcagagcttccatctgccaggtgtaccaggaggaagagaccatcagcctccaaaacgccttctcagtggttgaactgaagcccagtgtggcaccagccccagagcccagcccaggcttcctgccggtgaacagcgacaccgggcttgtggctgtgccagggcccgtgcccggccagcacccctgcggtgaagaagccacccagctgcctgcagcgttcacctccgaggccacgcacttcaagcccattgtcctcgcgcagaacgcaagtgtggccagggaccagcctgccttggcccaggaggagtccgaggagaggggcggccagagggagggagaaggtgaggagaagctctccctggaggcccacgctgggtcccccagcctgaagacgcctgacgggccggtgcctggtccggggccacagggagcagccccagagcctcttggggcgtcagtgcagcgtgactcagcccagggccgcccctgccctccaccccaggccccagcaaaccagccagagggggcctcatcggcagctcccggctctccagtccccgccccgcccacgaaggcatctgcgctgcccgtagagcaagggccggctgagccgatcccacctggagttgcttccgggggcctcaggcccgacgccctggggcccaccacggcccaccacggcccacgccacccgcccaagcccccacgaagcaaggccaccgagcgcccgggccaggagccagagggccccggggccacccctgccggggaacgtgatgaccagagtccagacagtgtcccagagaggccgcggcccgcagaccggaggctctgtctgccctgcgtggatgcctcgccactcccagggaggacggcctgcccgtcgctgcaggaggccacgcgcctcatccaggaggaatttgccttcgatggctacctggacaatgggctggaggctctgatcatgggggagtacatcttcgccttgaaagatctcacctttgccactttctgtggcgccatttccgagaagttctgtgacctgtactgggatgagaagttgctgcagaacctctttaaggtggtcaacgggcaggcgtcaccctccccaagcacggccgaggaggctgggtcacagctcgagggcagccaaagcccccgctccccgtccagcaagaggccgtcgctgcaccgcctgggaaaagagaagccagccatggccaggaccagcagcagggccccctgctcacccacctcggtgtcggatgtggactcggacgcactgtcacggggaaacttcgaggtggggtttcggcctcagaggtccgtaaaagccgagagagcgcagcagcctgaggctggcgaggacagacggccagctggcggggcctcagacgtggaggcagtgacccgactggccaggtccaaaggggtcggcccagccttgtcccccggcccagccggattccagagctgcagccccggctggtgcagcgccttctacgaggccgactgcttcggggccgacgtccacaactacgtgaaggacctggggcggcagcaggcggacggggccctgcccgacgcccagagcccggagctggaacagcagctcatgatggagaaaagaaactaccgcaagaccctgaagttctaccagaaactcttacagaaggaaaagaggaacaaaggttccgacgtcaagaccatgctgtccaagctgaaagggcagctagaagaaatgaaatccagggtgcaattcctcagcttggtcaagaagtatctgcaggtcatgtacgcggaacgctggggcctggagccctgcaccctcccagtgatcgtgaacatcgcggccgcaccctgcgacacgctggacttcagccccctggacgagtcctcctcgctcatcttctacaacgtcaacaagcacccgggcggccggcagaaggcccgcatcctgcaggccggcacgccgctggggctcatggcctacctgtactccagtgatgccttcctggagggttatgtgcagcaattcctctacaccttccgctacttctgcacaccccacgacttcctgcacttcctcctcgaccgcatcaacagcacgctgaccagggcccaccaggaccccacctcgaccttcaccaagatctacaggcggagcctctgcgtcctgcaggcctgggtggaggactgctacgctgtggacttccctcggaacagcgggctgctggggaagctagaggacttcatctcctccaagatcctacccctggacggctctgccaagcacctgctgggcctcctggaggtgggcatggaccggcgggccgagggcaaccctcgcggcacagacctggagaaccccagggaggccgaggaggatgccagacccttcaacgccctctgtaagaggctctcagaggacggcatctccaggaagagcttcccctggaggctgccccgaggcaacgggctggtgctgccgccacacaaggagcgcccctacaccattgctgccgccctgcccaagccctgcttcctcgaggacttctacggcccctgcgccaagaccagtgagaaggggccctacttcctgacggagtacagcactcaccagctcttcagccagctcacgctgctacagcaggagttgtttcaaaagtgccacccggtccacttcctgaactcacgggccctgggcgtcatggacaagagcactgccatccccaaagccagctcttctgagtctctttcggccaaaacctgcagcttatttctgcccaattacgttcaggacaagtatctgttacagcttctaagaaacgcagatgacgtcagcacctgggtggctgcagagattgtgaccagccacacctccaagctgcaggtgaacttgctgtccaaatttttgctgattgcaaaatcttgctatgagcagagaaacttcgcgacagccatgcagatcctgagcgggctggagcacctggccgtgaggcagtcccctgcctggagaattctgcctgcaaagatagcagaggtcatggaggagctgaaagccgtggaggtcttcctgaagagcgacagcctgtgtctgatggaagggcggcgcttccgggcgcagcccaccctgccctcggcccacctcctggccatgcacatccagcagctggagacaggcggcttcaccatgaccaacggggcccacaggtggagcaagctcaggaacatcgcaaaggtggtgagccaggtgcacgcgttccaggagaacccttacaccttcagccccgaccccaagctccagtcgtacctcaagcagaggattgcccgcttcagcggtgccgacatttccacactcgccgcagatagcagggccaacttccaccaggtctccagcgagaagcactcacggaagattcaggacaagctacggaggatgaaggctacattccagtagccgagctcgggcctggtgtggaattccagatccgaatccgactgtggggggcgggctgggaggtgggagccgcgtctcaggcccggccgttatcaaggcccctccgcccccgaaccctggggagctggaccaggaggtggaggctcaggggaccccatggggacaggcagagctggtctcctcccagcagacggagccaggacgggcacaagagtcttggaggtttgcgtgtttctgctagaattaaaaagttaaatttaaaaatgaaaatgaaagacagcttcccaggagttttgtgcctgtctgcgcctctcacacacagataagtggctcttacccagctctcagtgactcccccacaaaacagcaacagcctccaccgccaactcaacaaacttcagagtagctcctccctgagcaggtttctgagccagcctgggttggctgagcaacgaagggccaaagctgacctctgagtggccaactgcagctcccagggactccgagacctccggtccgagaccctgcctgggttcaccccccacaacccagacccagaaccgctctccccttccctgcccagtgcccctcctccccagcccagacccccaggtgcccaaggcctgctgctggagcaggcaccttgggctgggcctgctcccccagggcccagggccccccagcttagaacagcccttggtgaggtggtcatgcccgggcaaaggccctgcttcctggaaaggacactcagagcagctccaagacagaggctctgtggcgggggtccctgagagtgcccccacccatctcatgccccagggaccgccactgcccaccgcctccagcagccatgcatgtgcgcccgcagccctgcctccacagctcgccacacactcacgcttcgccagagacaggaagtgcgctgcctccacggccccttgcccttgctcaggttcttggaccccaggcagctggtgtggagccccttggccagggccatgggagtcccgcgcagtcagctccacattggcctctgcagctgggtgaccagagccccgggcacggccccagctccgtggggctctcacggtgccaatcacaagacccagggttgtgcttttgagttttagaattagtcattctttagagcagccagctagtggcatttctaggaaaactgtgacctgtgacaaatcgctgcatttttaatgtcaagatgtgttttcccacataaattcaccggagacatccgggccccgcttcgatgtaacatgagaggaagtcggcgtcctggccacgaaatgcagttcacttttttttaggcttttatatggattatgttttgctgacccacgcccgcattttcagattttgtatctaacagacagtgctcagtgcaaatcaacattccagcggtcaggactgaccccggggcagcactgggctcaggcttcagcgcgactgtccgcatggctccctcccgtcctggcaccaatttctgaataaagtcctttctaccagc

SEQ ID NO: 4484 - DNA, 6779 bp, Homo sapiens
gatgcaggccatggacccggccgcggcggatctttacgaggaggacggcaaagacctggacttctacgacttcgagccgctgcccaccctccccgaggacgaggagaacgtgtctctggctgacatcctctccctgcgggaccgcggcctcagcgagcaggaagcctgggccgtgtgcctggagtgcagcctgtccatgcggagcgtggcccacgccgccatcttccagagcctgtgcatcacgcccgacaccctggccttcaacaccagcgggaacgtgtgtttcatggagcagctcagcgacgaccctgagggtgccttcgttccccccgagttcgacgtgaccgggaacacctttgaggcgcacatctactctctgggggccacgctgaaggccgccctcgagtacgtggcagagcccacactggaacccaggctgagccaagacctcgaggcgctgctgagccggatgcaggcggaggaccccggggaccggccggaccttgagagcatcatcgcgctgtgtgaagagaagctgcagctcacatcctcctgtcgcgtgtgccggagcctctctgctgtggggaggagggtcctctccatcgagtccttcggagcgctgcaggatgtcagcgagagcagctggcgggagagacctgccccaggaaacgctgggcccaggaggccgcccggggaccccagcactgacccggaggttctgccgacccccgaaggcccggagtctgagacgagccggggccccagagcctccccaaccaaggctctgctgtccaccccggtgagaaatggcgagagccacagccgggaggggctggccggcctcgtcctggatgccgagcgcaccctcggggagctggacagagacgccctcaggagaagccgcctgcggaaggtgcagacgttccctaggctgctgtccgacagccccgaggccaccctctgcctgccgctgacccgcgggaaaagccagctgcccatatcggaattattctctccggaccccaggaaggcctttctggacaggaaaaatggcctttctagcttccaggctcagcccaaatgcaggctgtggccggagcaggagccggaacaccagctgggacgggttccctgtgcaggccgcagcacggacaggggccctggggtgcccggcagtccaggacagcccgagacttcacaccccagccaggggccagcagaggcccctgcagaccctcgagatgctagcggtgaagcccagactcccagggacgatgagagaattccagaaggagctaggcagctggaaagtgcagccgcggagcagtgggtgtccctgcaggacctcctgtcccagctgggccggcccttccgggagtacgagctgtgggccctgtgcctggcctgcctccgcgcactgcagacacgccctgagcacccagcctacctgtgtctggactccgtgctggttgctgaggacggggctgtgctcttccagccaccccctgccaacggttcctatgactcgttctttctggctcccgagctggcagaggagaggctggtaactgaaaaggcctctgtgtactgtgtggccgccgttctgtggaccgcagccaagttcagcgtcccccgcaaccacaagctggccctgccacgcaggctcaagaccctcctcctggacatggccaggcgcagtgccccggagcggccgtccgcggctgaggccatcaaggtgtgcggcagctacctcctccagcgaggcatggacagccggaaaatccttgcccacctcagagcttccatctgccaggtgtaccaggaggaagagaccatcagcctccaaaacgccttctcagtggttgaactgaagcccagtgtggcaccagccccagagcccagcccaggcttcctgccggtgaacagcgacaccgggcttgtggctgtgccagggcccgtgcccggccagcacccctgcggtgaagaagccacccagctgcctgcagcgttcacctccgaggccacgcacttcaagcccattgtcctcgcgcagaacgcaagtgtggccagggaccagcctgccttggcccaggaggagtccgaggagaggggcggccagagggagggagaaggtgaggagaagctctccctggaggcccacgctgggtcccccagcctgaagacgcctgacgggccggtgcctggtccggggccacagggagcagccccagagcctcttggggcgtcagtgcagcgtgactcagcccagggccgcccctgccctccaccccaggccccagcaaaccagccagagggggcctcatcggcagctcccggctctccagtccccgccccgcccacgaaggcatctgcgctgcccgtagagcaagggccggctgagccgatcccacctggagttgcttccgggggcctcaggcccgacgccctggggcccaccacggcccaccacggcccacgccacccgcccaagcccccacgaagcaaggccaccgagcgcccgggccaggagccagagggccccggggccacccctgccggggaacgtgatgaccagagtccagacagtgtcccagagaggccgcggcccgcagaccggaggctctgtctgccctgcgtggatgcctcgccactcccagggaggacggcctgcccgtcgctgcaggaggccacgcgcctcatccaggaggaatttgccttcgatggctacctggacaatgggctggaggctctgatcatggaaccaggggagtacatcttcgccttgaaagatctcacctttgccactttctgtggcgccatttccgagaagttctgtgacctgtactgggatgagaagttgctgcagaacctctttaaggtggtcaacgggcaggcgtcaccctccccaagcacggccgaggaggctgggtcacagctcgagggcagccaaagcccccgctccccgtccagcaagaggccgtcgctgcaccgcctgggaaaagagaagccagccatggccaggaccagcagcagggccccctgctcacccacctcggtgtcggatgtggactcggacgcactgtcacggggaaacttcgaggtggggtttcggcctcagaggtccgtaaaagccgagagagcgcagcagcctgaggctggcgaggacagacggccagctggcggggcctcagacgtggaggcagtgacccgactggccaggtccaaaggggtcggcccagccttgtcccccggcccagccggattccagagctgcagccccggctggtgcagcgccttctacgaggccgactgcttcggggccgacgtccacaactacgtgaaggacctggggcggcagcaggcggacggggccctgcccgacgcccagagcccggagctggaacagcagctcatgatggagaaaagaaactaccgcaagaccctgaagttctaccagaaactcttacagaaggaaaagaggaacaaaggttccgacgtcaagaccatgctgtccaagctgaaagggcagctagaagaaatgaaatccagggtgcaattcctcagcttggtcaagaagtatctgcaggtcatgtacgcggaacgctggggcctggagccctgcaccctcccagtgatcgtgaacatcgcggccgcaccctgcgacacgctggacttcagccccctggacgagtcctcctcgctcatcttctacaacgtcaacaagcacccgggcggccggcagaaggcccgcatcctgcaggccggcacgccgctggggctcatggcctacctgtactccagtgatgccttcctggagggttatgtgcagcaattcctctacaccttccgctacttctgcacaccccacgacttcctgcacttcctcctcgaccgcatcaacagcacgctgaccagggcccaccaggaccccacctcgaccttcaccaagatctacaggcggagcctctgcgtcctgcaggcctgggtggaggactgctacgctgtggacttccctcggaacagcgggctgctggggaagctagaggacttcatctcctccaagatcctacccctggacggctctgccaagcacctgctgggcctcctggaggtgggcatggaccggcgggccgagggcaaccctcgcggcacagacctggagaaccccagggaggccgaggaggatgccagacccttcaacgccctctgtaagaggctctcagaggacggcatctccaggaagagcttcccctggaggctgccccgaggcaacgggctggtgctgccgccacacaaggagcgcccctacaccattgctgccgccctgcccaagccctgcttcctcgaggacttctacggcccctgcgccaagaccagtgagaaggggccctacttcctgacggagtacagcactcaccagctcttcagccagctcacgctgctacagcaggagttgtttcaaaagtgccacccggtccacttcctgaactcacgggccctgggcgtcatggacaagagcactgccatccccaaagccagctcttctgagtctctttcggccaaaacctgcagcttatttctgcccaattacgttcaggacaagtatctgttacagcttctaagaaacgcagatgacgtcagcacctgggtggctgcagagattgtgaccagccacacctccaagctgcaggtgaacttgctgtccaaatttttgctgattgcaaaatcttgctatgagcagagaaacttcgcgacagccatgcagatcctgagcgggctggagcacctggccgtgaggcagtcccctgcctggagaattctgcctgcaaagatagcagaggtcatggaggagctgaaagccgtggaggtcttcctgaagagcgacagcctgtgtctgatggaagggcggcgcttccgggcgcagcccaccctgccctcggcccacctcctggccatgcacatccagcagctggagacaggcggcttcaccatgaccaacggggcccacaggtggagcaagctcaggaacatcgcaaaggtggtgagccaggtgcacgcgttccaggagaacccttacaccttcagccccgaccccaagctccagtcgtacctcaagcagaggattgcccgcttcagcggtgccgacatttccacactcgccgcagatagcagggccaacttccaccaggtctccagcgagaagcactcacggaagattcaggacaagctacggaggatgaaggctacattccagtagccgagctcgggcctggtgtggaattccagatccgaatccgactgtggggggcgggctgggaggtgggagccgcgtctcaggcccggccgttatcaaggcccctccgcccccgaaccctggggagctggaccaggaggtggaggctcaggggaccccatggggacaggcagagctggtctcctcccagcagacggagccaggacgggcacaagagtcttggaggtttgcgtgtttctgctagaattaaaaagttaaatttaaaaatgaaaatgaaagacagcttcccaggagttttgtgcctgtctgcgcctctcacacacagataagtggctcttacccagctctcagtgactcccccacaaaacagcaacagcctccaccgccaactcaacaaacttcagagtagctcctccctgagcaggtttctgagccagcctgggttggctgagcaacgaagggccaaagctgacctctgagtggccaactgcagctcccagggactccgagacctccggtccgagaccctgcctgggttcaccccccacaacccagacccagaaccgctctccccttccctgcccagtgcccctcctccccagcccagacccccaggtgcccaaggcctgctgctggagcaggcaccttgggctgggcctgctcccccagggcccagggccccccagcttagaacagcccttggtgaggtggtcatgcccgggcaaaggccctgcttcctggaaaggacactcagagcagctccaagacagaggctctgtggcgggggtccctgagagtgcccccacccatctcatgccccagggaccgccactgcccaccgcctccagcagccatgcatgtgcgcccgcagccctgcctccacagctcgccacacactcacgcttcgccagagacaggaagtgcgctgcctccacggccccttgcccttgctcaggttcttggaccccaggcagctggtgtggagccccttggccagggccatgggagtcccgcgcagtcagctccacattggcctctgcagctgggtgaccagagccccgggcacggccccagctccgtggggctctcacggtgccaatcacaagacccagggttgtgcttttgagttttagaattagtcattctttagagcagccagctagtggcatttctaggaaaactgtgacctgtgacaaatcgctgcatttttaatgtcaagatgtgttttcccacataaattcaccggagacatccgggccccgcttcgatgtaacatgagaggaagtcggcgtcctggccacgaaatgcagttcacttttttttaggcttttatatggattatgttttgctgacccacgcccgcattttcagattttgtatctaacagacagtgctcagtgcaaatcaacattccagcggtcaggactgaccccggggcagcactgggctcaggcttcagcgcgactgtccgcatggctccctcccgtcctggcaccaatttctgaataaagtcctttctaccagc

SEQ ID NO: 4485 - DNA, 556 bp, Homo sapiens
ccgacctctcgaagtcccgtgagaacctgtctgcagtcatgttgtataaccccggtcttttccctataaaaggacccatctgtctaagacttgaatttgagaggcaacagcgtgaagaacttgaaaaattagaaagtaaaaggaaactcatagaagaaatggaggaaaagcagaaatcagacaaggctgaactggagcggatgcagcaggaggtggagacccagcgcaaggagacagaaatcgtgcagctccagattcgcaagcaggaggagagcctcaaacgccgcagcttccacatcgagaacaagctaaaggatttacttgcggagaaggaaaaatttgaagaggagaggctgagggaacagcaggaaatcgagctgcagaagaagagacaagaagaagagacctttctccgcgtccaagaagaactccaacgactcaaagaactcaacaacaacgagaaggctgagaagtttcagatatttcaagaactggaccagctccaaaaggaaaaagatgaacagtatgccaagcttgaactggaaaaaaagagact

SEQ ID NO: 4486 - DNA, 6931 bp, Homo sapiens
gatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttg

SEQ ID NO: 4487 - DNA, 3128 bp, Homo sapiens
agagatgagactgaggtttctcaccggttcctaagcccagtcagagctgtcaggtaattacagggtaaccgacagcccagagccaggcgggcgtggagccggagcgtcagtctcgccgggcgctccttccctgcgcccctgtctggaaaagaggagacctggaagccgggttaaactttaacacgggtcgggcacagagcagggggaatcagctgcattccctctggccaagctggtcagagctctgcgggctgccgtccttggccaagagcgtgtgggctagctccggtctctgcccaggctggtaaacaagggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagct

SEQ ID NO: 4488 - DNA, 4925 bp, Homo sapiens
gtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggcctcccagaagttcctgccgaatcgtcttcgtcacccccggggtccgaggtagcctcccttacacagcctgagaagagcacaggccgagtgcccacccaggagcccacccacagggagcccaccaggcaagcagcctcccaagagtccgaggaggccgggggcaccggcgggcccccggcaggcgtgcgatctatcatgaaacggaaagaggaggttgcagaccccacggcccaccggaggagcctccagttcgtgggggtcaacggcgggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggatggagctaagccctgacctcatctcagcctgcttggccctggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcgtttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccgacggccacaggactccagctccaagtgggttttcttggctcccctgttcaaagtggccacagcgcagaccgaagcaaaattcttgtatacattggcgccagggctgatgctggggtgtgggttttatgaagaacattgagaacaatcagctggtaattatggatggaggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatcccccacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaagaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttcaagagacagggctttgctgaaaaccaaacatgggccagctgggctttttaacaacctagagactttccggagctgcctggaacagagcctgcgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatggatggatggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgatg

SEQ ID NO: 4489 - DNA, 5231 bp, Homo sapiens
gagggccgggcgcccaggctgcggcgcgcgcgaagacgctcgggcggcgggacccagggaaggcagcggccggagcgcgcaaggtgttgaaagacagagaagcgaagacagagacgtggaaagacagggagagagacacggagagagacgcagaaggacagagacgtggagagagacgcagagagacagagacgtggagagacacagagagacgtggagagacacagagagacttggagagagacaaagcaagacaggacgggagaacaaggacaagctcaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggcctcccagaagttcctgccgaatcgtcttcgtcacccccggggtccgaggtagcctcccttacacagcctgagaagagcacaggccgagtgcccacccaggagcccacccacagggagcccaccaggcaagcagcctcccaagagtccgaggaggccgggggcaccgcacctccgctgtcctcccctccaggcgggcccccggcaggcgtgcgatctatcatgaaacggaaagaggaggttgcagaccccacggcccaccggaggagcctccagttcgtgggggtcaacggcgggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggatggagctaagccctgacctcatctcagcctgcttggccctggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcgtttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccgacggccacaggactccagctccaagtgggttttcttggctcccctgttcaaagtggccacagcgcagaccgaagcaaaattcttgtatacattggcgccagggctgatgctggggtgtgggttttatgaagaacattgagaacaatcagctggtaattatggatggaggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatcccccacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaagaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttcaagagacagggctttgctgaaaaccaaacatgggccagctgggctttttaacaacctagagactttccggagctgcctggaacagagcctgcgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatggatggatggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgatg

SEQ ID NO: 4490 - DNA, 5162 bp, Homo sapiens
gcgggacccagggaaggcagcggccggagcgcgcaaggtgttgaaagacagagaagcgaagacagagacgtggaaagacagggagagagacacggagagagacgcagaaggacagagacgtggagagagacgcagagagacagagacgtggagagacacagagagacgtggagagacacagagagacttggagagagacaaagcaagacaggacgggagaacaaggacaagctcaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggcctcccagaagttcctgccgaatcgtcttcgtcacccccggggtccgaggtagcctcccttacacagcctgagaagagcacaggccgagtgcccacccaggagcccacccacagggagcccaccaggcaagcagcctcccaagagtccgaggaggccgggggcaccggcgggcccccggcaggcgtgcgatctatcatgaaacggaaagaggaggttgcagaccccacggcccaccggaggagcctccagttcgtgggggtcaacggcgggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggatggagctaagccctgacctcatctcagcctgcttggccctggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcgtttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccgacggccacaggactccagctccaagtgggttttcttggctcccctgttcaaagtggccacagcgcagaccgaagcaaaattcttgtatacattggcgccagggctgatgctggggtgtgggttttatgaagaacattgagaacaatcagctggtaattatggatggaggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatcccccacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaagaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttcaagagacagggctttgctgaaaaccaaacatgggccagctgggctttttaacaacctagagactttccggagctgcctggaacagagcctgcgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatggatggatggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgatga

SEQ ID NO: 4491 - DNA, 2786 bp, Homo sapiens
gggctcgggtgcgggcgcggctggggctgcggcttcagggtgcctctgacagctgctgcaggaaacatggccaagtttgccctgaatcagaacctgcccgacctgggcggcccccgcctgtgcccggtccccgccgccgggggcgcacgcagcccgagctcgccctactcggtggagacgccctacggcttccacctggacctggacttcctcaagtacatagaggagctggagcgtggccccgctgcccgccgcgccccgggacccccgacctcgcgccgtccccgcgcgccccggcccggcctcgcgggcgcacgtagcccaggcgcctggacatccagcgagtccctggccagtgacgacggtggagcaccgggcatactctcccagggcgcgccctcggggctcctgatgcagccgctgtcgccgcgcgcgcccgtgcgcaacccgcgcgtcgagcacacgctccgggagaccagccggcggctggagctggcgcagacacacgagcgcgcgcccagccccggccgcggggtcccgcgcagcccacgcgggtccggccgcagcagccccgcccctaaccttgcccctgcttcgcccggccctgcccaactgcagctggtgcgcgagcagatggccgcggcgctgcggcgcctgcgcgagctcgaggaccaggcgcgaacgctgcccgagctgcaggagcaggtgcgcgcgctgcgcgccgagaaggcgcggctgctggccgggcgcgcgcagcccgagccggacggggaggctgagacgcgcccggacaagctcgcccagctgcggcggctcaccgagcgcctggccacctccgagcgcggcggccgtgccagggccagcccccgggctgacagcccagacggcctggctgcagggcgcagcgagggcgcgctccaggtcctcgacggggaggtcgggagtctcgatgggacgccccagacccgggaggtggccgccgaggccgtgcccgagacccgagaagcgggtgcccaggccgtgccggagacccgggaggccggcgtggaggctgcccccgagaccgtggaggcggacgcgtgggtgaccgaggcgctgctggggctgcctgcggccgccgagcgcgagctagagctgctgcgcgccagtctggagcaccagcgcggggtgagtgagcttctgcggggccggttgcgggagctggaggaagcccgcgaggctgcggaggaggcagcggcgggggcccgggcccagctacgcgaggccaccacccagaccccgtggagctgtgccgaaaaggccgcgcagaccgagtccccggcagaggcgccctccttgactcaggagagctcgcccggatccatggacggagacagggccgtggcgcccgcgggcatcctcaaatccatcatgaagaagagagacggcacacctggtgcccaacccagctccggacccaagagcctgcagtttgttggggtcctcaacggagagtacgagagctcctccagcgaggacgccagcgacagcgatggcgacagcgagaacggtggcgccgagcccccgggtagctcctcgggctccggggatgacagcggcgggggatccgactcgggcacccctggccctcccagcggcggggacatccgggaccctgagcccgaggcggaggcagagcctcagcaggtggcacaggggaggtgcgagctgagcccgcgtctgagggaggcgtgcgtagcgctgcagcggcagctgagccggccccgcggagtagccagcgacggcggcgcagtgcgcctcgtggcccaggagtggtttcgagtgtccagccagcggcgctctcaggcggagcccgtggccaggatgctggaaggggtgaggcgcctgggacccgaactgctggcgcacgtggtgaacctggcggatggcaacgggaacacggccctgcactacagtgtgtcccacgggaacctggccatcgcaagcctgctcctggatacgggggcctgcgaggtcaaccgccagaaccgagccggctactcggccctcatgctggctgcactcacctctgtgaggcaggaagaggaggacatggctgtggtccagagactcttctgcatgggtgatgtcaatgccaaggccagtcagacggggcagacagccctcatgctggccatcagccatggccgacaggacatggtggcaaccctactggcgtgtggggctgatgtgaatgcgcaggatgcggatggggccacagcgctgatgtgtgccagtgagtatgggcgcctggacaccgtgcggctgctgctcacccagccaggctgtgaccctgccatcctggacaatgagggcaccagtgccctggccatcgccctggaggctgagcaggatgaggtggccgctctgctacatgcccacctgagctcgggccagcccgacacccagagcgagtcaccccctggctcccagacagccacacctggtgaaggagaatgcggtgacaatggagagaacccccaggttcagtaagctgcctcgtctggctcactacacctagctgtggggagatctcctcgtcagtcacctcagcctttggcgcacagaagggtccagggtcccctgctcagaggctaacactggccgaagagaaaggcaatttcagttggggtgactgtggcaggaaggggctcactctggccccaccaaggtgaggtggggaccaagtgatagagccctgatccacccactctctgaaacttctttgctaataaaacattcctact

SEQ ID NO: 4492 - DNA, 633 bp, Homo sapiens
atggcgacagcgagaacggtggcgccgagcccccgggtagctcctcgggctccggggatgacagcggcgggggatccgactcgggcacccctggccctcccagcggcggggacatccgggaccctgagcccgaggcggaggcagagcctcagcaggtggcacaggggaggtgagcggcgctcgctagttgtttggagaggaggcggctgccctcctcctggtcggcgctgtccccgatccatcctgagtctctcctggcctcctctgcaggtgcgagctgagcccgcgtctgagggaggcgtgcgtagcgctgcagcggcagctgagccggccccgcggagtagcgacggcggcgcagtgcgcctcgtggcccaggagtggtttcgagtgtccagccagcggcgctctcaggcggagcccgtggccaggatgctggaaggggtgaggcgcctgggacccgaactgctggcgcacgtggtgaacctggcggatggcaacgggaacacggccctgcactacagtgtgtcccacgggaacctggccatcgcaagcctgctcctggatacgggtcagagccaagggagggtgggtcaccaggaaatgggtggggggagagggcaggggctgacctag

SEQ ID NO: 4493 - DNA, 2080 bp, Homo sapiens
ggcaagctggagggagctgcagggacagaggccaaagctgtctttccttgtgtaagggaggaactcttgctggccggggaacctcttggaattggtcttttttggggtttcagaggcaaagcttgaacaccatcagtcaagagtggttccgcgtctccagccggaagtcgtctagccccgccgtggtggcctcctacctccacgaggtccagcctcactccccacacttcctgaaactgcttgtcaacttggccgatcacaacgggaacacggcccttcactacagcgtgtcccactccaacttctccatcgtgaagctgctgctggagacaggcgtctgcaatgtggaccatcagaacaaagctggctacactgccgtaatgatcactcccttggcttccgcagagaccaatgaagacatggctgttgtctggaagctcttaagagaaggaaatgtgaacattcaagctactcagggaggccagactgcgctgatgctgggagtcagccacgacagggaggacatggttcaagcgctgcttagctgccaggcagatgtcaatctgcaggaccacgatggatcctcggccctcatggtggcctgtcaccatggcaacgtggacctggtgcggctgctcctggcacacccagcctgcgacagcagcctgactgacaaggctggccgcacagctttgtccatcgctctgaagtcacccacccatatggaaattgctgggcttctgagagcccacgcggagcagggcaggtccctggggctgtaggggctgcagaagaactggccgtggggaacaaaagccttcttctctggactcctccctcgcccttgaagagggcagaggtcacaggccagagagccacccttctagagaagaaactatgtcaaatatgcacatacattcctgttgtataattctgctcattaggatgctttgtagtttttgccttaggccaagcctgaaaactacacgggcttcagagcagggttcaaggtgcaaggtgaggggtacgtcggtgtcatccaaacatccaaaacatcttcagccttgaattcctcatgactctaccctctgtaacattgtgtagcaagcaggcaggcaggagcacattagcacattagaaaagcaatactttttacatggaattttacagtgcactatctttctgttttttaagcaagtgtatacaaatatgtcccattgatatgcatgtctatagatgggaggggatttaagccaaccccctggcaagcattctgtaggggaccctagaagaatcaccgtgcagactggtgaaactgaacaagcaccatttgggagctttgtttcgatggggttgacagagaaatcttaaaatctgacagggtagaagaagcactttggcatcaatgccatatgtacagtcttgactatttctgagtcatctagtggctccaatttgctccagggaaattggaattaattaagaaatttattatctagtaagttgctatgtaataaagaaaaaaaagaaattcaatccaatgacacacaccacatgtatttgggcagagtcagattctctcagctattttgagtctgtggaagaaacaaaaaaaagcttcctcctgaggatgggttattgtcatcaagaagccacctgcatagccgtatccattacctcatggtaattcccggtgctttcccctcatatcccctagaagcaaatatctgttctgaggttttttgggacttctggctgcaataggagcaagggacccaggcagggcagagcaataccttccgaagcttccatattccctggggccagcacatgcaaggtttatatggtcagtagctcacgtgaagtcatctgaatctttcttaaatctgctctcttaaaatctcttatgcaaaaaaaaaaaaaaaaagccccttatataaaaagaagtaatgtcaaagtttgatgagctttacattggaaactcaaaagcttgcactctcattttggctcagatgccaatttgctgggtgcccctgtggtgagtcatgaaacctccttgggccgcaatttcatcatctct

SEQ ID NO: 4494 - DNA, 2103 bp, Homo sapiens
gagaccgtcggccagagggcgcctggagggtgtgcgcgccgcggacgaccagggtgcgccagccccggggtgcgcgcctgggacgcggacagtgcacccggaggttgcgtgcgctccgaagccggggtgtgcgcctagctgccccggccccgtgcaccgcgggccgcctcgcgcaggacttccgcagctcgccaagaaccttcaacaagttttacagactcattggatgaagagtgcctgagacactgagggtcagcgctccaaagatggagaagacagatgagatctccccatcgaccagccttaaatccataatgaaaaagaaagactatggcttccgtgcaggaggtaatgggaccaaaaagaaccttcagtttgttggggttaacggtgggtatgagaccacctcaagtgaggagaccagcggtgaggacagcaccccagaggacttgtctgacagcgaggcagagaagaagtgtgacggcccagatcacaagcatgtcaaagatgcccatctcacctgcgaggctgggcagggcatccctgagggcacctgccatgctgcccaggaaagtgggcctggggaagaagtcccccactccaaggccgagagatataaaccctcagaagaatttcttaatgcatgccgggcactgagccagcatctgccagaaactgggaccaccacagaccagctcttgaggcaaagcttgaacaccatcagtcaagagtggttccgcgtctccagccggaagtcgtctagccccgccgtggtggcctcctacctccacgaggtccagcctcactccccacacttcctgaaactgcttgtcaacttggccgatcacaacgggaacacggcccttcactacagcgtgtcccactccaacttctccatcgtgaagctgctgctggagacaggcgtctgcaatgtggaccatcagaacaaagctggctacactgccgtaatgatcactcccttggcttccgcagagaccaatgaagacatggctgttgtctggaagctcttaagagaaggaaatgtgaacattcaagctactcagggaggccagactgcgctgatgctgggagtcagccacgacagggaggacatggttcaagcgctgcttagctgccaggcagatgtcaatctgcaggaccacgatggatcctcggccctcatggtggcctgtcaccatggcaacgtggacctggtgcggctgctcctggcacacccagcctgcgacagcagcctgactgacaaggctggccgcacagctttgtccatcgctctgaagtcacccacccatatggaaattgctgggcttctgagagcccacgcggagcagggcaggtccctggggctgtaggggctgcagaagaactggccgtggggaacaaaagccttcttctctggactcctccctcgcccttgaagagggcagaggtcacaggccagagagccacccttctagagaagaaactatgtcaaatatgcacatacattcctgttgtataattctgctcattaggatgctttgtagtttttgccttaggccaagcctgaaaactacacgggcttcagagcagggttcaaggtgcaaggtgaggggtacgtcggtgtcatccaaacatccaaaacatcttcagccttgaattcctcatgactctaccctctgtaacattgtgtagcaagcaggcaggcaggagcacattagcacattagaaaagcaatactttttacatggaattttacagtgcactatctttctgttttttaagcaagtgtatacaaatatgtcccattgatatgcatgtctatagatgggaggggatttaagccaaccccctggcaagcattctgtaggggaccctagaagaatcaccgtgcagactggtgaaactgaacaagcaccatttgggagctttgtttcgatggggttgacagagaaatcttaaaatctgacagggtagaagaagcactttggcatcaatgccatatgtacagtcttgactatttctgagtcatctagtggctccaatttgctccagggaaattggaattaattaagaaatttattatctagtaagttgctatgtaat

SEQ ID NO: 4495 - DNA, 3023 bp, Homo sapiens
aaaaaagattttagtacttccaggaacccagtggaataaaaactgatgtgtgtgacagtggaggctcgggacctctactcttgcctttgctctaaggttgggtctgactatgggcccactgcctacagctgtatggatagcacagggcacaaagatgccagccagggagggcaaatgagagttgaaagccagcccacactccatttgccaagccttgcgctgcagcaccacatccacccagagggggctgttctcatttgcattgtgcaaaggcagtgtctggggccaagaatggccctgctgcgtggactccagacctcttcctgggcttttgcattcctgtgttcctctctggttcttgcatagtagaggttttctctggcctggttttggaggagcattatattgatatctggtatagttcactgaatattttctctgcgtgcatgtgtgtgtgtacgtgcatgtgtgtgtgtacaggggcaggagattaagtgctgctcacatatggaaatgggcccttcggctgagcagcacttcctgttgtaacagatcaaaccctcttcactgtcgggtaaagtggaaccacgttttgctttgcagggcagcatgcgagtctgcttcctgccacaaatcacaatttgactgctttctcattgtttcagtgctagttctagccttccccgttgggagccgcctcctgtcctgttgagcacattgcaagatctgtgtccttgctcgtgtatctactgtgagcacggtgtcatcaccacccccacaaccctagtgtcagtatgcacttgtgagccaggaaggaccactgaggtgcccttgagcagaagtgggtgctagaccatgagtccagaggcctacgttctgctcctacactcccattcactgagcaagtctgggcctcagatttcccagctgtaagacagggacaacaatggcacctacgccacatggttcttcatccacacttagaggggcattgttaacagagacagttctcccaacattgagcagaaagcaaggctcctccaagaggtccccaaaacattgatttacatgatctggttccctgtccctccttacctctccacacacctgcaacccttgtcccctcaaagcaatatcctggttttgctacattcccatgcatccccaagatcattctaacctgtgatgttgtgtctgcctagagatctccccatcgaccagccttaaatccataatgaaaaagaaagactatggcttccgtgcaggaggtaatgggaccaaaaagaaccttcagtttgttggggttaacggtgggtatgagaccacctcaagtgaggagaccagcggtgaggacagcaccccagaggacttgtctgacagcgaggcagagaagaagtgtgacggcccagatcacaagcatgtcaaagatgcccatctcacctgcgaggctgggcagggcatccctgagggcacctgccatgctgcccaggaaagtgggcctggggaagaagtcccccactccaaggccgagagatataaaccctcagaagaatttcttaatgcatgccgggcactgagccagcatctgccagaaactgggaccaccacagaccagctcttgaggcaaagcttgaacaccatcagtcaagagtggttccgcgtctccagccggaagtcgtctagccccgccgtggtggcctcctacctccacgaggtccagcctcactccccacacttcctgaaactgcttgtcaacttggccgatcacaacgggaacacggcccttcactacagcgtgtcccactccaacttctccatcgtgaagctgctgctggagacaggcgtctgcaatgtggaccatcagaacaaagctggctacactgccgtaatgatcactcccttggcttccgcagagaccaatgaagacatggctgttgtctggaagctcttaagagaaggaaatgtgaacattcaagctactcagggaggccagactgcgctgatgctgggagtcagccacgacagggaggacatggttcaagcgctgcttagctgccaggcagatgtcaatctgcaggaccacgatggatcctcggccctcatggtggcctgtcaccatggcaacgtggacctggtgcggctgctcctggcacacccagcctgcgacagcagcctgactgacaaggctggccgcacagctttgtccatcgctctgaagtcacccacccatatggaaattgctgggcttctgagagcccacgcggagcagggcaggtccctggggctgtaggggctgcagaagaactggccgtggggaacaaaagccttcttctctggactcctccctcgcccttgaagagggcagaggtcacaggccagagagccacccttctagagaagaaactatgtcaaatatgcacatacattcctgttgtataattctgctcattaggatgctttgtagtttttgccttaggccaagcctgaaaactacacgggcttcagagcagggttcaaggtgcaaggtgaggggtacgtcggtgtcatccaaacatccaaaacatcttcagccttgaattcctcatgactctaccctctgtaacattgtgtagcaagcaggcaggcaggagcacattagcacattagaaaagcaatactttttacatggaattttacagtgcactatctttctgttttttaagcaagtgtatacaaatatgtcccattgatatgcatgtctatagatgggaggggatttaagccaaccccctggcaagcattctgtaggggaccctagaagaatcaccgtgcagactggtgaaactgaacaagcaccatttgggagctttgtttcgatggggttgacagagaaatcttaaaatctgacagggtagaagaagcactttggcatcaatgccatatgtacagtcttgactatttctgagtcatctagtggctccaatttgctccagggaaattggaattaattaagaaatttattatctagtaagttgctatgtaat

SEQ ID NO: 4496 - DNA, 4665 bp, Homo sapiens
tcgggcgctgttggcagctggcgacgcggggcgaagccgcggctggcggcgcctggccagtcccgcatccgccgcggtgggtgtgcccgcaggggtgcgccggggccagggccgagaccgtcggccagagggcgcctggagggtgtgcgcgccgcggacgaccagggtgcgccagccccggggtgcgcgcctgggacgcggacagtgcacccggaggttgcgtgcgctccgaagccggggtgtgcgcctagctgccccggccccgtgcaccgcgggccgcctcgcgcaggacttccgcagctcgccaagaaccttcaacaagttttacagactcattggatgaagagtgcctgagacactgagggtcagcgctccaaagatggagaagacagatgccaaagaccagtcctctcagggggatgaagagaaagaccctccgaagagccacccttattctgtggagaccccatatggctttcatttagacctggacttcctcaagtatgtggatgacatcgagaagggaaacactatcaaaagaattcctatccacagaagggccaagcaggccaaatttagcactctgccccgaaacttcagccttcctgacagtggggctcgcccccctgcagccccgcccctccaaaactggtctcccgtggtgccaagggaggcatcacttgggacacaggagcaaaaccagtcaccaccgcttggtaatgccccccaggcctcaacaagcaggagtgaggtgagctaccacaggaaggctctgttggcagaggccaccagacagttggaagctgctgagccagaggatgccgagctcacttttgggagtggacggccccagctcttgagagcatccagcatgcctgccacgctgctgcacagcagggcttctgaggagccaggcctgagcctggggccccctgcccctcctgccctccctccccttcagggtgaaggcagtgtctgtgatggcacctttgaacctgcagaaggattggcaggtttccacagctccagcccacgagcatcaactcggattccagagctggtccaggagggagctgagcctccagagggtgtggtgaaggttccaaatcacctccctctcccaggccctcctttctcattccagaatgtgcttgtagttctagaggacaaggaagatgaacacaatgccagagaagcagaggtgttgttcacccctggctcccctacgccaagcccgccacctctgccatcacccatccctgagaatgagctcctcctggaagaaatcgagctcaacatcagcgagattccacccccgccacctgtagaggtggacatgagaagcattggcatcagggtaactgaggaaagcctgggccttgccagggtggatccaggcagcatctccagcctgaaacagcaggtctcggccctggagggagagttgtctggaagaaccgaggaactggcacaggtcagaactgctctccagcagcaggaagaggaaatcaaagctagggagcaaagaattcgagagctggagttcactgtagcccaactggaaggacagtttcaccaagagaacgccaaagacactcagggccagacggacgtgatggtgaacactgaccctgtccatggactcttgaccagggagtcgtgtgataagggcattgaagtcaaccttctaggcagcatggagtctgaaagctgggggcaccgaggagaggagaatggcctcctatgggggccagatggtcataaacaagggaatcagagcccagcagaacgtgtgcttctgccccagctgtcactgccacagggacccgagcaggtccttacctcctctgtacatagcttcctctccactgaactcaggattgaagaagcaggcactgaacaggaaggaggccctcagggaggaaccaggggagcaggaggctttctgtggggcagcgacagaaagactcccccagcagggagggaggagaccagttccaatctcccagggaaggagcacccgggaaggccaccaagctcgccaacggatgccactattgggcagtatgtgaagaagatccaggagctcctgcaggagcagtggaactgcctggagcatgggtacccggagctggccagcgccatcaagcagccagcctccaagctcagcagcatccagagccagctgctgagctccctcaacctgctgctgtcggcctactcggcccaggctcacccacccaaggagccaccggcctcctcctcctccccgccagtggagatctccccatcgaccagccttaaatccataatgaaaaagaaagactatggcttccgtgcaggaggtaatgggaccaaaaagaaccttcagtttgttggggttaacggtgggtatgagaccacctcaagtgaggagaccagcggtgaggacagcaccccagaggacttgtctgacagcgaggcagagaagaagtgtgacggcccagatcacaagcatgtcaaagatgcccatctcacctgcgaggctgggcagggcatccctgagggcacctgccatgctgcccaggaaagtgggcctggggaagaagtcccccactccaaggccgagagatataaaccctcagaagaatttcttaatgcatgccgggcactgagccagcatctgccagaaactgggaccaccacagaccagctcttgaggcaaagcttgaacaccatcagtcaagagtggttccgcgtctccagccggaagtcgtctagccccgccgtggtggcctcctacctccacgaggtccagcctcactccccacacttcctgaaactgcttgtcaacttggccgatcacaacgggaacacggcccttcactacagcgtgtcccactccaacttctccatcgtgaagctgctgctggagacaggcgtctgcaatgtggaccatcagaacaaagctggctacactgccgtaatgatcactcccttggcttccgcagagaccaatgaagacatggctgttgtctggaagctcttaagagaaggaaatgtgaacattcaagctactcagggaggccagactgcgctgatgctgggagtcagccacgacagggaggacatggttcaagcgctgcttagctgccaggcagatgtcaatctgcaggaccacgatggatcctcggccctcatggtggcctgtcaccatggcaacgtggacctggtgcggctgctcctggcacacccagcctgcgacagcagcctgactgacaaggctggccgcacagctttgtccatcgctctgaagtcacccacccatatggaaattgctgggcttctgagagcccacgcggagcagggcaggtccctggggctgtaggggctgcagaagaactggccgtggggaacaaaagccttcttctctggactcctccctcgcccttgaagagggcagaggtcacaggccagagagccacccttctagagaagaaactatgtcaaatatgcacatacattcctgttgtataattctgctcattaggatgctttgtagtttttgccttaggccaagcctgaaaactacacgggcttcagagcagggttcaaggtgcaaggtgaggggtacgtcggtgtcatccaaacatccaaaacatcttcagccttgaattcctcatgactctaccctctgtaacattgtgtagcaagcaggcaggcaggagcacattagcacattagaaaagcaatactttttacatggaattttacagtgcactatctttctgttttttaagcaagtgtatacaaatatgtcccattgatatgcatgtctatagatgggaggggatttaagccaaccccctggcaagcattctgtaggggaccctagaagaatcaccgtgcagactggtgaaactgaacaagcaccatttgggagctttgtttcgatggggttgacagagaaatcttaaaatctgacagggtagaagaagcactttggcatcaatgccatatgtacagtcttgactatttctgagtcatctagtggctccaatttgctccagggaaattggaattaattaagaaatttattatctagtaagttgctatgtaataaagaaaaaaaagaaattcaatccaatgacacacaccacatgtatttgggcagagtcagattctctcagctattttgagtctgtggaagaaacaaaaaaaagcttcctcctgaggatgggttattgtcatcaagaagccacctgcatagccgtatccattacctcatggtaattcccggtgctttcccctcatatcccctagaagcaaatatctgttctgaggttttttgggacttctggctgcaataggagcaagggacccaggcagggcagagcaataccttccgaagcttccatattccctggggccagcacatgcaaggtttatatggtcagtagctcacgtgaagtcatctgaatctttcttaaatctgctctcttaaaatctcttatgcaaaaaaaaaaaaaaaaagccccttatataaaaagaagtaatgtcaaagtttgatgagctttacattggaaactcaaaagcttgcactctcattttggctcagatgccaatttgctgggtgcccctgtggtgagtcatgaaacctccttgggccgcaatttcatcatctct

SEQ ID NO: 4497 - DNA, 674 bp, Homo sapiens
gtttttgtcgcgcgaggttttggtttgtgaggatcggcgagtggcgcccaccatctctgcttgctgaaaagctgcagaggccgccaggagcccacgcacctgagacttttacctttacccagaaaggaataaaagaggtcagatgatgacagctgtgtccttaacaaccaggccccaggaatcagtggcttttgaggacgtggctgtgtacttcactacgaaggaatgggccatcatggtgcctgccgagagggccttgtacagggatgtgatgctggagaactatgaggctgtggcctttgtagtgccacccacttccaaaccagctttggtctctcatctggagcaagggaaagagtcctgtttcacccagccacagggagtcctaagcaggaatgactggagagcaggctggataggatacttggaactaagaagatatacttacttagctaaagcagtgttacgtagaatagtatcaaaaatttttcgaaatcgtcaatgctgggaagacaggagaaaagcttaattcttgacatttaaataccagttttccaagtaaggagttgatgtaagagccaccttaaacgatgtcaaatacacattttctttttctgtagactggtagatttaatgtttttcattcattaaaataactcattttgatgtacaaa

SEQ ID NO: 4498 - DNA, 2566 bp, Homo sapiens
agttattttcgcctgccatagtgtacaccagtcttgaaacttgttactgtcgtagagcaaccaaaaatttgagaataccgaattgtattccctacccgtccccaggatgtcccattttggaaaatatggagccctgcgatctggattggctcataagaatgttaaatctaaaaagactgatcgtatccgtcatgcacctaatgtgtgtccagtgtttaacatagtttcctatgtacaggattggagatgtcgaaagatttcttgacctcttaacattgttcattatattcttttctttagattctctgaacttttactccactgtcataatttaattgtcaaggttcataggataacattcgatgtccctgccattagtcaactatgttgggagtgtgatttgttctccaatgtggcttgttatttatgtttcatctccacttagctttccccataggaagacacttccatagggagtgttttgtgttttgtagggtgacctctgttgtagttctatttccagatgatttccctttcgcagattgtcagctgtgcagatcagacctttttgcttaagtccttttgtttgatacgctaatcctattaagtatccactgtaagggacatttactgccgatacaatgacagtatcatgattttagagaattagattccacaattacaagggttaactatttacttagtatgaatcactgcttttgttaccctttcttggacagaaaccatccatgaatttagcagcattacttgtgtaggtttacattgtgttttcttttaaagtacttctctttacactcataaatatttctccttactggactccctgttaacttccaagatgccttttctggcgtctcctgacagctgtttctctgacaccttcagcttcctctaccttcctgaatggctttctggattcactaagaagagtcattggagggaggggcagtgcactggctttatagtgttttgtctgatgctgttgcagtaccctaagacttacagcaaactgcagatatggagttggaacggaagttgtttttaaggtctatgagtatatgcacttttatgtgtttgtttatatgctttttgaatatctctgatccaactgttggcagctctttgtatttcaggtgttgtctttaatgcataaatattgatgattcactcttgaaaggcaaaagacttacttcctaatgatgaactaattaaatgacccagaatgagagttggaactagtttagaaatgaaattgttttgtttccttatactataacatttggaacttgaagtatttgggacatgttatgaagttgatggattcttttaatatggtaatgttttctttctcatcacccactccaaacacctttataaaactgaatgagtatcttgtatttaggggaaaaatagtagtagggaggcatcaaaatatttctgataactattttcaaagtctgttcaactttcattacttcagtcatagaaactcttgttctaatattaagtagcataggaggaaaaacatgctgaggtcttacagtgtttaatggatttcttttatataactcattcctatctgtactacataactcattcttatctgtactgtatggatttcagggatcttaactgtttagaattccaactttcttttctgcctataacactctgtccactgtctaccttagtttccttttctgtttcctgtcctgtgatgtattctatggattagctgaaattatagttttctcagtccactttttcatcactcattccgtggatgattctacctcctttttgcatttctctgtatgcctgctatctcgcctttgtgagattgataataagcaataactaatgaacggttattgatatagccttcaaaacagatgggtcagaggttgtttgtaggacttatggtcaataaagttattatcgttaatgttttttttctttaccttcagcacctgagacttttacctttacccagaaaggaataaaagaggtcagatgatgacagctgtgtccttaacaaccaggccccaggaatcagtggcttttgaggacgtggctgtgtacttcactacgaaggaatgggccatcatggtgcctgccgagagggccttgtacagggatgtgatgctggagaactatgaggctgtggcctttgtagtgccacccacttccaaaccagctttggtctctcatctggagcaagggaaagagtcctgtttcacccagccacagggagtcctaagcaggaatgactggagagcaggctggataggatacttggaactaagaagatatacttacttagctaaagcagtgttacgtagaatagtatcaaaaatttttcgaaatcgtcaatgctgggaagacaggagaaaagcttaattcttgacatttaaataccagttttccaagtaaggagttgatgtaagagccaccttaaacgatgtcaaatacacattttctttttctgtagactggtagatttaatgtttttcattcattaaaataactcattttgatgtacaaa

SEQ ID NO: 4499 - DNA, 826 bp, Homo sapiens
gggatcctttctggaatggaggtcttatgagctgctattgaacacggcagagcctgttggtgacctgcacacaggagccctccagtcagtactgattgaattactcaaggctgcctctctgcaaagttgagcagcatttccatttcccaaaccggctctgatttcccagctggagcgaggggaaacaccctggtgctcggttcctcggggagctctggatggagaggccccaaggggcatctcctcagcacctgagacttttacctttacccagaaaggaataaaagaggtcagatgatgacagctgtgtccttaacaaccaggccccaggaatcagtggcttttgaggacgtggctgtgtacttcactacgaaggaatgggccatcatggtgcctgccgagagggccttgtacagggatgtgatgctggagaactatgaggctgtggcctttgtagtgccacccacttccaaaccagctttggtctctcatctggagcaagggaaagagtcctgtttcacccagccacagggagtcctaagcaggaatgactggagagcaggctggataggatacttggaactaagaagatatacttacttagctaaagcagtgttacgtagaatagtatcaaaaatttttcgaaatcgtcaatgctgggaagacaggagaaaagcttaattcttgacatttaaataccagttttccaagtaaggagttgatgtaagagccaccttaaacgatgtcaaatacacattttctttttctgtagactggtagatttaatgtttttcattcattaaaataactcattttgatgtacaaa

SEQ ID NO: 4500 - DNA, 4017 bp, Homo sapiens
ggcgcgccaggtaaggcaggcggacgcgcggacccctcggcgcagtgcggccccgaaggcggtagggcgagaaagagctgggacccccccgcaacttcgggatcggctgggtgaggctgggcaggcctgatgctcaggggttcgtgccgggaagttcaggtcctcggacaacctctctccagctctccgccgccggtacccacggcccagtctccacctggggaaacccccttggcgtggcttgtttcgttacaagttatcctggtagagtgggcatgaaggcctcggaggcaactgtgcctgcaggtgtccatcaccttcaaggacttggccgtgcggttctcggaggaggagtggcggctcctggaggaggggcagagggagttctaccgagacgtgatgcgggagaactacgagacgctggtctctgtggggacagctgagctgctccccctctctgctttcctgtcaccctcagagcctggaagagctgttgggggagggagccacgctgatgaggggcaggagcctgctggttgtggagatccccaggggggacagccccggcacagcctgcacctcacagccctggtgcagctggtgaaggagatcccagagttcttgtttggagaagtcaagggcgctatggacagccccgagagcgagagccggggagccagcctggatggagagagagcgagccccgaggcagctgcggcaagagagccctgccctctccgaggcctgctcagctgccttccagacggccctaccagccagccccacctggccaccacgcccaccgacagctcgtgttccagtggcccaactggtgacggggtccagggaagtcctctccccatcaaaactgccgacaaaccgtggcctacaaggaaggaaggcccaggagccctgggcggggagcccagccctcccacccatagccccagcaggaggaagagccacagaggacaggagagagggacctcagaggccggaatttctcctgggaacagccccttgcaaggcctcatcaactgtctgaaggaaatccttgtgcctgggccccggcaccccgagacatccccaagcttcttgccacctctccctagcctgggcacgtccaggctaaccagagcagacctggggcctgggagcccgccctgggcagtgaagaccgaggcggtttcaggggattgtcccctccagggtctgctacactgtctgaaggagctccccgaggcccaggacaggcatcccagtccctcaggagtggggaaccgacggctacaggagaatccaggagcctggaaaaggggttctggagggcctggatacctcctgacccctcctccccatcctgatcttggagctggcggtctgctctctgtgaagatggagaacagctgggtccagagccccccaggacctgcatcctgtcagcctggcaggcagcccctcagtccctcagccactggagacaccagaggggtcccccaacccagctggggccctgaggctcaagctgccagtgcctcaagctcaccgctggaagccctggaagcctgtctgaagggcattcccccaaatgggtcgtcaccttcccagctgccacccacttcttgttcccagaacccccagccaggagactctaggtctcagaagcctgaactgcaaccccacagatcacacagtgaagaagcgaccagagagcctgttctgcctctgggtctgcagagctgtgtgagagatggccccagcaggcccctggccccccgaggaacccccaccagcttctcctcatccagcagcaccgactgggacctggattttgggagtcctgtggggaaccaggggcagcatcctggaaaaggaagcccaccaggaagctccccactgcagggtctggagaattgtctcaaggagatacctgtgcctgtgctgcggcctgcctggccctgctcctcagcagcagacaggggaccgaggagagcagagcccaggaactggacagcagacaaggaaggactgagggctgaggcctgcgagtcacgtctcgggcagggtaggggagaagcgcccacccggagcctccatctggtcagcccacaggtgttcacctccagctgcgtccccgcctgccaccagcgggggttcaaagaccctggggccaccaggccaggagtgtggaggtggctcccagaggggtctgcccccaagccctccccgctgcactgcctggagagcgccctgagggggatcttgcctgtaaggcccttgcgcttcgcctgcgtgggaggccccagccccagccccagccccggctccagctcgagcttcagcggctctgaaggagaagacccgaggccagagcctgatctctggaagccgctcccccaggagagggaccgccttcccagctgtaagcctcctgtccctctgtccccatgtcctggtgggacccctgctggcagcagtggcggcagccctggtgaagaccccaggagaacagagcccaggtactgcagcggcctcggtgcaggtacagctcaggatccctgcccggtttctcagctggagaaaaggcccagggttagtgaagcatccagaggcctggagcttggacatggaagacccagagttgcagccaagacccatgagaggctgctcccccagggcccgcctgagctgcccagtgagtctccccctccggagctgccccctccggaagctgcgcctcctgtgttgccagcctcctccctgcagccgccatgccactgtgggaagcccctgcagcaggagctgcacagcctcggtgctgcccttgcggagaagctggatcggctcgccacagcgctggcaggcctggctcaggaagtggccaccatgaggacccaggtgaatcggctggggaggcgcccccaaggccctgggccaatgggccaagcttcctggatgtggaccctcccacggggacctcgctgggctcatggccctggtcacagacatctgccctactggaggcagaagggacccacgaggcctaaaccaaagatcctgcgtggccagggagagagctgcagggctggtgacctgcaaggactctccagagggaccgctcgccgggcacgtccgctgcctccagacgctcccccggcagaacctcctgggctccactgcagctcttcccagcagctgctgtcctctacacccagctgccatgctgcgccgcctgcacaccccctcctcgcacataccgggggccaccagagcccccttccccctttagtgcctgctgccttacccctgcagggagcctctcctcctgcagccagtgcagatgcagacgtgccgacctcaggagtggcaccagacgggatcccagagcggcccaaggagccgagcagcctgctgggaggagtgcagagggccctccaggaagaactgtggggtggggagcacagggacccgagatggggggcgcattgatggcattcctcttctccacatctgctcgttcttgccgagggtgcagtggtggcgtggaagccctgtcaccccaccccaggccaccctctcccagaggacgccatctcccttactgttgctgggagcctcgccctttgtcccaactgggtagagcccccaggtgctgtttgctcaggaggctgctgtgggggtgccttcctcagcctctggccctcttggctcagattcaatcaaatgttgcttccctctcctgtctttcccactggagccgcccaagcttgtaggtgggtggtgtgcataggccacgtgtgccccacatatgcagggggtgccccacacagctagagcggccaggagagcgcctcctaaccaccagccgttcctgatctcaggagccttgaagggctgggctcttgccttcctggagtaaatattggcacagatttcatttgagagaactcagccccctggtctaagctggacttacctctgtggattctgaaattaaagaagtgagttgctaaggaa

SEQ ID NO: 4501 - DNA, 3837 bp, Homo sapiens
ggcgcgccaggtaaggcaggcggacgcgcggacccctcggcgcagtgcggccccgaaggcggtagggcgagaaagagctgggacccccccgcaacttcgggatcggctgggtgaggctgggcaggcctgatgctcaggggttcgtgccgggaagttcaggtcctcggacaacctctctccagctctccgccgccggtacccacggcccagtctccacctggggaaacccccttggcgtggcttgtttcgttacaagttatcctggtagagtgggcatgaaggcctcggaggcaactgtgcctgcaggtgtccatcaccttcaaggacttggccgtgcggttctcggaggaggagtggcggctcctggaggaggggcagagggagttctaccgagacgtgatgcgggagaactacgagacgctggtctctgtggggacagctgagctgctccccctctctgctttcctgtcaccctcagagcctggaagagctgttgggggagggagccacgctgatgaggggcaggagcctgctggttgtggagatccccaggggggacagccccggcacagcctgcacctcacagccctggtgcagctggtgaaggagatcccagagttcttgtttggagaagtcaagggcgctatggacagccccgagagcgagagccggggagccagcctggatggagagagagcgagccccgaggcagctgcggcaagagagccctgccctctccgaggcctgctcagctgccttccagacggccctaccagccagccccacctggccaccacgcccaccgacagctcgtgttccagtggcccaactggtgacggggtccagggaagtcctctccccatcaaaactgccgacaaaccgtggcctacaaggaaggaaggcccaggagccctgggcggggagcccagccctcccacccatagccccagcaggaggaagagccacagaggacaggagagagggacctcagaggccggaatttctcctgggaacagccccttgcaaggcctcatcaactgtctgaaggaaatccttgtgcctgggccccggcaccccgagacatccccaagcttcttgccacctctccctagcctgggcacgtccaggctaaccagagcagacctggggcctgggagcccgccctgggcagtgaagaccgaggcggtttcaggggattgtcccctccagggtctgctacactgtctgaaggagctccccgaggcccaggacaggcatcccagtccctcaggagtggggaaccgacggctacaggagaatccaggagcctggaaaaggggttctggagggcctggatacctcctgacccctcctccccatcctgatcttggagctggcggtctgctctctgtgaagatggagaacagctgggtccagagccccccaggacctgcatcctgtcagcctggcaggcagcccctcagtccctcagccactggagacaccagaggggtcccccaacccagctggggccctgaggctcaagctgccagtgcctcaagctcaccgctggaagccctggaagcctgtctgaagggcattcccccaaatgggtcgtcaccttcccagctgccacccacttcttgttcccagaacccccagccaggagactctaggtctcagaagcctgaactgcaaccccacagatcacacagtgaagaagcgaccagagagcctgttctgcctctgggtctgcagagctgtgtgagagatggccccagcaggcccctggccccccgaggaacccccaccagcttctcctcatccagcagcaccgactgggacctggattttgggagtcctgtggggaaccaggggcagcatcctggaaaaggaagcccaccaggaagctccccactgcagggtctggagaattgtctcaaggagatacctgtgcctgtgctgcggcctgcctggccctgctcctcagcagcagacaggggaccgaggagagcagagcccaggaactggacagcagacaaggaagggtctgcccccaagccctccccgctgcactgcctggagagcgccctgagggggatcttgcctgtaaggcccttgcgcttcgcctgcgtgggaggccccagccccagccccagccccggctccagctcgagcttcagcggctctgaaggagaagacccgaggccagagcctgatctctggaagccgctcccccaggagagggaccgccttcccagctgtaagcctcctgtccctctgtccccatgtcctggtgggacccctgctggcagcagtggcggcagccctggtgaagaccccaggagaacagagcccaggtactgcagcggcctcggtgcaggtacagctcaggatccctgcccggtttctcagctggagaaaaggcccagggttagtgaagcatccagaggcctggagcttggacatggaagacccagagttgcagccaagacccatgagaggctgctcccccagggcccgcctgagctgcccagtgagtctccccctccggagctgccccctccggaagctgcgcctcctgtgttgccagcctcctccctgcagccgccatgccactgtgggaagcccctgcagcaggagctgcacagcctcggtgctgcccttgcggagaagctggatcggctcgccacagcgctggcaggcctggctcaggaagtggccaccatgaggacccaggtgaatcggctggggaggcgcccccaaggccctgggccaatgggccaagcttcctggatgtggaccctcccacggggacctcgctgggctcatggccctggtcacagacatctgccctactggaggcagaagggacccacgaggcctaaaccaaagatcctgcgtggccagggagagagctgcagggctggtgacctgcaaggactctccagagggaccgctcgccgggcacgtccgctgcctccagacgctcccccggcagaacctcctgggctccactgcagctcttcccagcagctgctgtcctctacacccagctgccatgctgcgccgcctgcacaccccctcctcgcacataccgggggccaccagagcccccttccccctttagtgcctgctgccttacccctgcagggagcctctcctcctgcagccagtgcagatgcagacgtgccgacctcaggagtggcaccagacgggatcccagagcggcccaaggagccgagcagcctgctgggaggagtgcagagggccctccaggaagaactgtggggtggggagcacagggacccgagatggggggcgcattgatggcattcctcttctccacatctgctcgttcttgccgagggtgcagtggtggcgtggaagccctgtcaccccaccccaggccaccctctcccagaggacgccatctcccttactgttgctgggagcctcgccctttgtcccaactgggtagagcccccaggtgctgtttgctcaggaggctgctgtgggggtgccttcctcagcctctggccctcttggctcagattcaatcaaatgttgcttccctctcctgtctttcccactggagccgcccaagcttgtaggtgggtggtgtgcataggccacgtgtgccccacatatgcagggggtgccccacacagctagagcggccaggagagcgcctcctaaccaccagccgttcctgatctcaggagccttgaagggctgggctcttgccttcctggagtaaatattggcacagatttcatttgagagaactcagccccctggtctaagctggacttacctctgtggattctgaaattaaagaagtgagttgctaaggaa

SEQ ID NO: 4502 - DNA, 527 bp, Homo sapiens
cagaccctggctattatcctggagtgtgcgcctggaggcctaggtggggttaccaagtgcagggacagctaggctgtcccctctgggatggaacaaccaacccccccggagactgtgcctgcaggtgtccatcaccttcaaggacttggccgtgcggttctcggaggaggagtggcggctcctggaggaggggcagagggagttctaccgagacgtgatgcgggagaactacgagacgctggtctctgtggggacagctgagctgctccccctctctgctttcctgtcaccctcagagcctggaagagctgttgggggagggagccacgctgatgaggggcaggagcctgctggttgtggagatccccaggggggacagccccggcacagcctgcacctcacagccctggtgcagctggtgaaggagatcccagagttcttgtttggagaagtcaagggcgctatggacagccccgagagcgagagccggggagccagcctggatggagagagagcgagccccgagg

SEQ ID NO: 4503 - DNA, 1964 bp, Homo sapiens
tgctgcatgccttcattcctggtgccctctcttgtctcttccccagtcctgctgaagctgctctttagcccaggccccaagactatatggtccctgtggcagcagccaatgttgtttcaggaagcaacagcatttgaaaatatgaccaaagattggaattatttagaaggctctcaaaaggattgctacagagacacaatgctggacagttatgagaacacggtcccacagggatccttcttacagctctccatgatgcctcagagagctggaaatgatccacctggggtttcaaatgcaagtgaaatggaaatggagataagtaacatgagagaaaagtttcttatgagtgtaacaaagttagtagaaagcaaaagttacaacagcaaggtattttccaaagaaaagtactttcaaacaataaaggaagttaaagaagctaaagaaaaagggaagaagtcatcacgtgattatcgccgtgcagcaaaatatgatgtgatctctgtacagggcacagagaaactgatagaggctactcatggagaacgtgatcgaatacggtattatgtacataaggaagagttgtttgatattcttcatgatacacatctcagtattggacatggtgggcggacacgcatgctcaaggagctgcaaggaaaatatgggaatgtcaccaaagaagttattgtcttatatctgactctgtgtaaacagtgccaccagaagaacccagtacccaagagaggccttgcaccaaagcccatgacttttaaggacatagactccacatgccaagttgaaatacttgacatgcagtccagtgccgatggtgagttcaagttcattttatactaccaggatcactcaaccaagtttattattttacggccattaagaaccaaacaggcccatgaggtggtcagtgtcttgttagatattttcacaattcttggtacacccagtgtgttagactctgacagtggcgttgagttcacaaaccaggttgttcatgagctcaatgagttgtggccagacctaaagattgtatctggtaagtaccaccctggccaaagccagggctccctggaaggagcaagccgtgatgtaaagaacatgataagtacctggatgcagagtaaccactcatgtcactgggccaaaggcctccgattcatgcagatggtgaggaatcaggctttcgacgtttccttgcagcaaagtccatttgaggcaatgtttggctataaagccaaatttgggctatattcctcaaacttgccccgggaaactgtggctactttacaaacggaagaagagctagaaattgctgaagaacagctagaaaatagcctttggatcaggcaggaagaaagggctgagattggagcagacagatctgatatggacgatgacatggatcccactcctgaagcttcagaacccagcacctcacaagggacttccggtctcctctgctggtgaacagatggctgctgggtggacagtcacaggtgtctctctgagcatagtcatctgagaactgttgccagaggccccagaggaaaagattgaaggctgcactctcaggtcaagttgtacatggcagtccttgctcaaaaagacaaaagttcaggtctgtgtatttattcttagggctgccataaaaaattaccacaacctggccgggcgcagcgctcatgcccgtaatcccagcactttggtaggccaaggtgggcgggtcacttgagatcaggagttcaagactagcctggccaacatgatgaaaccctgtctctactgaaaatatagaaattagccaggcttggagctgtgtgcctgtaatcccagctaaccaggaggctgaggcaggagaatcacttgaacccaggaggcagaggttgcagtgagccgagaccatgccactgcactccggcctgggtgacaaagcaagactctgtctc

SEQ ID NO: 4504 - DNA, 2562 bp, Homo sapiens
gtggggcggagttgctgctcgggggcctctgggtggagggggattcagacgccgcgtctggtgtgtccctttctccttcctgaccttcctcagtctgcagctcttttctccaccgcgcgcccgcctcagccgttcagccctgagctggcgggtggacgggcatggatccaggcggtgggagcagtctgcgaagtcagggtaggaaggctacacaaaggaggcgacatcccagcccggtcctcaggaataagcgggcgtgcccgtgtggtgtggacggtgaggggacactgtattaagtgccttatctgcattatcattgaatcttcatagcaatcgattgtgatgggtactggtcatctccccgggttgtagatgaggaaactgaggcctcagtaactttgctttagtcagtaaatgataagagtcagcaaatgaattcccaagcgtagactcggccgtaccgctgctctaccttgctaataacgacctacctgtaagcgacatttttgacaaaatgtcctttaaacatcttttgtgctcagctctgtattcgtgggccctccaaagggggtacaggcaggtagaagcctccgtccctaccttataggttgtatatatctgaactggtcgactaaagatgcaaagcgaagtgctccagtgagtgtggtacaggttgttgagatgaaggagagatggcaatcagctaaagttactgaatacgtcaggaaggaggctggtttcagctggctgtgattgggaggatcaatgcgaggacattccgagtcggaaacagccaaggcgaagactcacaggatccttcttacagctctccatgatgcctcagagagctggaaatgatccacctggggtttcaaatgcaagtgaaatggaaatggagataagtaacatgagagaaaagtttcttatgagtgtaacaaagttagtagaaagcaaaagttacaacagcaaggtattttccaaagaaaagtactttcaaacaataaaggaagttaaagaagctaaagaaaaagggaagaagtcatcacgtgattatcgccgtgcagcaaaatatgatgtgatctctgtacagggcacagagaaactgatagaggctactcatggagaacgtgatcgaatacggtattatgtacataaggaagagttgtttgatattcttcatgatacacatctcagtattggacatggtgggcggacacgcatgctcaaggagctgcaaggaaaatatgggaatgtcaccaaagaagttattgtcttatatctgactctgtgtaaacagtgccaccagaagaacccagtacccaagagaggccttgcaccaaagcccatgacttttaaggacatagactccacatgccaagttgaaatacttgacatgcagtccagtgccgatggtgagttcaagttcattttatactaccaggatcactcaaccaagtttattattttacggccattaagaaccaaacaggcccatgaggtggtcagtgtcttgttagatattttcacaattcttggtacacccagtgtgttagactctgacagtggcgttgagttcacaaaccaggttgttcatgagctcaatgagttgtggccagacctaaagattgtatctggtaagtaccaccctggccaaagccagggctccctggaaggagcaagccgtgatgtaaagaacatgataagtacctggatgcagagtaaccactcatgtcactgggccaaaggcctccgattcatgcagatggtgaggaatcaggctttcgacgtttccttgcagcaaagtccatttgaggcaatgtttggctataaagccaaatttgggctatattcctcaaacttgccccgggaaactgtggctactttacaaacggaagaagagctagaaattgctgaagaacagctagaaaatagcctttggatcaggcaggaagaaagggctgagattggagcagacagatctgatatggacgatgacatggatcccactcctgaagcttcagaacccagcacctcacaagggacttccggtctcctctgctggtgaacagatggctgctgggtggacagtcacaggtgtctctctgagcatagtcatctgagaactgttgccagaggccccagaggaaaagattgaaggctgcactctcaggtcaagttgtacatggcagtccttgctcaaaaagacaaaagttcaggtctgtgtatttattcttagggctgccataaaaaattaccacaacctggccgggcgcagcgctcatgcccgtaatcccagcactttggtaggccaaggtgggcgggtcacttgagatcaggagttcaagactagcctggccaacatgatgaaaccctgtctctactgaaaatatagaaattagccaggcttggagctgtgtgcctgtaatcccagctaaccaggaggctgaggcaggagaatcacttgaacccaggaggcagaggttgcagtgagccgagaccatgccactgcactccggcctgggtgacaaagcaagactctgtctcaaaaaaaaaaaaaaaaaa

SEQ ID NO: 4505 - DNA, 3016 bp, Homo sapiens
ttcctcaatgcgcgtgcgcaatgggccacagaaccgccatgccggaaccgcgcgggtcgtcgcagctgcgggtgaacgcggcgtttgccgcgcggtacaaccgctaccgggagcgcgaggaactgcagcggctgaaggatcgctacggggaccgagacagcagcagcgactccagctccgagtcggactcaagcgacgagcgcgtggaatttgatccccagcaggagcgggacttttacaaaacgctctccttgttgaagaagaaggacccccgcatttatcagaaagatgccaccttctataacagaacagcatcgtcatcagacagtgaggaggacccagaagccttggagaagcagaagaaagtgcggcccatgtacctgaaggactacgagaggaaggttatcttggagaaggcaggcaaatatgttgatgaggagaactcagacggggagacttccaatcacagactccaggagacatcgtcgcaaagttatgtggaggaacagaaacagctcaaggaaagcttccgggcatttgtggaggacagtgaggacgaggacggcgctggggagggcggctccagtttgctgcagaaacgtgccaaaaccaggcaggagaaggcccaggaggaggccgactacatcgagtggctgaagggacagaaagagattcggaacccagattccctgaaggaactgacgcatctcaaggaatactggaacgaccctgagttggatgaaggggagcggttcctgcgggattacatcctcaacaaacgctatgaggaggaggaagaggaggaggaagatgaagaggaaatggaggaagaggagggggtccacggtcccccagtccagctggctgtggacgactcctcagacgaaggggagctgtttctgaagaaacaggaggactttgaacagaagtacaatttccgtttcgaggagccggactcagcatcggtcaagacctacccacgcagcatcgcgtcctccgtgcgccgtaaggatgagcgcagaaaggagaagagggaagagactcgggagcgaaagaagagggagaaagcaaagaagcaggaagagctcaagcagctgaagaacctgaagaggaaggagattctggccaagctggagaagctgcggaaagtaacaggcaacgagatgctgggcctcgaggagggggaccttgaagacgacttcgaccctgcccagcacgaccagctcatgcagaagtgctttggggacgagtactacggggccgtggaggaggagaagccacaatttgaggaagaagaagggcttgaagacgactggaactgggacacgtgggacgggcctgagcaggagggagactggagccagcaggagctgcactgtgaggaccccaacttcaacatggacgccgactacgaccccagccagccgaggaagaaaaagcgcgaggcccccttgacgggcaagaagaagcgcaagtcgcccttcgccgcggccgtggggcaggagaagcccgtgtttgaacccggggacaagacgttcgaggagtacctggatgagtattaccggctggactacgaggacatcatcgacgacctgccctgtcgcttcaagtaccgcacagtggtgccctgtgactttggcctcagcactgaggagatcctcgctgctgacgataaggagctgaaccggtggtgctccctaaagaagacctgcatgtacaggtcagagcaggaggagctgcgggacaagcgggcgtacagccagaaggcccagaactcatggaaaaagcggcaggtcttcaagtcactctgccgagaagaggcagagacacctgcggaagccacagggaagccacagagagatgaagccggcccacagaggcagctgccagcccttgatggcagcttgatggggccggagagtcccccagcacaggaagaggaagcccctgtatcaccccacaagaagccagccccccagaagcggaggagggccaagaaggcacggctgctgggccccactgtgatgcttggtggatgcgagttcagccgccagagactgcaggcctttggcctcaaccccaaacggctgcacttccgccagctgggccggcagcggaggaaacaacaggggcccaagaacagctcctgagcaccagggagcaggcaggggcctcaggctcctctcctcaaatcaagccctggacaggtctcgcacccacaagtactatctgctgcagagatcctctcatctgtggccaggcacgcctgtaatcccagcactttgggaggccgaggtgaaaggatcacttgagcccaggaattggagaccagcgtgggcaacttagcgagactccatctctacaaaatgtggtgacacatgcctgtagtcccagctactcaggaggctggggaaggaagatcacttaaggccatgagtttgaggctacagagagctatgattgcaccactgcactccagcctgggcaacaaagcaagaccctgtctcttgaaaaaaaaaaaaaaattaaaaaacacgtgtagctgtgggtaaggaagtcgtcccattttatggatgtggaaactgaggctgacttaaacttcccgtgacttggagctctcacctcgagacacctcccagaccccacatcccctcagaacgctgcgcccagccacacccacgatcaagttacacagctttattggcccccagcagccacagttcccccaagggggctttgggacagggagggcccgggcgtccagtgcaaactacagtacgtgagtcaggccctgaggggggtgcccggggtcctccttccctaccctgccaggagggccccgctggtgggagacaggtgtatgggctctgtgggctctgtccctggctgaatggccccagactggttgcagctgggcttgaggggctgacaacaggaagtaccatcatcactgccagagctcaagatcccacacccgacatgacataaataaaaaaataaatagtgttgtatcttt

SEQ ID NO: 4506 - DNA, 2104 bp, Homo sapiens
aatgcgcgtgcgcaatgggccacagaaccgccatgccggaaccgcgcgggtcgtcgcagctgcgggtgaacgcggcgtttgccgcgcggtacaaccgctaccgggagcgcgaggaactgcagcggctgaaggatcgctacggggaccgagacagcagcagcgactccagctccgagtcggactcaagcgacgagcgcgtggaatttgatccccagcaggagcgggacttttacaaaacgctctccttgttgaagaagaaggacccccgcatttatcagaaagatgccaccttctataacagaacagcatcgtcatcagacagtgaggaggacccagaagccttggagaagcagaagaaagtgcggcccatgtacctgaaggactacgagaggaaggttatcttggagaaggcaggcaaatatgttgatgaggagaactcagacggggagacttccaatcacagactccaggagacatcgtcgcaaagttatgtggaggaacagaaacagctcaaggaaagcttccgggcatttgtggaggacagtgaggacgaggacggcgctggggagggcggctccagtttgctgcagaaacgtgccaaaaccaggcaggagaaggcccaggaggaggccgactacatcgagtggctgaagggacagaaagagattcggaacccagattccctgaaggaactgacgcatctcaaggaatactggaacgaccctgagttggatgaaggggagcggttcctgcgggattacatcctcaacaaacgctatgaggaggaggaagaggaggaggaagatgaagaggaaatggaggaagaggagggggtccacggtcccccagtccagctggctgtggacgactcctcagacgaaggggagctgtttctgaagaaacaggaggactttgaacagaagtacaatttccgtttcgaggagccggactcagcatcggtcaagacctacccacgcagcatcgcgtcctccgtgcgccgtaaggatgagcgcagaaaggagaagagggaagagactcgggagcgaaagaagagggagaaagcaaagaagcaggaagagctcaagcagctgaagaacctgaagaggaaggagattctggccaagctggagaagctgcggaaagtaacaggcaacgagatgctgggcctcgaggagggggaccttgaagacgacttcgaccctgcccagcacgaccagctcatgcagaagtgctttggggacgagtactacggggccgtggaggaggagaagccacaatttgaggaagaagaagggcttgaagacgactggaactgggacacgtgggacgggcctgagcaggagggagactggagccagcaggagctgcactgtgaggaccccaacttcaacatggacgccgactacgaccccagccagccgaggaagaaaaagcgcgaggcccccttgacgggcaagaagaagcgcaagtcgcccttcgccgcggccgtggggcaggagaagcccgtgtttgaacccggtgaggcccaggtgggcaggccgtgggtaggcagggggcaccgcggggcctggcatagcccagcagcctggctctgtctcgagcaggggacaagacgttcgaggagtacctggatgagtattaccggctggactacgaggacatcatcgacgacctgccctgtcgcttcaagtaccgcacagtggtgccctgtgactttggcctcagcactgaggagatcctcgctgctgacgataaggagctgaaccggtggtgctccctaaagaagacctgcatgtacaggtcagagcaggaggagctgcgggacaagcgggcgtacagccagaaggcccagaactcatggaaaaagcggcaggtcttcaagtcactctgccgagaagaggcagagacacctgcggaagccacagggaagccacagagagatgaagccggcccacagaggcagctgccagcccttgatggcagcttgatggggccggagagtcccccagtgtgatgcttggtggatgcgagttcagccgccagagactgcaggcctttggcctcaaccccaaacggctgcacttccgccagctgggccggcagc

SEQ ID NO: 4507 - DNA, 1714 bp, Homo sapiens
gcgtacaacccggaagttggcgcagcgcggttgccaatggtcgctccctgagaggatgccgctcgtggtgttttgcgggctgccgtacagcggcaagagccggcgtgctgaagagttgcgcgtggcgctggctgccgagggccgcgcggtgtacgtggtggacgacgcagctgtcctgggcgcagaggacccagcggtgtacggcgattctgcccgtgagaaggcattgcgtggagctctgcgagcctccgtggaacggcgcctgagtcgccacgacgtggtcatcctggactcgcttaactacatcaaaggtttccgttacgagctctactgcctggcacgggcggcgcgcaccccgctctgcctggtctactgcgtacggcccggcggcccgatcgcgggacctcaggtggcgggcgcgaacgagaaccctggccggaacgtcagtgtgagttggcggccacgcgctgaggaggacgggagagcccaggcggcgggcagcagcgtcctcagggaactgcatactgcggactctgtagtaaatggaagtgcccaggccgacgtacccaaggaactggagcgagaagaatccggggctgcggagtctccagctcttgtgactccggattcagagaaatctgcaaagcatgggtccggtgccttttactctcccgaactcctggaggccctaacgctgcgctttgaggctcccgattctcggaatcgctgggaccggcctttattcactttggtgggcctagaggagccgttgcccctggcggggatccgctctgccctgtttgagaaccgggccccaccaccccatcagtctacgcagtcccagcccctcgcctccggcagctttctgcaccagttggaccaggtcacgagtcaagtactggccggattgatggaagcgcagaagagcgctgtccccggggacttgctcacgcttcctggtaccacagagcacttgcggtttacccggcccttgaccatggcagaactgagtcgccttcgtcgccagtttatttcgtacactaaaatgcatcccaacaatgagaacttgccgcaactggccaacatgtttcttcagtatttgagccagagcctgcactgaccagaggaggtaggggggaagccatggcttctgatctccactccactttatttctctgggaaaaataggctgcaggtctccagagcatatcgatgcagtactgtactagagctgttgtgactgattcactcaaactttcctgcatacccctgtgccaggccttgggtttacagcataagttcagactaaagagaatggagaactattgtggtgcaacctggcaaatccctcagaggacagagctaaggtggacagggattacctagattggatcctacttgggctatcacagagcattgaccattggcttccctcatctgaggcgtgggagagcagactggatagatgagaattgttttaaaacaattgtgaacagaaactgaagatggtacagttctacatctgcacctgcccttttttcataccacaaaagtattttttgagtactgtactgactttttgctagtttctattctgggaccgagttcacagataaatccattggtttgtatccttgagaaactttgtttttgtggaagtaagaaagttatctactagattatttcctctaataaaatcttttaaaatagtcta

SEQ ID NO: 4508 - DNA, 1465 bp, Homo sapiens
ctcgcggctggccggctcgggattccgggctttcttcccgagaccgcgtcccccagctgggccgaaggtggacgctcaggggctggaggctcagcggaatcccctgcgttcagtagccccgctctcccctgtcccgaaggattactctgcccctcagcggttccagtgccctcaaagcaatctgtctctgaagtactggctatcttctgagcgtgtgccagaagatccagctttgttgaaaagcgaagccgttagtcccttaatacaaaggatcagggatagcagaaatgaaagtataatggaagcagctggaggattccaggtccactttcacccaagtaatggagacggaaggttcatcgaaacttcttcagctgcagatctagaagtcattagctattctagcaaagtatctgtcacagaaaggtgcttcataaaggtctgcactgtgctcttttgacctgtgtcttcaagcatgtgctgtcataacagattaaagatgactgaaaattatctgccactcattgcgtgaaaggtgggatctgtagacctccctcttgaatttgggagggttctgtgactgctgtgaccaatgaatatggcagaagtgacgctttgccaacttctgggtccaggctatacgagacaggcagttccactcactgtctcttagatccatgtaaaaagttcatctaccctgctggaaaaaccatgtagagaggccctgagactacattgggtgggagaggggctcagctgcaccatcttccaactgtccccatcaagatgacagaaatataaatgaagccttcttgaactccagaccatccatgctacaagctaaatgccaccaagcgaccccagttaataccatgtggagcaaaaatatcacttaaccaagcactgcctgagtttctgaccccacagaattctgaccccatacaaataaaataatttttgtaattttttataattcgtcatgtaatagataaatggaacagccttcttccagtcttttaaatagctgcaagaaatcttattcaagcagaaggaagtttctactttgttcatacagtctcaagacatccctggagcctttcaagggaaatttgggcagaagtaggtagagaggtaaagctattatgtaacattacttaacatgattaaaaccaccttaatgtctcccatcctcaaaggctgccagtgaattggaaattaatggattaaatgaggacagagaaactagtatttgtgcatatgcactgtgccaggtatttaacgtatcttagctcatgtggtcttcgaaacaaccccatattgtagtatcaggctcacacgggtaactaactagtgcaaagacacaaggctcacaaactgctacttgaccctagagctctttgactccgattcccatgtacgtgccccaataccatgttgactcccaaggtgtaaatcttcaggtata

SEQ ID NO: 4509 - DNA, 1354 bp, Homo sapiens
ccacgcgctccggtactcgctgctcgcggctggccggctcgggattccgggctttcttcccgagaccgcgtcccccagctgggccgaaggtggacgctcaggggctggaggctcagcggaatcccctgcgttcagtagccccgctctcccctgtcccgaagatcagggatagcagaaatgaaagtataatggaagcagctggaggattccaggtccactttcacccaagtaatggagacggaaggttcatcgaaacttcttcagctgcagatctagaagtcattagctattctagcaaagtatctgtcacagaaaggtgcttcataaaggtctgcactgtgctcttttgacctgtgtcttcaagcatgtgctgtcataacagattaaagatgactgaaaattatctgccactcattgcgtgaaaggtgggatctgtagacctccctcttgaatttgggagggttctgtgactgctgtgaccaatgaatatggcagaagtgacgctttgccaacttctgggtccaggctatacgagacaggcagttccactcactgtctcttagatccatgtaaaaagttcatctaccctgctggaaaaaccatgtagagaggccctgagactacattgggtgggagaggggctcagctgcaccatcttccaactgtccccatcaagatgacagaaatataaatgaagccttcttgaactccagaccatccatgctacaagctaaatgccaccaagcgaccccagttaataccatgtggagcaaaaatatcacttaaccaagcactgcctgagtttctgaccccacagaattctgaccccatacaaataaaataatttttgtaattttttataattcgtcatgtaatagataaatggaacagccttcttccagtcttttaaatagctgcaagaaatcttattcaagcagaaggaagtttctactttgttcatacagtctcaagacatccctggagcctttcaagggaaatttgggcagaagtaggtagagaggtaaagctattatgtaacattacttaacatgattaaaaccaccttaatgtctcccatcctcaaaggctgccagtgaattggaaattaatggattaaatgaggacagagaaactagtatttgtgcatatgcactgtgccaggtatttaacgtatcttagctcatgtggtcttcgaaacaaccccatattgtagtatcaggctcacacgggtaactaactagtgcaaagacacaaggctcacaaactgctacttgaccctagagctctttgactccgattcccatgtacgtgccccaataccatgttgactcccaaggtgtaaatcttcaggtat

SEQ ID NO: 4510 - DNA, 1461 bp, Homo sapiens
gtctaagccccgccctttcctgtcgtgacttaacgcacgcaagcggctccagggtacgtccccgccacgcgcgctcgcaggatcggtgcgtggtgacgtttcgccggcgcgggcgccatcccggaagcgcgagcaaggccgccagatgtgcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccagcctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaagtacaccta

SEQ ID NO: 4511 - DNA, 1496 bp, Homo sapiens
gtctaagccccgccctttcctgtcgtgacttaacgcacgcaagcggctccagggtacgtccccgccacgcgcgctcgcaggatcggtgcgtggtgacgtttcgccggcgcgggcgccatcccggaagcgcgagcaaggccgccagatgtgcaggtgccgccgctaccgacgccggggccgagtttggggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccagcctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaagtacaccta

SEQ ID NO: 4512 - DNA, 1592 bp, Homo sapiens
gtctaagccccgccctttcctgtcgtgacttaacgcacgcaagcggctccagggtacgtccccgccacgcgcgctcgcaggatcggtgcgtggtgacgtttcgccggcgcgggcgccatcccggaagcgcgagcaaggccgccagatgtgcaggagggtcagtgctgtagcccctcctaccctggctgctccgggaagtccctgcctgccattacggtcatctgtgtgccagcaaaactgggaacctcagaaccatctggattgctggggcccacaggttggctgcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccagcctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaagtacaccta

SEQ ID NO: 4513 - DNA, 949 bp, Homo sapiens
ggcgaccacggtgtcttcaaaagccccgtcagggttggcttcctggggccggaccgactgtgggtcagtttgcaccagcgctctggaatcgagttacgcgcgaaagggcagagtttctggaggaaaccgcagcctctcaaccgctgaccgggtctcagaaggcccccggcagggccgcttggcgggaactgaccacgcgccagtcaggctctccagggacctgcgcaggcgcgtgtgggcggagtcgtgcgcagggggcggggcttcgggaaggagccacagagagggcggggcgtaggacctgcgcttcgggggtggagtcggagcggcgcggcggcggtcatgcgggacgcggatgcagacgcaggcggaggcgctgacggcggggatggccggggtggccacagctgccgcgggggcgtggacacagccgcagctccggccggtggagctcccccagcgcacgcgccaggtccgggcagagacgccgcgtctgcggccagggggtcacgaatgcggccgcacatattcaccctcagcgtgcctttcccgacccccttggaggcggaaatcgcccatgggtccctggcaccagatgccgagccccaccaaagggtggttgggaaggatctcacagtgagtggcaggatcctggtcgtccgctggaaagctgaagactgtcgcctgctccgaatttccgtcatcaactttcttgaccagctttccctggtggtgcggaccatgcagcgctttgggccccccgtttcccgctaagcctggcctgggcaaatggagcgaggtcccactttgcgtctccttgtaggcagtgcgtccatccttccctagggcaggaattcccacagttgctactttcctgggagggcctcatgttttatctggttcttaaatgtttgttactacagaaaataaaactgcgctactattccaa

SEQ ID NO: 4514 - DNA, 5000 bp, Homo sapiens
tgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaattgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatc

SEQ ID NO: 4515 - DNA, 5113 bp, Homo sapiens
tcgcagacgcgctcgggcggcgggtccgaggccggcgtgcgcggaggctgggcgggcagcccgagcggtggccgcagcgcagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacaggtccctggagagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatcaaga

SEQ ID NO: 4516 - DNA, 1577 bp, Homo sapiens
ggggcaaggcgagtgtgtgtccttatcctagcaattggggcgcgggcctgtgagccagttggagttgcggcggcgggaacgattgggctgagcagaggacgacatgttgcttttcgtggagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggtaagaaaataaagtacctgaaaacctttgataataatgtgatcatcctgaataattgaagaacatgatcttcataataattaaatgagcatttaattattggtatatggttatattaaataaatacgttattttcagaa

SEQ ID NO: 4517 - DNA, 3778 bp, Homo sapiens
gggtaaagctcctcggcctcggcgtgctgcgcctccgcggctgccctgcgccagaattcggttccctcaaaattataaaggcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagaggttggaagcgagatagagaaaaaagggatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcattgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagagtctgccccaaattctccaagaattggaagcccattgagcccaaagaaaaacagtgaaacaagtattcttcaagcaatgtctagaggtttgtctaccagtttgcctgacttggactcagaaccttggatagaagttaaaaaaagacatcagccagccccagtgaaattgagggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcctggaggagatcgaacaggcacccacatgtctcgggcaaaaatcacatctgaacttgctaaagttatcaatgatggcttatactattatgaacaggatctatggatggaagaagatgaaaacaaacacacagccataaagcaagaagttgagaactttaagaagctaaatctcattagtaaagagcagtttgaaaacctaacacctgaacttccttttgagccaaaccaagaagttcctgtagcaccttcacagtccaggcaagatttgactgatgaattagctcagaagttatttgatgtttcagaaataacttcagcagcaatggttcattcgttgcctacagcagttccagaatctcctagaattcatcctacaagaacacccaaaacacctcgaacacctaggttacaagatcctaacaaaacaccaagattttatcctgttgttaaagaaccaaaagccattgatgtaaagagtccaagaaagagaaaaacaaggcatagcacaaatccccctctagagtgtcatgttggttgggtaatggattccagagaccgtgggccaggaacatcctctgtcagcacttcaaatgcttcaccttcagaaggcgcaccactagcaggaagttatggatgtactcctcattcattcccaaagttccagcatccttctcatgaacttttgaaggaaaatggctttacccaacaagtgtaccacaagtatcgtcgaagatgcctaagtgagagaaaacgcttgggaattggtcagtcccaagaaatgaataccctctttcgtttctggtcctttttcctcagagatcacttcaataaaaaaatgtatgaggaatttagacaacttgcttgggaagatgcaaaagaaaattacaggtatgggttagaatgtctgttcaggttttatagttatggactggaaaaaaaattcaggcgagaaatttttcaggatttccaagaagaaaccaaaaaagactacgaatctggtcagctgtatggactagaaaagttttgggcttatttgaaatattctcaatctaagacacagtctattgacccaaaacttcaggaatacctctgtagttttaagaggttagaagacttccgtgttgatccccctattagtgatgaatttggaagaaaaagacattcctctacttctggtgaggagagtaatcgtcatagacttccacctaattcctctacaaagccaccaaatgctgctaaacctacatctaccagtgagcttcaggtaccaataaactctcccagaaggaatatttcaccggagtccagtgacaattcacattaaacagtgctgcctgtgtcctgtggtctcaagaaatggtgaaatgcctgagaaatagactcttatgaaagttctttgtccttgaagtcaacatttacatcagtatttatttggggaaaatcttctggtgtttaattgtgataataagaaagaagaaaaagaaagaaaagtggtagcattttttctaacaagataaattctaaaaatgttttccctgatttcacaaacaaggatagtcttggtgaccttttatagagatcttctagtaatgtattttgatctcagatttctttttcaaagccatggttttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgtattggtgtggagttttctgaattggctataagctgattacatattagaggtttatttttatgattctatataaacgtgcacgagtaatttaaaacctgcattgggattgattggaatattgtcctaaattaattaaatcttgcactgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtgagatttaaaaaaataaagcacttattctg

SEQ ID NO: 4518 - DNA, 4891 bp, Homo sapiens
gctctcgggccgcccctcttcgccgtctccacgcctccgcgggcagttaccagctttggctgctcgcgcctccccaactcgggtaaagctcctcggcctcggcgtgctgcgcctccgcggctgccctgcgccagaattcggttccctcaaaattataaaggcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagggatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcattgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagagtctgccccaaattctccaagaattggaagcccattgagcccaaagaaaaacagtgaaacaagtattcttcaagcaatgtctagaggtttgtctaccagtttgcctgacttggactcagaaccttggatagaagttaaaaaaagacatcagccagccccagtgaaattgagggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcctggaggagatcgaacaggcacccacatgtctcgggcaaaaatcacatctgaacttgctaaagttatcaatgatggcttatactattatgaacaggatctatggatggaagaagatgaaaacaaacacacagccataaagcaagaagttgagaactttaagaagctaaatctcattagtaaagagcagtttgaaaacctaacacctgaacttccttttgagccaaaccaagaagttcctgtagcaccttcacagtccaggcaaggaggtgttcaaggagtgcttcacattcccaagaaagatttgactgatgaattagctcagaagttatttgatgtttcagaaataacttcagcagcaatggttcattcgttgcctacagcagttccagaatctcctagaattcatcctacaagaacacccaaaacacctcgaacacctaggttacaagatcctaacaaaacaccaagattttatcctgttgttaaagaaccaaaagccattgatgtaaagagtccaagaaagagaaaaacaaggcatagcacaaatccccctctagagtgtcatgttggttgggtaatggattccagagaccgtgggccaggaacatcctctgtcagcacttcaaatgcttcaccttcagaaggcgcaccactagcaggaagttatggatgtactcctcattcattcccaaagttccagcatccttctcatgaacttttgaaggaaaatggctttacccaacaagtgtaccacaagtatcgtcgaagatgcctaagtgagagaaaacgcttgggaattggtcagtcccaagaaatgaataccctctttcgtttctggtcctttttcctcagagatcacttcaataaaaaaatgtatgaggaatttagacaacttgcttgggaagatgcaaaagaaaattacaggtatgggttagaatgtctgttcaggttttatagttatggactggaaaaaaaattcaggcgagaaatttttcaggatttccaagaagaaaccaaaaaagactacgaatctggtcagctgtatggactagaaaagttttgggcttatttgaaatattctcaatctaagacacagtctattgacccaaaacttcaggaatacctctgtagttttaagaggttagaagacttccgtgttgatccccctattagtgatgaatttggaagaaaaagacattcctctacttctggtgaggagagtaatcgtcatagacttccacctaattcctctacaaagccaccaaatgctgctaaacctacatctaccagtgagcttcaggtaccaataaactctcccagaaggaatatttcaccggagtccagtgacaattcacattaaacagtgctgcctgtgtcctgtggtctcaagaaatggtgaaatgcctgagaaatagactcttatgaaagttctttgtccttgaagtcaacatttacatcagtatttatttggggaaaatcttctggtgtttaattgtgataataagaaagaagaaaaagaaagaaaagtggtagcattttttctaacaagataaattctaaaaatgttttccctgatttcacaaacaaggatagtcttggtgaccttttatagagatcttctagtaatgtattttgatctcagatttctttttcaaagccatggttttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgtattggtgtggagttttctgaattggctataagctgattacatattagaggtttatttttatgattctatataaacgtgcacgagtaatttaaaacctgcattgggattgattggaatattgtcctaaattaattaaatcttgcactgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtgagatttaaaaaaataaagcacttattctgaattttttgaattgatttttaattatttttatttagaatatagttgaaaagctgtaatattcagttttgctagtaaaagaccatttttttgtgtgaatgaagtttcaattataaacttacattcactttattgagcactacataatttacagatattttgttgtattggcaaaagcaagtggtttccatatgctaaattaattgtattttctttttgagcagattggatatcttgttcttataaattataatattgaaatacatataatctttggatggatgggctgttaatttgtaaataggttttcattaagttatttctcatgataagtaataatcagcagttttataatatttactatttggagggtcattttgatgctttaaattgcagaaatagtcaaatttgaatattcagaaaataaatttatttagatatattgtaaagagggtgcaaaacaagcaatgggttagaataatagatcttcaagtcttttcttaaatggggtatgtagttccagcttttcagtgagaaatttccaaaccgtgcttattagctttaaatggtctcttgaaatgatcataaatttttctcagtgtcctttttgtgttgaacacatatatctgaaacctgtatttaaccagatatttctactcaactgaatatacaagtgtaaatttgattggaaaattgtatattataaatgaaaatacaataatcaggagttttgtggtttgtattaattagtagttttatcatatttttattataaaagtaatacatgtacattgggaaatttagaaaagcacaaagaagaaaataaagtacttgttataaaaagaagaaaaaccaaaa

SEQ ID NO: 4519 - DNA, 2720 bp, Homo sapiens
gggtaaagctcctcggcctcggcgtgctgcgcctccgcggctgccctgcgccagaattcggttccctcaaaattataaaggcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagggatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcattgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagagtctgccccaaattctccaagaattggaagcccattgagcccaaagaaaaacagtgaaacaagtattcttcaagcaatgtctagaggtttgtctaccagtttgcctgacttggactcagaaccttggatagaagttaaaaaaagacatcagccagccccagtgaaattgagggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcctggaggagatcgaacaggcacccacatgtctcgggcaaaaatcacatctgaacttgctaaagttatcaatgatggcttatactattatgaacaggatctatggatggaagaagatgaaaacaaacacacagccataaagcaagaagttgagaactttaagaagctaaatctcattagtaaagagcagtttgaaaacctaacacctgaacttccttttgagccaaaccaagaagttcctgtagcaccttcacagtccaggcaaggaggtgttcaaggagtgcttcacattcccaagaaagatttgactgatgaattagctcagaagttatttgatgtttcagaaataacttcagcagcaatggttcattcgttgcctacagcagttccagaatctcctagaattcatcctacaagaacacccaaaacacctcgaacacctaggttacaagatcctaacaaaacaccaagattttatcctgttgttaaagaaccaaaagccattgatgtaaagagtccaagaaagagaaaaacaaggcatagcacaaatccccctctagagtgtcatgttggttgggtaatggattccagagaccgtgggccaggaacatcctctgtcagcacttcaaatgcttcaccttcagaaggcgcaccactagcaggaagttatggatgtactcctcattcattcccaaagttccagcatccttctcatgaacttttgaaggaaaatggctttacccaacaagtgtaccacaagtatcgtcgaagatgcctaagtgagagaaaacgcttgggaattggtcagtcccaagaaatgaataccctctttcgtttctggtcctttttcctcagagatcacttcaataaaaaaatgtatgaggaatttagacaacttgcttgggaagatgcaaaagaaaattacaggtatgggttagaatgtctgttcaggttttatagttatggactggaaaaaaaattcaggcgagaaatttttcaggatttccaagaagaaaccaaaaaagactacgaatctggtcagctgtatggactagaaaagttttgggcttatttgaaatattctcaatctaagacacagtctattgacccaaaacttcaggaatacctctgtagttttaagaggttagaagacttccgtgttgataatcaccatgatcgattacttctgctcatcataaacatctag

SEQ ID NO: 4520 - DNA, 2151 bp, Homo sapiens
gcctccccaactcgggtaaagctcctcggcctcggcgtgctgcgcctccgcggctgccctgcgccagaattcggttccctcaaaattataaaggcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagggatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcattgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagtcagggtgatgatcttctgaagctcttggatgtcatttgatcggaatatgcagtggaataggtgactcactgaaatgcctttataaatactggaacaaatcctgctgcaaaaatgaaagcgatcagactgtcttctgttcaagaatgtctattcccacctcttggtggaggaagttgggccaacactgcagtggagataaccacctttgcgataatgagagacagaccagaggactgctactctttttataggagctgcctatttctgtgtaattggcctgggctgcatgggctgcttttattcatggtgggaaagttaattattattattctggaaataccgcaagattatgttttctgtttccagggttatgtacttgtgtccagatgaataaagcagaaaaagaggggattgagtagcatttcccagattcttaagtactttgctattcgatttgcctttcagtgtagtgtacattgtaaaactcagatattgtcatgatgtttcacttggacataagacttattaatgtggtcacttaaggggtaaggaatttaagaactggatgaggttatttcttcctttactcttcaaaatgtatttttgatacatcagtatgagaggacgtcccatcaacaaagcatcgatgatggacagtctcacactatttttatcatatgtttctttgtcagccttctgcttctaatcccagtaagcaacttggacaggcattttaaaagctgaagaaaagtgacattattttagctagtggtttttaatttattttttgttaagatataatgggtgattatataagttagatttatttatgatatcaacttgggtccaagatgatagttttagctagcttatgaacattgggttcacaaggcattgggtaagttagataaaatagcatatactttctctgcagggtaggtaagataggtcagtcaagttggtaatgcctgtccattaaccatttatgcatactaataaaattataagaataaaatca

SEQ ID NO: 4521 - DNA, 1819 bp, Homo sapiens
gggtaaagctcctcggcctcggcgtgctgcgcctccgcggctgccctgcgccagaattcggttccctcaaaattataaaggcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagggatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcattgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagagtctgccccaaattctccaagaattggaagcccattgagcccaaagaaaaacagtgaaacaagtattcttcaagcaatgtctagaggtttgtctaccagtttgcctgacttggactcagaaccttggatagaagttaaaaaaagacatcagccagccccagtgaaattgagggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcctggaggagatcgaacaggcacccacatgtctcgggcaaaaatcacatctgaacttgctaaagttatcaatgatggcttatactattatgaacaggatctatggatggaagaagatgaaaacaaacacacagccataaaggtaattgtttctggccaacatctttctactgatgctttgttttgattgtatgttgctgtttatattttctcaaacttgaggctctattttatgaaatgttgaatataaatacattgtatttaacttgaaaaattcctggaaatatacctgataattaccacctg

SEQ ID NO: 4522 - DNA, 2707 bp, Homo sapiens
gggtaaagctcctcggcctcggcgtgctgcgcctccgcggctgccctgcgccagaattcggttccctcaaaattataaaggcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagggatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcattgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacaggtaacatcttttcttctagagcaaacgatgtaacagtgggttatttggtccaatttacttacttatttatttattttcagtttatttagatttgataggaaaattaaagctaactgaaagacttttgagtcccattttgtattcatattgcctcactcacagagttacaaattaaataaggatttaagaattatgaggaaagctgtcttatgtttcttgttcttaaattatatgtgtactttgtcatgtatggagtttctatcttttatttttactaaataactatagatatgtatcgttttcccctgtaaaattggaatagtatgattggattattctaaaaaggtcttatactcaagagtggggtagtcttcctttaattttgttaccaatacgctttaatcttgtcttggaaagataaaatgacctgcattctaaattagaattggggttctgtttaatttggttgtgtttagaatttccaaaagatttaatgttaataattttttcctggatcatttttaagacattccctcttgggaaaaaatgtgtgcttaaacttttttcagtcagggtgatgatcttctgaagctcttggatgtcatttgatcggaatatgcagtggaataggtgactcactgaaatgcctttataaatactggaacaaatcctgctgcaaaaatgaaagcgatcagactgtcttctgttcaagaatgtctattcccacctcttggtggaggaagttgggccaacactgcagtggagataaccacctttgcgataatgagagacagaccagaggactgctactctttttataggagctgcctatttctgtgtaattggcctgggctgcatgggctgcttttattcatggtgggaaagttaattattattattctggaaataccgcaagattatgttttctgtttccagggttatgtacttgtgtccagatgaataaagcagaaaaagaggggattgagtagcatttcccagattcttaagtactttgctattcgatttgcctttcagtgtagtgtacattgtaaaactcagatattgtcatgatgtttcacttggacataagacttattaatgtggtcacttaaggggtaaggaatttaagaactggatgaggttatttcttcctttactcttcaaaatgtatttttgatacatcagtatgagaggacgtcccatcaacaaagcatcgatgatggacagtctcacactatttttatcatatgtttctttgtcagccttctgcttctaatcccagtaagcaacttggacaggcattttaaaagctgaagaaaagtgacattattttagctagtggtttttaatttattttttgttaagatataatgggtgattatataagttagatttatttatgatatcaacttgggtccaagatgatagttttagctagcttatgaacattgggttcacaaggcattgggtaagttagataaaatagcatatactttctctgcagggtaggtaagataggtcagtcaagttggtaatgcctgtccattaaccatttatgcatactaataaaattataagaataaaatca

SEQ ID NO: 4523 - DNA, 3845 bp, Homo sapiens
gggtaaagctcctcggcctcggcgtgctgcgcctccgcggctgccctgcgccagaattcggttccctcaaaattataaaggcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagggatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcattgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagagtctgccccaaattctccaagaattggaagcccattgagcccaaagaaaaacagtgaaacaagtattcttcaagcaatgtctagaggtttgtctaccagtttgcctgacttggactcagaaccttggatagaagttaaaaaaagacatcagccagccccagtgaaattgagggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcctggaggagatcgaacaggcacccacatgtctcgggcaaaaatcacatctgaacttgctaaagttatcaatgatggcttatactattatgaacaggatctatggatggaagaagatgaaaacaaacacacagccataaagcaagaagttgagaactttaagaagctaaatctcattagtaaagagcagtttgaaaacctaacacctgaacttccttttgagccaaaccaagaagttcctgtagcaccttcacagtccaggcaaggaggtgttcaaggagtgcttcacattcccaagaaagatttgactgatgaattagctcagaagttatttgatgtttcagaaataacttcagcagcaatggttcattcgttgcctacagcagttccagaatctcctagaattcatcctacaagaacacccaaaacacctcgaacacctaggttacaagatcctaacaaaacaccaagattttatcctgttgttaaagaaccaaaagccattgatgtaaagagtccaagaaagagaaaaacaaggcatagcacaaatccccctctagagtgtcatgttggttgggtaatggattccagagaccgtgggccaggaacatcctctgtcagcacttcaaatgcttcaccttcagaaggcgcaccactagcaggaagttatggatgtactcctcattcattcccaaagttccagcatccttctcatgaacttttgaaggaaaatggctttacccaacaagtgtaccacaagtatcgtcgaagatgcctaagtgagagaaaacgcttgggaattggtcagtcccaagaaatgaataccctctttcgtttctggtcctttttcctcagagatcacttcaataaaaaaatgtatgaggaatttagacaacttgcttgggaagatgcaaaagaaaattacaggtcagctgtatggactagaaaagttttgggcttatttgaaatattctcaatctaagacacagtctattgacccaaaacttcaggaatacctctgtagttttaagaggttagaagacttccgtgttgatccccctattagtgatgaatttggaagaaaaagacattcctctacttctggtgaggagagtaatcgtcatagacttccacctaattcctctacaaagccaccaaatgctgctaaacctacatctaccagtgagcttcaggtaccaataaactctcccagaaggaatatttcaccggagtccagtgacaattcacattaaacagtgctgcctgtgtcctgtggtctcaagaaatggtgaaatgcctgagaaatagactcttatgaaagttctttgtccttgaagtcaacatttacatcagtatttatttggggaaaatcttctggtgtttaattgtgataataagaaagaagaaaaagaaagaaaagtggtagcattttttctaacaagataaattctaaaaatgttttccctgatttcacaaacaaggatagtcttggtgaccttttatagagatcttctagtaatgtattttgatctcagatttctttttcaaagccatggttttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgtattggtgtggagttttctgaattggctataagctgattacatattagaggtttatttttatgattctatataaacgtgcacgagtaatttaaaacctgcattgggattgattggaatattgtcctaaattaattaaatcttgcactgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtgagatttaaaaaaataaagcacttattctg

SEQ ID NO: 4524 - DNA, 1593 bp, Homo sapiens
agaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagggatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcattgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagagtctgccccaaattctccaagaattggaagcccattgagcccaaagaaaaacagtgaaacaagtattcttcaagcaatgtctagaggtttgtctaccagtttgcctgacttggactcagaaccttggatagaagttaaaaaaagacatcagccagccccagtgaaattgagggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcctggaggagatcgaacaggcacccacatgtctcgggcaaaaatcacatctgaacttgctaaagttatcaatgatggcttatactattatgaacaggatctatggatggaagaagatgaaaacaaacacacagccataaaggtaattgtttctggccaacatctttctactgatgctttgttttgattgtatgttgctgtttatattttctcaaacttgaggctctattttatgaaatgttgaatataaatacattgtatttaacttgaaaaattcctggaaatatacctgataattaccacctg

SEQ ID NO: 4525 - DNA, 6296 bp, Homo sapiens
agacccggaagcagttgttgtttcaagggaggtgggactgggcgggtcaggccgcagcggctgacggcaggggaggagccgggtccactgccgggtggaggggcaaggcgagtgtgtgtccttatcctagcaattggggcgcgggcctgtgagccagttggagttgcggcggcgggaacgattgggctgagcagaggacgacatgttgcttttcgtggagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaaggaaacaagagaaagtacgtccatttcattatggattttggagttgtgagtgataggatcccaaaattcatctctaatgtggtttttaaatgctggaggattccaatcaatataaatatatatatatatatacacacacatatataaaaagtataatttttctatttttgtttttggttttaatttgcagagatttgctgccaggaatcaattttgagggttcagatttagcttggaagaaaaaaaagaaacatacatccttcagtataggagatgagggaatgagagaaaatattttttgaagaagcatttctgtaaaattagaaattactttttttaatctatttaaagtttggcttgaagaatgccatctctgactatatggccttgtattgcaaagcggatcagtggctggggtgcctgttgtgggtgtgagtgtgtacaagagcgattgaagccaaatctgttgtcatgttagtaaatgatttgaaaactgaatgtaatacttgagtagatttttttttctagtttgaaatttagtctgtctttttgaccttactaatatttcatttaacaagttgtaaaactctgattgtacttagagatgtgactaccaatcagtttgatactcaaggaaagggggttattcaagaaattgaaaatttcatcttggacctcagtgcataggtcaaatggatttcagaggtttaaacttccctgtgattcccccgaatacccccaaaatgagaaacaaaattttttttcttactccatttgttactctctgttctttgactgcccacccacagaaaagcaaaataaccaactacctactcaattgtgtgtttgtaattgctttgagcagtctagtcaaatcatataaattgttctaaatttcagaattgaacattgaagtattaactcttctgttcacacatttagaattttagctcccaagatggtagggcagactgaccgtacagtaatttatttgtcgttagtgttaaagattaagcatagtaactgactcttaagtgttaaataatgtagaagtaaaaaaattttttttaaaggcttaatttgggaggggggacttatttctgtttacagtgtattaccttccttccctcctcttctccccccacacccaacaaaatacagtttggaattcactgaaacagtaccagcaagtcatgagattttttagtaaagatgagaaagatggttgaagaaaattagtgcataatttctcagtgaataaagttgtagctctcatatactaaatagacaagtttacatgctgttatttagaaaatgactaaaatattaaaaaccgtgttgtgttaatctgttttaagtcataccatgttcagagttctatgtaaggtgggttttatttttcttttaagggatagtttgtaatagtaagaactgtcccatatgttagtaaattacatatgtacaaattgaaactgtaaattgtgaacactggaaagcaccattgtgacatagagtaaacatcttagtaatatattaaagtgaatgtaaatggtggttaaaattacattactgtgaaattcatcttccaactctaagttaagctttggagatacatgttagtggttaactgttaagagctttgaaaacactgcacatatctgtacaagccagaattactatttctttgacttattattagcttggcagttgcttttgatttgattgttttatgacatggtatactactatatttactcagtttgaaactattcatttctacacactatttttaaaaattgcctactaggtgaaacataacaataaaactacctgtgctgaaatttgggggaagtttaggtcctttaaaaaaacatattaatcattgactacatctatgataaaagtgcttattttggtttactaagataatgcagttggtggaaatgataaacgttttaagtgttaacatcctttgaatgcgttggatttcagagaataaacattttgtaaaaatcacttggtaaggattataaacttaattactgcacttaaaatgaaacattactttttttaaacaatgtgtcacaaatgtaggtctgtattacttgtatgcttgtgtgacttactgttagtccagctctaaaaatttaaaggttgtaattgaaatacaagaaaagagccttcttttagaagaaagcaagtatatttttgcttttacttcaaatgttatttaaagtagaaatttaatttgtagatataacctttaaaaattttctcattaagacaatgtttttaatttaatttgcctcattacatctaatagttcccatttgatggcatgtatagggaagagtgagagagtgtgtgtgtgtgtatgtgtgtgtaatatttatatatattcacagtatgtatttagcatttattttattacagcagatttaaagtttgtatctaaataatgcctatgagttgtgtgaagctcttggcttttttccaacgttactttgtaactaatgagggtggatgttcattgtagtttatttatttggttctttagatggaggaatttaaaaaatcaaatttttctcttcacctttatgacttgacatttccttgatctgttggaggctaaaagtaggtataaatgatattgaatgttgggtatagtgatactctgccatagttcttactgcatgaagagaacaagagtcacacaagttcaccactttgcacttcatagagaaggtacatagagacattgcaaaacctgtctccatttgctatcctgataattaaggttttcataatacctagggcctgtctctgagtaattttaattttgccaaatacactgacatttaaaatagtgatccatctaaatttttttcagctgggttttgaggaatataagagctttcaatgataaaggtttgttgtagttgtcttatgtgctgaatttgcagatgatcagatgctgtgcagaattctgatttatttttgtttcctaaaattaagatagcttgaatattatttcacattcctttttcttttttaaataaacaggtttgctttggaaaggcttaatgatggaatgttagcatcttcactagggtaaagaagaacaaaaagaatgttgctggaacgtaaaatagtatttaaaagttaatgaacacttctctagttttcttagttatggccttaataattagtctcttggcttaaatgtccactggttttactttgacacagttgaacaacactggggttaagtctctggtatttaggctggcaatatatatattaaccatattttaaaagtaccaattttgtttttacagaaaagataaaactcaaaagagaacagtgtattccttctgaggggcttttataaattattaactataatatatgatggattttttcctaattttttatatttccttacaattttggtggccattaatttaactttaggcttttgggcatatgctagtctgagcttccgaaaagatacatatatgtttcccttttcattagctgaatgaggatattttaagaagttgaaagagaatttattttcaagttgtgagtaaatcctcctttgaaattcacctgattattagataacttaaagtttatttttaaaagctgacaactttttatgaatcttcgagttgacagttcctaaaagcgtaactcagatattaatgggctgtgtattaaatggttttattttcagttttgcagcacagaacactgttgaaatatccatatcaacttgatttttttaacctaattcaggtgtcctttgcatctcttaaatgttgggggtgggggtcagagccagttatccggcttctgttttgtcgattgcttagatttgttcctgttgtcaaaactgttacccccaaaattggtgtgacacatgctcatgcataaaatgttaaaatgagtacatccttgtatttgtatttgttttcaacatcgccaaggtgctatgggaaattaacaaaattagaaaaaaaataaaattatt

SEQ ID NO: 4526 - DNA, 3621 bp, Homo sapiens
aacgattgggctgagcagaggacgacatgttgcttttcgtggagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaaggaaacaagagaaagtacgtccatttcattatggattttggagttgtgagtgataggatcccaaaattcatctctaatgtggtttttaaatgctggaggattccaatcaatataaatatatatatatatatacacacacatatataaaaagtataatttttctatttttgtttttggttttaatttgcagagatttgctgccaggaatcaattttgagggttcagatttagcttggaagaaaaaaaagaaacatacatccttcagtataggagatgagggaatgagagaaaatattttttgaagaagcatttctgtaaaattagaaattactttttttaatctatttaaagtttggcttgaagaatgccatctctgactatatggccttgtattgcaaagcggatcagtggctggggtgcctgttgtgggtgtgagtgtgtacaagagcgattgaagccaaatctgttgtcatgttagtaaatgatttgaaaactgaatgtaatacttgagtagatttttttttctagtttgaaatttagtctgtctttttgaccttactaatatttcatttaacaagttgtaaaactctgattgtacttagagatgtgactaccaatcagtttgatactcaaggaaagggggttattcaagaaattgaaaatttcatcttggacctcagtgcataggtcaaatggatttcagaggtttaaacttccctgtgattcccccgaatacccccaaaatgagaaacaaaattttttttcttactccatttgttactctctgttctttgactgcccacccacagaaaagcaaaataaccaactacctactcaattgtgtgtttgtaattgctttgagcagtctagtcaaatcatataaattgttctaaatttcagaattgaacattgaagtattaactcttctgttcacacatttagaattttagctcccaagatggtagggcagactgaccgtacagtaatttatttgtcgttagtgttaaagattaagcatagtaactgactcttaagtgttaaataatgtagaagtaaaaaaattttttttaaaggcttaatttgggaggggggacttatttctgtttacagtgtattaccttccttccctcctcttctccccccacacccaacaaaatacagtttggaattcactgaaacagtaccagcaagtcatgagattttttagtaaagatgagaaagatggttgaagaaaattagtgcataatttctcagtgaataaagttgtagctctcatatactaaatagacaagtttacatgctgttatttagaaaatgactaaaatattaaaaaccgtgttgtgttaatctgttttaagtcataccatgttcagagttctatgtaaggtgggttttatttttcttttaagggatagtttgtaatagtaagaactgtcccatatgttagtaaattacatatgtacaaattgaaactgtaaattgtgaacactggaaagcaccattgtgacatagagtaaacatcttagtaatatattaa

SEQ ID NO: 4527 - DNA, 1572 bp, Homo sapiens
ggggcaaggcgagtgtgtgtccttatcctagcaattggggcgcgggcctgtgagccagttggagttgcggcggcgggaacgattgggctgagcagaggacgacatgttgcttttcgtggagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggtaagaaaataaagtacctgaaaacctttgataataatgtgatcatcctgaataattgaagaacatgatcttcataataattaaatgagcatttaattattggtatatggttatattaaataaatacgttattttc

SEQ ID NO: 4528 - DNA, 6427 bp, Homo sapiens
ccgggtggaggggcaaggcgagtgtgtgtccttatcctagcaattggggcgcgggcctgtgagccagttggagttgcggcggcgggaacgattgggctgagcagaggacgacatgttgcttttcgtggagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaaggaaacaagagaaagtacgtccatttcattatggattttggagttgtgagtgataggatcccaaaattcatctctaatgtggtttttaaatgctggaggattccaatcaatataaatatatatatatatatacacacacatatataaaaagtataatttttctatttttgtttttggttttaatttgcagagatttgctgccaggaatcaattttgagggttcagatttagcttggaagaaaaaaaagaaacatacatccttcagtataggagatgagggaatgagagaaaatattttttgaagaagcatttctgtaaaattagaaattactttttttaatctatttaaagtttggcttgaagaatgccatctctgactatatggccttgtattgcaaagcggatcagtggctggggtgcctgttgtgggtgtgagtgtgtacaagagcgattgaagccaaatctgttgtcatgttagtaaatgatttgaaaactgaatgtaatacttgagtagatttttttttctagtttgaaatttagtctgtctttttgaccttactaatatttcatttaacaagttgtaaaactctgattgtacttagagatgtgactaccaatcagtttgatactcaaggaaagggggttattcaagaaattgaaaatttcatcttggacctcagtgcataggtcaaatggatttcagaggtttaaacttccctgtgattcccccgaatacccccaaaatgagaaacaaaattttttttcttactccatttgttactctctgttctttgactgcccacccacagaaaagcaaaataaccaactacctactcaattgtgtgtttgtaattgctttgagcagtctagtcaaatcatataaattgttctaaatttcagaattgaacattgaagtattaactcttctgttcacacatttagaattttagctcccaagatggtagggcagactgaccgtacagtaatttatttgtcgttagtgttaaagattaagcatagtaactgactcttaagtgttaaataatgtagaagtaaaaaaattttttttaaaggcttaatttgggaggggggacttatttctgtttacagtgtattaccttccttccctcctcttctccccccacacccaacaaaatacagtttggaattcactgaaacagtaccagcaagtcatgagattttttagtaaagatgagaaagatggttgaagaaaattagtgcataatttctcagtgaataaagttgtagctctcatatactaaatagacaagtttacatgctgttatttagaaaatgactaaaatattaaaaaccgtgttgtgttaatctgttttaagtcataccatgttcagagttctatgtaaggtgggttttatttttcttttaagggatagtttgtaatagtaagaactgtcccatatgttagtaaattacatatgtacaaattgaaactgtaaattgtgaacactggaaagcaccattgtgacatagagtaaacatcttagtaatatattaaagtgaatgtaaatggtggttaaaattacattactgtgaaattcatcttccaactctaagttaagctttggagatacatgttagtggttaactgttaagagctttgaaaacactgcacatatctgtacaagccagaattactatttctttgacttattattagcttggcagttgcttttgatttgattgttttatgacatggtatactactatatttactcagtttgaaactattcatttctacacactatttttaaaaattgcctactaggtgaaacataacaataaaactacctgtgctgaaatttgggggaagtttaggtcctttaaaaaaacatattaatcattgactacatctatgataaaagtgcttattttggtttactaagataatgcagttggtggaaatgataaacgttttaagtgttaacatcctttgaatgcgttggatttcagagaataaacattttgtaaaaatcacttggtaaggattataaacttaattactgcacttaaaatgaaacattactttttttaaacaatgtgtcacaaatgtaggtctgtattacttgtatgcttgtgtgacttactgttagtccagctctaaaaatttaaaggttgtaattgaaatacaagaaaagagccttcttttagaagaaagcaagtatatttttgcttttacttcaaatgttatttaaagtagaaatttaatttgtagatataacctttaaaaattttctcattaagacaatgtttttaatttaatttgcctcattacatctaatagttcccatttgatggcatgtatagggaagagtgagagagtgtgtgtgtgtgtatgtgtgtgtaatatttatatatattcacagtatgtatttagcatttattttattacagcagatttaaagtttgtatctaaataatgcctatgagttgtgtgaagctcttggcttttttccaacgttactttgtaactaatgagggtggatgttcattgtagtttatttatttggttctttagatggaggaatttaaaaaatcaaatttttctcttcacctttatgacttgacatttccttgatctgttggaggctaaaagtaggtataaatgatattgaatgttgggtatagtgatactctgccatagttcttactgcatgaagagaacaagagtcacacaagttcaccactttgcacttcatagagaaggtacatagagacattgcaaaacctgtctccatttgctatcctgataattaaggttttcataatacctagggcctgtctctgagtaattttaattttgccaaatacactgacatttaaaatagtgatccatctaaatttttttcagctgggttttgaggaatataagagctttcaatgataaaggtttgttgtagttgtcttatgtgctgaatttgcagatgatcagatgctgtgcagaattctgatttatttttgtttcctaaaattaagatagcttgaatattatttcacattcctttttcttttttaaataaacaggtttgctttggaaaggcttaatgatggaatgttagcatcttcactagggtaaagaagaacaaaaagaatgttgctggaacgtaaaatagtatttaaaagttaatgaacacttctctagttttcttagttatggccttaataattagtctcttggcttaaatgtccactggttttactttgacacagttgaacaacactggggttaagtctctggtatttaggctggcaatatatatattaaccatattttaaaagtaccaattttgtttttacagaaaagataaaactcaaaagagaacagtgtattccttctgaggggcttttataaattattaactataatatatgatggattttttcctaattttttatatttccttacaattttggtggccattaatttaactttaggcttttgggcatatgctagtctgagcttccgaaaagatacatatatgtttcccttttcattagctgaatgaggatattttaagaagttgaaagagaatttattttcaagttgtgagtaaatcctcctttgaaattcacctgattattagataacttaaagtttatttttaaaagctgacaactttttatgaatcttcgagttgacagttcctaaaagcgtaactcagatattaatgggctgtgtattaaatggttttattttcagttttgcagcacagaacactgttgaaatatccatatcaacttgatttttttaacctaattcaggtgtcctttgcatctcttaaatgttgggggtgggggtcagagccagttatccggcttctgttttgtcgattgcttagatttgttcctgttgtcaaaactgttacccccaaaattggtgtgacacatgctcatgcataaaatgttaaaatgagtacatccttgtatttgtatttgttttcaacatcgccaaggtgctatgggaaattaacaaaattagaaaaaaaataaaattattaaaaagca

SEQ ID NO: 4529 - DNA, 4000 bp, Homo sapiens
aggccgcagcggctgacggcaggggaggagccgggtccactgccgggtggaggggcaaggcgagtgtgtgtccttatcctagcaattggggcgcgggcctgtgagccagttggagttgcggcggcgggaacgattgggctgagcagaggacgacatgttgcttttcgtggagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgaggtgtctgtctttaatacaggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaaggaaacaagagaaagtacgtccatttcattatggattttggagttgtgagtgataggatcccaaaattcatctctaatgtggtttttaaatgctggaggattccaatcaatataaatatatatatatatatacacacacatatataaaaagtataatttttctatttttgtttttggttttaatttgcagagatttgctgccaggaatcaattttgagggttcagatttagcttggaagaaaaaaaagaaacatacatccttcagtataggagatgagggaatgagagaaaatattttttgaagaagcatttctgtaaaattagaaattactttttttaatctatttaaagtttggcttgaagaatgccatctctgactatatggccttgtattgcaaagcggatcagtggctggggtgcctgttgtgggtgtgagtgtgtacaagagcgattgaagccaaatctgttgtcatgttagtaaatgatttgaaaactgaatgtaatacttgagtagatttttttttctagtttgaaatttagtctgtctttttgaccttactaatatttcatttaacaagttgtaaaactctgattgtacttagagatgtgactaccaatcagtttgatactcaaggaaagggggttattcaagaaattgaaaatttcatcttggacctcagtgcataggtcaaatggatttcagaggtttaaacttccctgtgattcccccgaatacccccaaaatgagaaacaaaattttttttcttactccatttgttactctctgttctttgactgcccacccacagaaaagcaaaataaccaactacctactcaattgtgtgtttgtaattgctttgagcagtctagtcaaatcatataaattgttctaaatttcagaattgaacattgaagtattaactcttctgttcacacatttagaattttagctcccaagatggtagggcagactgaccgtacagtaatttatttgtcgttagtgttaaagattaagcatagtaactgactcttaagtgttaaataatgtagaagtaaaaaaattttttttaaaggcttaatttgggaggggggacttatttctgtttacagtgtattaccttccttccctcctcttctccccccacacccaacaaaatacagtttggaattcactgaaacagtaccagcaagtcatgagattttttagtaaagatgagaaagatggttgaagaaaattagtgcataatttctcagtgaataaagttgtagctctcatatactaaatagacaagtttacatgctgttatttagaaaatgactaaaatattaaaaaccgtgttgtgttaatctgttttaagtcataccatgttcagagttctatgtaaggtgggttttatttttcttttaagggatagtttgtaatagtaagaactgtcccatatgttagtaaattacatatgtacaaattgaaactgtaaattgtgaacactggaaagcaccattgtgacatagagtaaacatcttagtaatatattaaagtgaatgtaaatggtggtt

SEQ ID NO: 4530 - DNA, 1949 bp, Homo sapiens
aggggcaaggcgagtgtgtgtccttatcctagcaattggggcgcgggcctgtgagccagttggagttgcggcggcgggaacgattgggctgagcagaggacgacatgttgcttttcgtggagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttatacttaagagaagaagttaaaacatttcagggcaagccaattatggctccctttcccaatggtagttttgtgaatggctttaattcgccaggatcttataaaacaaatgctgctgctatgaatatgggtcgaccattccaaaaaaatcggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaagg

SEQ ID NO: 4531 - DNA, 2853 bp, Homo sapiens
cttatcctagcaattggggcgcgggcctgtgagccagttggagttgcggcggcgggaacgattgggctgagcagaggacgacatgttgcttttcgtggaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaaggaaacaagagaaagtacgtccatttcattatggattttggagttgtgagtgataggatcccaaaattcatctctaatgtggtttttaaatgctggaggattccaatcaatataaatatatatatatatatacacacacatatataaaaagtataatttttctatttttgtttttggttttaatttgcagagatttgctgccaggaatcaattttgagggttcagatttagcttggaagaaaaaaaagaaacatacatccttcagtataggagatgagggaatgagagaaaatattttttgaagaagcatttctgtaaaattagaaattactttttttaatctatttaaagtttggcttgaagaatgccatctctgactatatggccttgtattgcaaagcggatcagtggctggggtgcctgttgtgggtgtgagtgtgtacaagagcgattgaagccaaatctgttgtcatgttagtaaatgatttgaaaactgaatgtaa

SEQ ID NO: 4532 - DNA, 5640 bp, Homo sapiens
agcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccctcagaatatgactctctgcctgaaaatagcgagacaggaggaaatgagtctcaaccagacagccaggaagacccccgagaagtacttaaaaaaacattggaattctgcttatctagggagaaccttgctagtgacatgtatcttatatcacagatggatagtgaccagtatgtgccaatcacaacggtggctaacctcgaccacatcaagaagctcagcactgatgtggacttgattgtggaagtgctaagatctttacctttagtccaagtggatgaaaagggagaaaaagtaaggccaaatcaaaatcgctgcatagtaatattgcgtgaaatatctgaatctacccccgtggaagaagtagaagcactatttaaaggagataatttaccaaaatttataaactgtgaatttgcatataatgataattggtttattacatttgaaacagaagctgatgcacaacaggcttacaaataccttcgagaagaagtcaaaacttttcaaggaaaaccaattaaggcacggataaaagcaaaggcaatagctataaacacatttttgccaaagaatggatttagacccctggacgtgagcctgtatgcccagcagcgctacgcgacgtcgttctacttccctcccatgtacagcccccagcagcagttccccctgtacagcctgatcactccccagacgtggtcagcaacgcacagctatcttgacccacccttggtaactccatttccaaatactggatttataaatgggtttacgtctccagcgttcaagcctgcggcgtctcctctgacttctctcagacagtatcctcctcgaagcaggaatcctagtaaatctcatctgcggcatgcgattcctagtgcagagaggggacctgggttattagaaagtccttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggaagaattcctttggctaccggaagaaaagggaggagaagtttacaagcagccagacacagtctccaacgccaccaaagcctccgtcgccaagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgctttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatattattttgatttgttgagattttcttttttctcttacatcggtgtgttgaactgattctgcctctttgctgcaaaagggaattggaaagtcttattaaaagcctccagatgttttcatactcttttaaaatgtatgtaaatgcatactaatcatatctaatgtgaaagagttttaaagtatatagagagcaaaaactggcaggatcgtaagtgaaggtgactagtaatctaatttaaatcacctgcagctaagcatgattgaccctgccagaggaaaacatgcctatttgaccatttcctttaaagcagttgccattattcaaatacagagaaatagccacagggctagtgtttttcaaatgcattttaaagaacatggggatttttttttgtagttgtcagttcactgaccaaaaaaaaaaaaaaaatcagaaataattgatctgtgaaacccaaactctcaatactcagaaagctgggaggcaacctcgaggcctgggcctacgagctgcatcttcgctacggaagggccagggcgccatcagccattcccaaaacacaaggcctgcccgtccgccagtgagtccttggtttttaataatgagaagtcctttcccccaaggtgtgagcattgcagcgcagtgtgtgtgtgtggttagagccagcttagtccttcactttgtcgaccgaagtgggagctcaacagctgcatgaggagggcagcgcgtgcattagccagtcgccactggagggctctgctgccctccggtcaatacactgtagttactgcctagccagcagcagtcttctgcatcaagaactgaaacgttgctcggaggtgatttttatagcatcctttttaattaaaggtgaaatacagattgctatataatgtctgaaaaaacctgatactacttcaagagtttctgctcagaagaaaatgagagttatcataataggaagctgtggcggtccatgccaactgtgctgtgtcacatacagcgatgagagtggctttcatactttttttttttttaagttaacaccctcctttacccccagcagtatctcaggttatagaatcagagatgcagcagtgacaaatggcattttaacttgtaaaatcgtgtgatgatgcttatcattttgaaatagaagaataaaaacctggtcccgtttcaccagacatgaatttcaagtggagtcgtcgttctctgagagtgagtgtcttgacattttcacccaggccctcctgtcatcacatcaccggctgtcactggcgggtggccgtaaacgtcctgcgttgctatattaggatctctgcagttcaggcttcaaaaccagttcagtgtatccgggcgacgggtagtggtggtgcatgcctgtctgtgtgccccgctggcgagctgtagttgcggcttgcgtgcctcgcggcccactacagggctgcagacaatcgaggcgagggcgctggccgccagcagctcacagcgcgggggtcatgtggtcgctcctcgagggtttcgtttttgttctgcttcattaagactggaatcaagcttacatgtaaactattggtaatttaagtttccttttgtgtcattcagtgtaaaactgtctaatttgaaaaaaaatgtaggttatgaaaataaagatttaggcactgttc

SEQ ID NO: 4533 - DNA, 681 bp, Homo sapiens
ggaagaatccgccgccgccgccgccgccagctcgcgcccgccctctcccctacctccggcccggcccggcccggccgcgccgcctctccctgccgtctctctcctcgccgtccccgcgtgtggcgcggccgccgggccccggggttgaggcgaggagcccgcgggcggccggtcgggcggggcggcggcgctgacagagtcgtgtggaagcagggagtggtcacatgtgggtgttactgggcggcaagcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccct

SEQ ID NO: 4534 - DNA, 432 bp, Homo sapiens
tgtaaatgagaggaagcaaagatttttatggagactatcaataatctcaagaaaatacatattcaaaatggaattaaagccgtgcagtaagattgcatgtgaaacatcaacaggaagttgccttttcctcctctggactctgggtatactttgtttgccatctgcgagatcagtccatggctgagagatggcataagtgagcctgagtgcagcagtgagcagcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaac

SEQ ID NO: 4535 - DNA, 547 bp, Homo sapiens
caagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggtacgtacctcgtgcctgccttcctgcacgacagccgcgaggctctggtgtgaacagacgctgcgcactcctgcacctgctcgttttttaatcacatctaatttggtgggtttttatttgcgtctgtctgtgttgtgttttctgtacaaaatacctttaatatttgctaataattttccactaactactct

SEQ ID NO: 4536 - DNA, 1438 bp, Homo sapiens
ttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggaagaattcctttggctaccggaagaaaagggaggagaagtttacaagcagccagacacagtctccaacgccaccaaagcctccgtcgccaagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggtacgtacctcgtgcctgccttcctgcacgacagccgcgaggctctggtgtgaacagacgctgcgcactcctgcacctgctcgttttttaatcacatctaatttggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgctttttttttttttttttaagtaactggtctgtaagtgcatatctctagaacgt

SEQ ID NO: 4537 - DNA, 2469 bp, Homo sapiens
aggtgaggcggggcgggtgtcgtcgcgctgggccgagcttacgactccagctgacccgctcgcggctgcccaatttcgttgaggctcaggacgagggacggggcggcaaattgtcacagaggtcgccgtagaccggtgtgcaaccgaaggtgaagagcgggaaggcgaggaccgaatcgcctctggtgtgcgttgtccgacaggaagtcccgaatgggctgtgagccgccggtggaggtgcccgggcaggtgcagagccacagcctgcgccccgtgagccgaggcgggtgatttatttggcataaaagtattctttcaaggatggcagaagctgttttgattgatctttttggtttgaaattgaactctcaaaaaaactgccatcagacattactgaagactttgaatgctgtccaataccaccatgctgccaaggccaagtttctctgtataatgtgttgcagtaacatcagctatgaaagggatggagaacaagataattgtgaaatagaaacaagcaatggattatcagctctcttggaagaatttgagattgttagctgtcccagcatggctgccactttgtataccattaaacagaaaattgatgaaaaaaatctgagcagcattaaggtaattgtacccaggcacaggaagacattaatgaaagcttttattgatcaactcttcactgatgtttacaattttgaatttgaagatttgcaagtgacttttaggggagggctttttaaacagtccattgaaataaacgtaatcacagctcaagaactaagaggaattcagaatgaaatagaaacatttttgagaagtctgccagcactgagaggaaaattaactattatcacttcttctttgatcccagatattttcatacatggatttactacaagaacaggtgggatatcttatataccaactcttagctcattcaatctcttcagtagttccaaacggagagatcccaaggtagtggttcaagaaaatctgcgtaggttggcgaatgctgcaggatttaatgtggagaaattttaccgaataaagactcatcattccaatgacatctggattatgggaagaaaggagcctgactcttatgatggaataaccacaaatcagagaggagtcacaatagcagctcttggtgcagactgtataccgatagtttttgcagatccagtcaaaaaagcatgtggggttgctcacgctggttggaaaggtactttgttgggtgttgctatggctacagtgaatgctatgatagcagaatatggctgcagtttggaagacattgttgttgtacttggaccttcagtaggaccttgctgttttactcttccaagggaatcagcagaggcatttcataatcttcatcctgcatgtgtacaactatttgattcaccaaatccctgtatcgacatccgtaaagccacaaggattcttctagaacagggaggaattcttccacagaatattcaggaccagaaccaagatctcaacctctgtacatcttgccatcctgacaagtttttctcccatgtccgagatggccttaattttggtacacagattggcttcatatcaattaaagaatgagatacttgactggatttttgtataactgcttcctgcctccttccaaactgactgcaagagagaaatttagctgtttgatttacttaaaaccaaatggattacaatggataattcatcttttgggtatatttttactattattcaaagccaaatgattttcatttaattgtaataataactgacaaaaatcagtatgttgtagctaatatgttttatgcatgagaattattcttaaagtttgttctccctgtttattacacagatcaggaatagatttgttcagttcagtatttattggataccctctattggtcaggcattgtgttaagcatatgtgaatcaaaatgaacacaactttttcctttgagtctgatacagtgaaggagataaacacttctacaacttaaatttaattttaatagcagtagaagagaacataaggaatagaggttaattttacccagaagcaggatagagaaaatattacagagaaaatcacatatcacatgggctcgaaagatgtagaggtttttgacaaatgaagaacaaccataacaggtagagggaacaccatgaaccagggcatgaaactgaaagtgcataacatattctagagagagaagggtgtgggcatgagttagggctggaaaaacaggttggaaacagataagtaagggtctcaaatgcaatgtcaaagagcttgcagtttattttccaggcaatgagtaggcagccaaaaaaaaaaaagtaaggatgttttttttttttttcccatggcatcatatttaagaggatggatttaaattgtgtgagaccaaagcatagagactagataagaggcgatcaaaatatttc

SEQ ID NO: 4538 - DNA, 705 bp, Homo sapiens
atcccgggattccccagctctcgcgctgggcccgccgcgttcgcaccaagcacgccaggcggccctggcctacctccctcccgcctcccggcagctggcacgagggaacctggccgtcaggtttcccctgggatcctgggacggtatcaggcggggaatctgtgcggccgcggcgaggtgatttatttggcataaaagtattctttcaaggatggcagaagctgttttgattgatctttttggtttgaaattgaactctcaaaaaaactgccatcagacattactgaagactttgaatgctgtccaataccaccatgctgccaaggccaagtttctctgtataatgtgttgcagtaacatcagctatgaaagggatggagaacaagataattgtgaaatagaaacaagcaatggattatcagctctcttggaagaatttgagattgttagctgtcccagcatggctgccactttgtataccattaaacagaaaattgatgaaaaaaatctgagcagcattaaggtaattgtacccaggcacaggaagacattaatgaaagcttttattgatcaactcttcactgatgtttacaattttgaatttgaagatttgcaagtgacttttaggggagggctttttaaacagtccattgaaataaacgtaatcacagctcaagaactaagaggaattcagaatgaaataga

SEQ ID NO: 4539 - DNA, 4262 bp, Homo sapiens
agacctgcagctcctgccgccctgcgcccgctcccagggcccgtcgttccgccgccctatccctcctcaaggggcccctagctgcctcctcgcgaccctttccggactcggcctgcccactcctgcccgctaacccgcctggctcccgggcgagagccctcgcgcggctctggttcctgttcctctaacgccgccggggctgcgggatgccgactccgcggaccgcccagacccggaactgctgaggcagcagcgggctcgcggcgcttggctcatcccgggattccccagctctcgcgctgggcccgccgcgttcgcaccaagcacgccaggcggccctggcctacctccctcccgcctcccggcagctggcacgagggaacctggccgtcaggtttcccctgggatcctgggacggtatcaggcggggaatctgtgcggccgcggcgaggtgatttatttggcataaaagtattctttcaaggatggcagaagctgttttgattgatctttttggtttgaaattgaactctcaaaaaaactgccatcagacattactgaagactttgaatgctgtccaataccaccatgctgccaaggccaagtttctctgtataatgtgttgcagtaacatcagctatgaaagggatggagaacaagataattgtgaaatagaaacaagcaatggattatcagctctcttggaagaatttgagattgttagctgtcccagcatggctgccactttgtataccattaaacagaaaattgatgaaaaaaatctgagcagcattaaggtaattgtacccaggcacaggaagacattaatgaaagcttttattgatcaactcttcactgatgtttacaattttgaatttgaagatttgcaagtgacttttaggggagggctttttaaacagtccattgaaataaacgtaatcacagctcaagaactaagaggaattcagaatgaaatagaaacatttttgagaagtctgccagcactgagaggaaaattaactattatcacttcttctttgatcccagatattttcatacatggatttactacaagaacaggtgggatatcttatataccaactcttagctcattcaatctcttcagtagttccaaacggagagatcccaaggtagtggttcaagaaaatctgcgtaggttggcgaatgctgcaggatttaatgtggagaaattttaccgaataaagactcatcattccaatgacatctggattatgggaagaaaggagcctgactcttatgatggaataaccacaaatcagagaggagtcacaatagcagctcttggtgcagactgtataccgatagtttttgcagatccagtcaaaaaagcatgtggggttgctcacgctggttggaaaggtactttgttgggtgttgctatggctacagtgaatgctatgatagcagaatatggctgcagtttggaagacattgttgttgtacttggaccttcagtaggaccttgctgttttactcttccaagggaatcagcagaggcatttcataatcttcatcctgcatgtgtacaactatttgattcaccaaatccctgtatcgacatccgtaaagccacaaggattcttctagaacagggaggaattcttccacagaatattcaggaccagaaccaagatctcaacctctgtacatcttgccatcctgacaagtttttctcccatgtccgagatggccttaattttggtacacagattggcttcatatcaattaaagaatgagatacttgactggatttttgtataactgcttcctgcctccttccaaactgactgcaagagagaaatttagctgtttgatttacttaaaaccaaatggattacaatggataattcatcttttgggtatatttttactattattcaaagccaaatgattttcatttaattgtaataataactgacaaaaatcagtatgttgtagctaatatgttttatgcatgagaattattcttaaagtttgttctccctgtttattacacagatcaggaatagatttgttcagttcagtatttattggataccctctattggtcaggcattgtgttaagcatatgtgaatcaaaatgaacacaactttttcctttgagtctgatacagtgaaggagataaacacttctacaacttaaatttaattttaatagcagtagaagagaacataaggaatagaggttaattttacccagaagcaggatagagaaaatattacagagaaaatcacatatcacatgggctcgaaagatgtagaggtttttgacaaatgaagaacaaccataacaggtagagggaacaccatgaaccagggcatgaaactgaaagtgcataacatattctagagagagaagggtgtgggcatgagttagggctggaaaaacaggttggaaacagataagtaagggtctcaaatgcaatgtcaaagagcttgcagtttattttccaggcaatgagtaggcagccaaaaaaaaaaaagtaaggatgttttttttttttttcccatggcatcatatttaagaggatggatttaaattgtgtgagaccaaagcatagagactagataagaggcgatcaaaatatttcaaaaagaaataatgaagatccaatgaaggaagtggaaattaaaatagggaagagagtagatggattagagagacatttaagagatggaatcaatagatcctgttactagataatggaagtaagaggtgaggaagagtggaaaagtcattaatgactctaagatttctgcttggctgcttaccaagattggcaacaaagggagggagaaggtttggaaaaagagagaaggataatgagtttgactttacatagaatgaagggcatccagatagaaatctttggttaataattagaaatatagacctagaaattaggaggaaacctgagacagagacaaatatttcaaagcttacaatacagagatgatacctgattctattggagcaggtttgatcatctaggcagaaattaggatgagaaaaaaggagatccaataatacaaccttatagtcacagaagtaagaaaaaaagggtagttgttttgaagaagccaggataggtgtggaaagtactcaaaaagaaatcttcagggataaaataaagtgataatttaaaagaaatcaatggattaaacatattgaaactgttctataggcagtggtcattgagtcagctttcagtgcattaggaagaagatgcataggtgtcaactcttttctgacagcatttactagagaagagaaaaagctggggactacatcttcaaggaagggactttttttggatgagcagttttgagtgtgtttgtcagttaaagagaggaattaggttagttttcatttgggaaaaattgtatatatatttaatgtaagttatcacattgcatcttaaaaatattcttatttaatacatatatttcctacatgtatatgtggtagcatgatagcaaataacatttgtttggtatttccaaaggactttcatgtacattgcctcattttacctttacagctactctgaaatacacaggcattatcccttttattcagctgagaaaactgagcttcattgaggtggaggtcaaaaatcacaaaatttgtgatgaattaagatttgaacatatgttttgtgactccagttttcctttcagattttaaaattaattaaagggatcttcattatacttttattgttaactttttgttaacataatttattcatacattcagtgaaaattttgttgaggtactgggacaggttaaaaaatacagttgtagccctcaggatatttaatatccagtgaaaagtgacagtcagtaaaccaacaatctcaatactttgatatatgttgtgaggttgtgataaccgattcttgtttagtttaattctatatctcccttagaccagtgttaaatttaaataaaacacctcattttttccaattcagggaaggcactaaacataaagcataggatagaaatgttgaactcatccaaaatattattttgtttaatgaaaatgatgaagattaaggaatacttccatgtattgagtaaggttgataattttctaattcttcactgtgcattattttgtttgaagttggtaaatttggagtatcctgcagacacattttgctttatgtactacaacattctacaaccaaataaaaattattttgattatctg

SEQ ID NO: 4540 - DNA, 6547 bp, Homo sapiens
gaatattcttctggagcccttggaggggctccaaactgagaggggagggaagaccgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaactatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcggtggccctgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagttacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaataaacacttgcacacatttttgaagtgcggctagattctcagattcacctttcttccagggaagataactttcaatctatataaaaatctctgtcctaaaactacctttctttattttgaagagacttactaacttacatataatctaaattagatgatagatttgtttttagcccttttgtttggtctatcagtataagaagaatattttaggtttatagctgaagttatcaaggtttaataaagtaaatttctaacagaatactagaaaaatgcagtataatttaattttttctaaataagaaacacaggaaatcaactactttttccccttccttatctccttaaaagaaaaataaaattgtacatgaga

SEQ ID NO: 4541 - DNA, 645 bp, Homo sapiens
agaatgaatgtgagaaggaagccaggacagcgcagtccccagtcccgaacggccagggagaggaggtggcctagcgctggcggggctcaccccaatccgtctgccttttgatgccgtactgtaagctccgtccatctctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgaggtacagtgtccctgccattgccaccctgctggggcacctgcgcccccgcgggctgtgccacactcgtccttctctctctctccgcctctttcctctccccagtgccttgagagtttcacctgggctaggtcagttcggaaacttgaaataaagagttttcctttgtaagttg

SEQ ID NO: 4542 - DNA, 3063 bp, Homo sapiens
gcccgggccactcgggagcctcgcggcagcccggcgccccacttggccatccgctccttgcccgcctcctcttgtcacctcccgtctcatccttctcgctccttccccgccgcatacaccggcatccgagtgcctcagagagccggaggtggtgtgcggggctgcagggcacgacttcaagcggtcctcagctccgcactagggggcacgggcaacagcatggacaccaagcgctgcttcgccaatcgcttcgatgactaccagggcagcctgctggcgggccagtgtgaggaggcggtggcgcccttggtcaccgccaccatcgagcgcatcctccaggagcttcccccactcgggggcggcgcggaggcccgaggggcgacggcgggggctagcgcctgccagggggggctttatggcggcgtggccggagtggcgtatatgctctaccacgtctcgcagagcccgcttttcgccacggcccgggaacgctacctgcgctcggctaagcgcctcatcgacgcgtgcgcccgcgctgaggagtggggcgaaccggacgccgacacccgcgccgccttcctgctcgggggcgcgggcgtgtacgccgtggccacgctcgtataccacgccctgggccggtccgactacgtgcagccgctgggcaagttccgggctctgtgtgccgtctgcgcgccggtctccttcctggagtgcggctccgacgagctgttcgtgggccgcgcgggttacctgtgtgccgcgctggtgctcaagcagaaactcgcccaggaggtgctgactccagcacagatcaagtcaatttgtcaggcaattctggactctgggaagcagtatgccataaagaagaggaaaccattccccctgatgtattcttactatggaaccgaatacttgggggcagctcacggcttgtcgtctattcttcagatgcttctttcttaccatgagcatctcaagccctcagatcgggaattggtatggcagagcgtggactttctcatggaacaggaacaaaactgcaactggccacctgagctcggcgagaccatcgagagagagaatgagctggtgcactggtgccatggcgctccaggaattgcctatctgtttgccaaagcttatctggtttccaagaaaccgcagtacctggacacatgtattcggtgtggggaactcacatggcagaaaggcctgctaaagaaggggcctgggatttgccatggagtagccggcagtgcctatgtcttcctgctgctgtaccggctcacgggaaactctaaatacatctaccgagctcaaaggtttgctcaattcttatttaccgaggaattcaaggccggttctcgggtccttgaaagtatatacagcttgtatgaaggcttctctgggacagtgtgctttctgattgacctgctgcagcccaatcaggctgaattcccactcttcagcgtctttgtttagaaggctctatcttccactgtggccctgcagagatcccctgagccaagccgaggcagtttccacataagccacattcaatggtatcgcaaccatgagccttaacattgccatcagaaggaaggaatcaggcaggtgaaggcaacatgatgccagatttgagaaaggatctgcaaaataaagataccacaattcatcttaaaactgcagagatttaatgtgtcagggaatagatgtgaaacaagggatcataggaaaaggggaaagagaaatgatctgtttttcagttatgacatagaaaaccaaactgcaagtgtagactatgacaaaaaatacactaatacctttgcaatctgaatgagaatttgaccatttgtgtgtgccctctacccttaaattcagaaataaagacaataaaaaattaaaataattgcccagctgaaaactgctatgaggaatggattgtcaggttgctgaagtataaaaataaactcttggttgtcctgtgcttatacttattgaaatttatggtttttactgagcaaagatatttgcatatgaatctctatttttttcattaccctgggcaatttaaagaaatcatatcatagcgtagttcagatactaaaatttgaagtttccttaggccctagaacatctcttttcctggttccttttttttcctcaaagctcaattagaatagcaaaatttataagctagtaaacttatactatagcaagtgttgctgtaaagtgtttttctccataggaagtgtgaactgtgtattgtctattgttagtaattttaaaaatgcctttatgtacataatcttgatggagctattagctgaactataaaatatgctcttggtaaatatcactaatttcaaagatcaggggaaccactacaaagacgtgtcatttctgcctttgtttgggacaggcagacaggctgaggaagtcaccagtgattgtggaaataattttgctccattttatactattaaatgaagagatgagtgaattctgtggttggttaccttaccttccaagatacagggtccactagaaattggctgtaatactcattgagccaagttgtcatatcaaattcaaccctgctgtaaacacatagaagttgtgaaactgcttcaagtaaatagtggtttgcagaacactgtaggagcatctgtcacttcattatgcagagcataagttgatccttttcctagaattttgtcagtggcaattgcatatatcagattgagtaggaaattgtgtactgtataagacttatttaaatagtcattaaatatttggatatattatgtgtgtgtgtgtgtgtgtgtgtgtgtgtatggtgtgtattccatatctattcccatgtaaatccaaatacttattctttatttcagtaattcttaacttgaatcatagactttggaacgagttagggaatgctctgttgcctaaaaagcaaacctacaagtatgttggtgtgtgtatgtgtatggaccagtttgtttgtgtgtgtgtgtgctcattttgaggggacaaggatctctagcattcataacattctca

SEQ ID NO: 4543 - DNA, 10298 bp, Homo sapiens
aagctgcggcggcgcaggagggggcgggttcagcgagggcgcggcctctgagggggggcgcaggacacgcatcccccgcgatcgcccgggccactcgggagcctcgcggcagcccggcgccccacttggccatccgctccttgcccgcctcctcttgtcacctcccgtctcatccttctcgctccttccccgccgcatacaccggcatccgagtgcctcagagagccggaggtggtgtgcggggctgcagggcacgacttcaagcggtcctcagctccgcactagggggcacgggcaacagcatggacaccaagcgctgcttcgccaatcgcttcgatgactaccagggcagcctgctggcgggccagtgtgaggaggcggtggcgcccttggtcaccgccaccatcgagcgcatcctccaggagcttcccccactcgggggcggcgcggaggcccgaggggcgacggcgggggctagcgcctgccagggggggctttatggcggcgtggccggagtggcgtatatgctctaccacgtctcgcagagcccgcttttcgccacggcccgggaacgctacctgcgctcggctaagcgcctcatcgacgcgtgcgcccgcgctgaggagtggggcgaaccggacgccgacacccgcgccgccttcctgctcgggggcgcgggcgtgtacgccgtggccacgctcgtataccacgccctgggccggtccgactacgtgcagccgctgggcaagttccgggctctgtgtgccgtctgcgcgccggtctccttcctggagtgcggctccgacgagctgttcgtgggccgcgcgggttacctgtgtgccgcgctggtgctcaagcagaaactcgcccaggaggtgctgactccagcacagatcaagtcaatttgtcaggcaattctggactctgggaagcagtatgccataaagaagaggaaaccattccccctgatgtattcttactatggaaccgaatacttgggggcagctcacggcttgtcgtctattcttcagatgcttctttcttaccatgagcatctcaagccctcagatcgggaattggtatggcagagcgtggactttctcatggaacaggaacaaaactgcaactggccacctgagctcggcgagaccatcgagagagagaatgagctggtgcactggtgccatggcgctccaggaattgcctatctgtttgccaaagcttatctggtttccaagaaaccgcagtacctggacacatgtattcggtgtggggaactcacatggcagaaaggcctgctaaagaaggggcctgggatttgccatggagtagccggcagtgcctatgtcttcctgctgctgtaccggctcacgggaaactctaaatacatctaccgagctcaaagttcattccctgtaaacttgataaagatggaacatctgctgtataccagacaacattgcttttaatagatattacctctgactggtttgctcaattcttatttaccgaggaattcaaggccggttctcgggtccttgaaagtatatacagcttgtatgaaggcttctctgggacagtgtgctttctgattgacctgctgcagcccaatcaggctgaattcccactcttcagcgtctttgtttagaaggctctatcttccactgtggccctgcagagatcccctgagccaagccgaggcagtttccacataagccacattcaatggtatcgcaaccatgagccttaacattgccatcagaaggaaggaatcaggcaggtgaaggcaacatgatgccagatttgagaaaggatctgcaaaataaagataccacaattcatcttaaaactgcagagatttaatgtgtcagggaatagatgtgaaacaagggatcataggaaaaggggaaagagaaatgatctgtttttcagttatgacatagaaaaccaaactgcaagtgtagactatgacaaaaaatacactaatacctttgcaatctgaatgagaatttgaccatttgtgtgtgccctctacccttaaattcagaaataaagacaataaaaaattaaaataattgcccagctgaaaactgctatgaggaatggattgtcaggttgctgaagtataaaaataaactcttggttgtcctgtgcttatacttattgaaatttatggtttttactgagcaaagatatttgcatatgaatctctatttttttcattaccctgggcaatttaaagaaatcatatcatagcgtagttcagatactaaaatttgaagtttccttaggccctagaacatctcttttcctggttccttttttttcctcaaagctcaattagaatagcaaaatttataagctagtaaacttatactatagcaagtgttgctgtaaagtgtttttctccataggaagtgtgaactgtgtattgtctattgttagtaattttaaaaatgcctttatgtacataatcttgatggagctattagctgaactataaaatatgctcttggtaaatatcactaatttcaaagatcaggggaaccactacaaagacgtgtcatttctgcctttgtttgggacaggcagacaggctgaggaagtcaccagtgattgtggaaataattttgctccattttatactattaaatgaagagatgagtgaattctgtggttggttaccttaccttccaagatacagggtccactagaaattggctgtaatactcattgagccaagttgtcatatcaaattcaaccctgctgtaaacacatagaagttgtgaaactgcttcaagtaaatagtggtttgcagaacactgtaggagcatctgtcacttcattatgcagagcataagttgatccttttcctagaattttgtcagtggcaattgcatatatcagattgagtaggaaattgtgtactgtataagacttatttaaatagtcattaaatatttggatatattatgtgtgtgtgtgtgtgtgtgtgtgtgtgtatggtgtgtattccatatctattcccatgtaaatccaaatacttattctttatttcagtaattcttaacttgaatcatagactttggaacgagttagggaatgctctgttgcctaaaaagcaaacctacaagtatgttggtgtgtgtatgtgtatggaccagtttgtttgtgtgtgtgtgtgctcattttgaggggacaaggatctctagcattcataacattctcaaagaatctgaccaaagaaaggtaacaactatctttgtgtattttatgactgtgtgtgtttgcactcattgcaataaagtaggacaaaatgattttgaaatgcatacatcttttcagcttcctgtttcatttttacatcctcagatacaaccatatcaaattggcctcagttgttcatcagtgaaaatgctcagtttggggtgataccacataaatagcagctttcagatgactccccacattgggtccagaagttctttcatataggctgaatataataaccatcctatatacagagctttatggaacacatgcagtttttatcgtccaagaacccctcaagatgtgtttggtaaatgctccaaagtcttacagctagaaaaggacaaaaccaggattcaaacccagggtttcactttctaagtttatttattcagtattctagactagaatctggggatacaatagtgaacaaaataaactttccctcaaagctaccttctgtttccatttgctgttcctttcacaattcatccttgagacctgaaacctaaagcactcagaactgatactctagttcattatcatatcagttccatttctagtaacttcagaaaaacaagaccactttcaggcctatctgcccttttaagttctgataggtctgatgatgatgtgctaaccattttgatttgtgtgtcaaatctaagcaaagaccatgtttgagtattgtctttatgaaatgacatttcggtaaattagaaacaacaataggcttgtttagcccttaaacatgttgatgaaacttttcattttcctgaaagaattatagattttggaaggtcctcttctatattatttttccaagaaggggaaaacgattcttacattttgctgtaggaaagtgtggcatgttacttcttatttaattatccaacttgccccccttctctgtggtagcatttttaatgtagtacttaaggctgttgtctcttaaaggctacaggggcattttcaccaccactagtataactttaatattatttactatatacagcatgagcaattataaaccctgaaggtaatagtggaaatgtttgaggatacattgaaatagtctctcaataatggggagactgcattatgctttgatagcaagacattttggaaaccattacaactctgtgtattttgtttcattaatgtaattacataccatctcttccacacacaccccagaatattatacatttttattttgcccaagcctgtttcagtcatcagtttgtagtcttttacttccacttgtaacttgataactgagtagaacaggggtttgctagagtatatttccctgtgcttctttaggtagttgactatgctattaagataacagtatttgcttactgataacttgagaaacagtcattttcttggtctgtgctaaattgcatctcttccagtggcagcttatttctttaacttttttgacatattaagattttaatcatggtaatactgaaattgtttcaaatttgaaagagcgaacctcagtaacttcaatgaaacaaatgggtttgtgatttctagccatgttaaatgaacacacaattaaaaggaaaaccattagtggtgcaaagagccctgtgctggaaatctcaaagtcttgctctgccacttttaggggccactgtagtaataataataatcaccctgtctacttcacagggttgttataaaagttgtcaatgataaaatggatataagtgagttttttaatgtgcagatcctttatatatttaaaagggatgttatattttacccactatatacatagaaaaatcatgcccagttatgacttccaataagaatttcaaccaaatagaatctctatatgtggatgtagtgcttgaggtctgggtcactagatggataaaaaccaagtgtacatttttttatattctaccaccagtcctgagcacagcactttgcctcagaaggttctgattcaccaagacttactacatgggaatagactgatttagctcaggagctccttttaatgcaaatatttattttgcttgctgagaacaaaggattacagtgccaataactcaagaaaaggagcaggcaagccaggtctgtagagagaaaatgaactggaaaataaagtaattctggggtgagtttgatctgcactttaattcaagtctcagaaccacgtgacatatagtgatcaaaatatactctcaattgcatattaggccttcctttggggacctgggctatttattcagcactgtcccaaattaatagctaaatgactgagcctcaaatttgccgagcccgtgtaatattggtataaatttggcaaggaaagcaaatgagaaggcaggcaaaggggtgggtgaggggaagcttgctgaagctcagtatctcaaagtgagttgtggatgcgtgtttaacactataaagaaccagtccattcttacccatgagttttattgctttctgggacctctaacccaggaccacccctgattcaccaacttctccttcttctcctctttaaatattatagttcattgtgatatgtttttcctgtatctgctctatcatgtgacctcctttcgcctgggagggcagattttctccttatctcttccatccatgtctgttcttagctaagagttccagcctcagtacagctggattaccctttggacagaagggcagacaacctcaaggtcagcagcaacagaagttgggcctagtagtcagatcacaagtgagtgtggctattcatgagaatagggtggtggtggcatttatcctgcttcccctccataaataaacctggtaattttatttttaatgttacaaaaaaagttgatgctacattaaatgttttaccctcatccattatcataaatctcatactggaggtgtgatctctcttcttgtttctttaattgaaagtaccaatgaatcgaggcctggtggatgatgcctttagagttttttgttttgttttgtttttgttttcttgaatcattgaaacttgtcatttttatctagactcttccacaaatggcaaagtcacttatctgcagaattcccagaatcttcttttgcctttgtgcacctgctaattaccccctctgaactgaatttgaaaaaattaattaaaataaccgaatcacccatgtttttgttcttgcagggtttggtgagttatgtggattaaaagaacagactatcctctctctttttttgtctttcttctccctgtccaatactgaggaagaagagggagaagggggtaaagatacataaggcttaactacccagggttatgaaaacagtttgcaaagtcttcctgtttgcttcccttttggtttttcttagtccctgtaggaaaaagtttacccctctgtgtgcgagtgtgtgtgtgtgtgtgtgtaagtagttgagtgaaaaagaatgagactgacttaaggagagtcaatatcgcatatgaatcaaaagccaacatttagctattagatagatctcagtgaaaggatatgttcaagctaagttgattaagtttattaaacttatttattaagcttgactaagcttattaaaacttctgctaggttgaagccattagtaaccatctgtagaagataacagccatgagtttcacaaatacagcagcagtgtctgctagaattgtgctgtgagccacgaatgcaaaccacatatgcaattttcaaattttctagtagctaccaaaaaggtaaaagaaaaagatgaaattaattttaataatgtatttgacttagccttatatatccaaaatgatagcatttcaatatgcaatcaatataaaaacatgaatgagctattttacatttttgtactgagtcttcaaactctagtgtgtattttatacttactatacatctccagtctcgaagtagccacatttcaagtgtataagagctgcatgtgagttggctattgtattggacagtcccattcctgtttcctagtattgataaagtcttcctaccttccttcgttgttatgggagaaaatgtaaacagaacctgcctattacacgagagctgcaatatttccccaaatgcagcccagcagtaccatgagctgccctgtggaaaaatttaatctgtgattaaataagttaggaaagttttattattttacccccttttgaagattacatggtacattaacatattaaagattgagtaaactctcctgggtaaaaaaacctgtttgacgttgtttagttgttgagttctgtgtctataagaatcctagaaattgccacaagtgtctctccataagaaaaactttgtgttttcctctctttctccactccttttggggcccatttctatttatctttgtattcagaatcacccgagagccacaatatctcttttgttctagaacaaccacctcctaaattgaaaccaacagatggctttaaagtcttgcacttggacatagatcttcagaaagtaccaaaatatataccttcctcttattctttcagaaacggtgaacactctaaaaagatgtgggggtgtggtgggggatatgtgaatgtgtatatgtgtaaacaccaaatacatacagtttcttaagtagagtaatgcaattcttgctgatgttttatttttatttttatttttttatttttttttttttttgagacggagtctcgctctgtcgcccaggctggagtgcagtggcgggatctcggctcgctgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaatatttttatattttgtgtgtggtgacaatgtacatgctttaatgtgtactgttctagtaatatgtatgaagtagctgtgacatagcagtcagttttaaagatacagactataattgactactgtcaatctttaacaagtgatctttttgcaacttggttttagtggggtctctgacgttgtccccacaagtttcattttaaaatctatgcttaagtggcagttaccaatataattaattctgctgctgaatttggttcatattgaatgtggtaacccttatatgtggatatattcaaacatgtggattgatttagatcatccgttttgtctttgttttttaggactttgctatttcaatattaaagatgtcttttgaatactgtagcagcagtagaatccctatgttcttgaaaatgcaaaatgtaacatgagttgcacatagactctctagcagtagaaatggaatattctaagtgcagaagtttggttttagaatctgttaaggaaggacggcccaatctttgaaaaggtacagctttctcaactttgaacatctgggggaactcttcttggaagtctgaattttaatatctttaatccaatggctctaaattaacaaacattaaaaaatggatttcgtagaatcaaattattagggggagcactttgcaaagccatatactggtgaatatatactgggtcaagcaccacatgttagttttggaatgtgtatttcccagcgaatagaatttactgctccaaaaagcttttttggcataaatcacaatacttacagaaatataattgtatcattgaaaaaaacaaagctcaccttcctaatgatacatttcacaaactgcacattagggcaatttcttacttatgaggaggtacaaagaaatactctgtcaatatagtataactgcttatttcaaattgtatctaggaatgaataactactattatttaaagtactactgaattttgaggaactgatcaaagaattagtattattaataaaattgtactatttgcaatatatttgccttggcacaaatgcagagttaaaaacataaaattataaaaaaaaataatagtgattggttgttactactttaaaatcctactaatttccattagcactaaatcaaacagcacttatctgttgtatacaagtaaaattttgaaagactcggacacaaaatgaaaggctttttaaaaatgtctttgccataacaggttatatgacctcttgctaattgttatatttccttaggggcactttgaggctctttcaaagacatctgcagcaattaggtctaaatttagagtagaatattttgccagatattttactatatcacaaaatgtcatactactgtattttataataaaaccaaattctcaagtattctggtatgttacatattaatataccaaaacatcactttctataagtctattattatgtacataatatttttaaaaataatgggtattttggtcctagtgaaaaagtataatgcaatacatgacattaatctttagtcaaaacccattgaggtgtctgacagggaaattagcaatcataagctataagatatatattattttcaaggacaaaatggcaaatgataatacagaaagacgtgatcactggagcaagttagctggtgtgcagactaagaaggatcaacttgcaaatgctcatcagaatttagcttttgttattggttgttctgcaggggatagtactagtcagttgatattgcttccctttcatgtgggagtttgctcacagcccactgcatggtataatgaaatctctataagcaagatagagtcagaagcttagagatgcactttatggtttttacaactgctgttacaatgttctaaacactgtgatctttccaaatgtgttttctgtattcgttttgtactgtagaaaataattcgctataaactggactttatagtgtttaaagcgatgttatttattggcttattgcccctccttataatacatttatgtacagtacacttaatgtaaaacctgtgataatcctttgccttaaaataaaatctaatgctaaata

SEQ ID NO: 4544 - DNA, 628 bp, Homo sapiens
gactcctcctgggataacttgtccacacatcttccactagggtaaggctacttctggctgaggagacacttggatgtagctcaagtgctgcttaggcagtcctgatctctcctctcgtctcttcccagggagctgaaaagccagattcgacctggtagccaagcaatgtcacagcagaagcagcaatcttggaagcctccaaatgttcccaaatgctcccctccccaaagatcaaacccctgcctagctccctactcgactccttgtggtgctccccattcagaaggttgtcattccagttcccaaaggcctgaggttcagaagcctaggagggctcgtcaaaagctgcgctgcctaagtaggggcacaacctaccactgcaaagaggaagagtgtgaaggcgactgagcccagaagagttgaggcacaggtgcagttactctctccctgccccacctttgggtactaattcccccttggaaagccaggccctcaacctctcatttggactgagaaacacttcctgatccccagctctagagaagcgagaactaggctgagccacgctgctactgctctcttccattcaccccttcagctcagcaacaataaagctgctttacttgga

SEQ ID NO: 4545 - DNA, 6297 bp, Homo sapiens
agaaagcggacaggagggcgacttttctccgtcaggctggaactggtgccgctggaggcgggagcgggctggaggacggacagggtctggaaatgtttaatttggtaaattggaggaaaaaaacatggatttttagcaattgaagagcaaattaaggtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggccagaacaattgtctgaaattagtaacaatgctgcatctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagatttagaagatattgtattgatgtatgtactat

SEQ ID NO: 4546 - DNA, 2416 bp, Homo sapiens
gggacgcgccggcgctgcggcgttggcgcagtcgtgggaacagcgcggagcagagaagcaccaaaagaggcaaactgagatgcagacaaatgatcatccgtatgctgatcattttgaatagttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatgagaattcacaaaataatctacctcaaattatggctaaacatcagaatgaagtaaaaaatttaaggcaactacttaggaaatcccaggaaaaggaaagaactctatctaggaaacttagagaaactgacagccagttactgaagactaaagatatcttgcaggcactgcagaaactttctgaagacaaaaaccttgcagaaagggaagaactcactcataaattatctattatcacaacaaaaatggacgcaaatgacaaaaaaatacagagcttggaaaaacaactgaggttgaactgcagagcctttagccggcagctggctattgagactcggaagactttagcagctcagacagctaccaagactctgcaggtggaagtaaaacaccttcaacaaaaacttaaggaaaaggatcgtgagcttgaaattaaaaacatctatagtcatcgaatacttaaaaatttacatgacacagaggactatccaaaagtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagccctcatttggtaagtcttccagaataaaagtgaaggatacaactttcagagataagaaaagcagtctcatggaagaactctttggatcaggctatgtcttgaaaactgaccaatcaagtcctggtgttgcaaaaggctcagaggagcctttgcaaagtaaggagtcgcatcccctgcctcccagtcaggcctccaccagccatgctttcggagactctaaagtaactgtggtaaattctattaagccatcgtcacctacagaaggaaaaagaaaaataattatttaaatataatcaatatcctaatgcattctggtttgatataa

SEQ ID NO: 4547 - DNA, 2564 bp, Homo sapiens
gcggagcaggtaacggccccgctgctgccgtcgtccccctcagccggttaccctgttacagccccagctctgggcccttccggaccctcctgctacgctctttctgggcttccagtatcgccggtcactcagtcctcgcccctgcctgcctcgctggcgccccgccgtttcctcctcgcggcacagtttgccaaggaacagctaccccggctcggcagtgaccgggcgccccggcgacacacgtactctcaggcccgctgggcagggggacggcctgggccgaggttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatgagaattcacaaaataatctacctcaaattatggctaaacatcagaatgaagtaaaaaatttaaggcaactacttaggaaatcccaggaaaaggaaagaactctatctaggaaacttagagaaactgacagccagttactgaagactaaagatatcttgcaggcactgcagaaactttctgaagacaaaaaccttgcagaaagggaagaactcactcataaattatctattatcacaacaaaaatggacgcaaatgacaaaaaaatacagagcttggaaaaacaactgaggttgaactgcagagcctttagccggcagctggctattgagactcggaagactttagcagctcagacagctaccaagactctgcaggtggaagtaaaacaccttcaacaaaaacttaaggaaaaggatcgtgagcttgaaattaaaaacatctatagtcatcgaatacttaaaaatttacatgacacagaggactatccaaaagtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagccctcatttggtaagtcttccagaataaaagtgaaggatacaactttcagagataagaaaagcagtctcatggaagaactctttggatcaggctatgtcttgaaaactgaccaatcaagtcctggtgttgcaaaaggctcagaggagcctttgcaaagtaaggagtcgcatcccctgcctcccagtcaggcctccaccagccatgctttcggagactctaaagtaactgtggtaaattctattaagccatcgtcacctacagaaggaaaaagaaaaataattatttaaatataatcaatatcctaatgca

SEQ ID NO: 4548 - DNA, 2364 bp, Homo sapiens
gagaagcaccaaaagaggcaaactgagatgcagacaaatgatcatccgtatgctgatcattttgaatagttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatgagaattcacaaaataatctacctcaaattatggctaaacatcagaatgaagtaaaaaatttaaggcaactacttaggaaatcccaggaaaaggaaagaactctatctaggaaacttagagaaactgacagccagttactgaagactaaagatatcttgcaggcactgcagaaactttctgaagacaaaaaccttgcagaaagggaagaactcactcataaattatctattatcacaacaaaaatggacgcaaatgacaaaaaaatacagagcttggaaaaacaactgaggttgaactgcagagcctttagccggcagctggctattgagactcggaagactttagcagctcagacagctaccaagactctgcaggtggaagtaaaacaccttcaacaaaaacttaaggaaaaggatcgtgagcttgaaattaaaaacatctatagtcatcgaatacttaaaaatttacatgacacagaggactatccaaaagtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagccctcatttggtaagtcttccagaataaaagtgaaggatacaactttcagagataagaaaagcagtctcatggaagaactctttggatcaggctatgtcttgaaaactgaccaatcaagtcctggtgttgcaaaaggctcagaggagcctttgcaaagtaaggagtcgcatcccctgcctcccagtcaggcctccaccagccatgctttcggagactctaaagtaactgtggtaaattctattaagccatcgtcacctacagaaggaaaaagaaaaataattatttaaatataatcaatatcctaatgcattctggtttgatataa

SEQ ID NO: 4549 - DNA, 808 bp, Homo sapiens
gcggagcaggtaacggccccgctgctgccgtcgtccccctcagccggttaccctgttacagccccagctctgggcccttccggaccctcctgctacgctctttctgggcttccagtatcgccggtcactcagtcctcgcccctgcctgcctcgctggcgccccgccgtttcctcctcgcggcacagtttgccaaggaacagctaccccggctcggcagtgaccgggcgccccggcgacacacgtactctcaggcccgctgggcagggggacggcctgggccgaggttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaag

SEQ ID NO: 4550 - DNA, 706 bp, Homo sapiens
ccggcgctgcggcgttggcgcagtcgtgggaacagcgcggagcagagaagcaccaaaagaggcaaactgagatgcagacaaatgatcatccgtatgctgatcattttgaataccttcagccatgcttctgccactgcctctgcaggaaagccacctgctttaaaaaaaagtcttcatggagtgcttatgagagggtcggctgttttctccagctcatttttccaaagcaaacaatcccaccagctatctcaggttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaaga

SEQ ID NO: 4551 - DNA, 885 bp, Homo sapiens
cggcgttggcgcagtcgtgggaacagcgcggagcagagaagcaccaaaagaggcaaactgagatgcagacaaatgatcatccgtatgctgatcattttgaataagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatg

SEQ ID NO: 4552 - DNA, 690 bp, Homo sapiens
ccggcgctgcggcgttggcgcagtcgtgggaacagcgcggagcagccttcagccatgcttctgccactgcctctgcaggaaagccacctgctttaaaaaaaagtcttcatggagtgcttatgagagggtcggctgttttctccagctcatttttccaaagcaaacaatcccaccagctatctcaggcaagaaacacataatccaaaaactttaattatttatgttcaactctgtactggaaagaaagagcaggcaggttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttct

SEQ ID NO: 4553 - DNA, 523 bp, Homo sapiens
ggaggccccgcgcgcgggtttccatggggacgcgccggcgctgcggcgttggcgcagtcgtgggaacagcgcggagcagagaagcaccaaaagaggcaaactgagatgcagacaaatgatcatccgtatgctgatcattttgaatagagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaaga

SEQ ID NO: 4554 - DNA, 849 bp, Homo sapiens
ggccccgctgctgccgtcgtccccctcagccggttaccctgttacagccccagctctgggcccttccggaccctcctgctacgctctttctgggcttccagtatcgccggtcactcagtcctcgcccctgcctgcctcgctggcgccccgccgtttcctcctcgcggcacagtttgccaaggaacagctaccccggctcggcagtgaccgggcgccccggcgacacacgtactctcaggcccgctgggcagggggacggcctgggccgagtctgtcagcactgccttcaaaatgcacccagaatagattcacaattctaccatttctctcaaccgccactgtcaccaccttggtccaggcccccatcatctgagaagcaccaaaagaggcaaactgagatgcagacaaatgatcatccgtatgctgatcattttgaataatgaaaagcggaatctaatttgcatttcattatgagagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaa

SEQ ID NO: 4555 - DNA, 805 bp, Homo sapiens
ggggacgcgccggcgctgcggcgttggcgcagtcgtgggaacagcgcggagcaggttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccagtgaggagattgtggactgcctaatatatttcatcagaagagaaggctggagaattaagcagatgcagcaaaaagcagaaactgacttcaaaaaaaaccctctcagtagagaaagtgatattagattcctattgcaaaggatctaatgccagttaaattctcttttgctttcttgataaaacaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaagg

SEQ ID NO: 4556 - DNA, 657 bp, Homo sapiens
gcgcagtcgtgggaacagcgcggagcagtctgtcagcactgccttcaaaatgcacccagaatagattcacaattctaccatttctctcaaccgccactgtcaccaccttggtccaggcccccatcatctgagaagcaccaaaagaggcaaactgagatgcagacaaatgatcatccgtatgctgatcattttgaatagttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccagtgaggagattgtggactgcctaatatatttcatcagaagagaaggctggagaattaagcagatgcagcaaaaagcagaaactgacttcaaaaaaaaccctctcagtagagaaagtgatattagattcctattgcaaaggatctaatgccagttaaattctcttttgctttcttgataaaacaggagaattgagaattaaatgaaaaggtaaatccttttaaagacctcagaagatggatctgtttgtttcaatctgcttttgaggttgtttgctatgtctttggctgatctaacaaaaacaaatat

SEQ ID NO: 4557 - DNA, 612 bp, Homo sapiens
atggggacgcgccggcgctgcggcgttggcgcagtcgtgggaacagcgcggagcagagaagcaccaaaagaggcaaactgagatgcagacaaatgatcatccgtatgctgatcattttgaataagaccaaaacctgtcaaaaaaatactaccgtggaaagctcataaatactacagtgtgaagaaccctgtgcttatcttcagtttatcatcagacatcttagggaagtttaataaagaacaccagtgaggagattgtggactgcctaatatatttcatcagaagagaaggctggagaattaagcagatgcagcaaaaagcagaaactgacttcaaaaaaaaccctctcagtagagaaagtgatattagattcctattgcaaaggatctaatgccagttaaattctcttttgctttcttgataaaacaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagag

SEQ ID NO: 4558 - DNA, 600 bp, Homo sapiens
gaagactggacacaattccgaaggtcgcccagaaggagaggacaatgtcatttctaactgtgccatacaaactgcctgtgtctttgtctgttggttcctgcgtgataatcaaagggacactgatcgactcttctatcaacgaaccacagctgcaggtggatttctacactgagatgaatgaggactcagaaattgccttccatttgcgagtgcacttaggccgtcgtgtggtcatgaacagtcgtgagtttgggatatggatgttggaggagaatttacactatgtgccctttgaggatggcaaaccatttgacttgcgcatctacgtgtgtctcaatgagtatgaggtaaaggtaaatggtgaatacatttatgcctttgtccatcgaatcccgccatcatatgtgaagatgattcaagtgtggagagatgtctccctggactcagtgcttgtcaacaatggacggagatgatcacactcctcattgttgaggaaaccctctttctacctgaccatgggattcctagagcctgctaacagaataatccctcctcaaccccttcccctacacttggtcattaaaacagcaccaaaccgta

SEQ ID NO: 4559 - DNA, 1246 bp, Homo sapiens
cattccttctgcaaaggactgcctggcaggtgtgaaaggcagcggtggccacagaggcggtggagatggccttcagcggttcccaggctccctatctgagcccagccgtccccttttctgggactatccaagggggtctccaggacggatttcagatcactgtcaatggggccgttctcagctccagtggaaccaggtttgctgtggactttcagacgggcttcagtggaaacgacattgccttccacttcaaccctcggtttgaagacggagggtatgtggtgtgcaacacgaggcagaaaggaagatgggggcccgaggagaggaagatgcacatgcccttccagaaggggatgccctttgacctctgcttcctggtgcagagctcagatttcaaggtgatggtgaacgggagcctcttcgtgcagtacttccaccgcgtgcccttccaccgtgtggacaccatctccgtcaatggctctgtgcagctgtcctacatcagcttccagaatccccgcacagtccccgttcagcctgccttctccacggtgccgttctcccagcctgtctgtttcccacccaggcccagggggcgcagacaaaaacctcccagcgtgcggcctgccaacccagctcccattacccagacagtcatccacacggtgcagagcgcctctggacagatgttctctcagactcccgccatcccacctatgatgtacccccaccctgcctatccgatgcctttcatcaccaccattccgggagggctgtacccatccaagtccatcatcctgtcaggcactgtcctgcccagtgctcagaggttccacatcaacctgtgctctgggagccacatcgccttccacatgaacccccgttttgatgagaatgctgtggtccgtaacacccagatcaacaactcttgggggtctgaggagcgaagtctgccccgaaaaatgcccttcgtccgaggccagagcttctcggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacataggcggctccctggccctggggccgggggctggggtgtggggcagtcggggtcctctcatcatccccacttcccaggcccagcctttccaaccgtgcctgggatctgggctt

SEQ ID NO: 4560 - DNA, 3159 bp, Homo sapiens
ttaaattatatgtagagacagggtcttcctatcttgaccaggctggtctcaacttcttggactcaagtgatcctcccgcttcagcctcccaaagggctgggattacaggcatgagccaccacgccctgcccatttttctaagttggattattttacactcaagtctgctatgaatgatagttccagttgttccatatcccaatcaattggtgattgctacaaatgacgtgacgtgatgaaaatattcctggtgttcgagaggattgcaaagaatttcccttcttttctctcctttctgctccccttgtactgtctactccttaacttggtcaaattctacttgatccagaacataatgggatggtgagtgcagacgacacacacggcctcagtctatgggaacatctcaaaggagttcgtctgcaaattctagtgcatctaggcagaacacaggaaggaagagaggtgcagactcacgtatggcctggggcacctgccatcccctcgagcctgtatggtccttacccgcccatccccagcttgagttctgggccttctcgccagcacatcgttgggacctggtcaacttcaggtaagtttatttcatggctccctctcccctctgcagcctatcctgttattctctgtttcagccaattatttcccctaactaggtgctgaagccaattaaaggcagttcatgccatatgttccttcccactcccatgtcacttgaaatgttctattatgtccaagacttctctccccatcctaaagctcacaaaataaggatggagaagagaagaaagagagattcactgagggggaggatcagaagctcctgggcaccccatactctagaataaaaatcttcattatagtgtttttcatgcaaaatattcccttctacataattatgttttaacatgaagaatagaaatttaaagaggagaaatacttcttgaagattctgagaatcttcatatagctcaggctgccacgaattagctgtgtgacctggggcatgtccctcagactctgagcctcagcttctctatatgtaaaatgggttgaagccgcccttccccacaagcaccctgtgcacaggcaatgcccagccccattattttctggaaccagtggccaagcatgcttaggacacccagccacatacttctgggcagtgtcatctggcaactcactgtcatgtcagtgtggtcaagcattgtagacctctatgaaccaaatatgcttcaggctggggttgagcacaggagagggaggagggaaaggtcactggggctgggagtgcctacttccctctatgagtgtcaccccagttcacccaacaccctacctttctctctctggacccacttcctcttgctgccggctcctccccattgaataacagccaagttgctttggtttctattactttgttaagtcattccttctgcaaaggactgcctggcaggtgtgaaaggcagcggtggccacagaggcggtggagatggccttcagcggttcccaggctccctatctgagcccagccgtccccttttctgggactatccaagggggtctccaggacggatttcagatcactgtcaatggggccgttctcagctccagtggaaccaggtttgctgtggactttcagacgggcttcagtggaaacgacattgccttccacttcaaccctcggtttgaagacggagggtatgtggtgtgcaacacgaggcagaaaggaagatgggggcccgaggagaggaagatgcacatgcccttccagaaggggatgccctttgacctctgcttcctggtgcagagctcagatttcaaggtgatggtgaacgggagcctcttcgtgcagtacttccaccgcgtgcccttccaccgtgtggacaccatctccgtcaatggctctgtgcagctgtcctacatcagcttccagaatccccgcacagtccccgttcagcctgccttctccacggtgccgttctcccagcctgtctgtttcccacccaggcccagggggcgcagacaaaaacctcccagcgtgcggcctgccaacccagctcccattacccagacagtcatccacacggtgcagagcgcctctggacagatgttctctactcccgccatcccacctatgatgtacccccaccctgcctatccgatgcctttcatcaccaccattccgggagggctgtacccatccaagtccatcatcctgtcaggcactgtcctgcccagtgctcagaggttccacatcaacctgtgctctgggagccacatcgccttccacatgaacccccgttttgatgagaatgctgtggtccgtaacacccagatcaacaactcttgggggtctgaggagcgaagtctgccccgaaaaatgcccttcgtccgaggccagagcttctcggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacataggcggctccctggccctggggccgggggctggggtgtggggcagtcggggtcctctcatcatccccacttcccaggcccagcctttccaaccgtgcctgggatctgggctttaatgcagaggccatgtccttatctggtcctgcttctggctacagccaccctggaattgagaaggcagctgactgggattgtcttcctcagccgcagcagcacctggggcgccagctgctggaatcctacaatcccagaaggcgggcacagccagggagaggggaggagcgggcagtgaagatgaagccccatgctcagtcccctcccatcccccacgcagctccaccccagtctcaagccaccagctgtctgctcctggtgggagatggcctcctcagcccctcctctctgacctttaacctcactctcaccttgcaccctgcaccaacccttcacccctcctggaaagcaggtctgatggcttcccactggcctccaccaactgaccagagtgttctcttcaggggactggctcctttcccagtgtccttaaaataaagaaatgaaaatgcttgttggcacattca

SEQ ID NO: 4561 - DNA, 1688 bp, Homo sapiens
ggtgtcaaaggcagtggtggccacagaggcggtggagagatggccttcagcggttgccaggctccctatctgagcccagccgtccccttttctgggactatccaagggggtctccaggacggatttcagatcactgtcaatggggccgttctcagctgcagtggaaccaggtttgctgtggactttcagacgggcttcagtggaaacgacattgccttccacttcaaccctcggtttgaagacggagggtatgtggtgtgcaacacgaggcagaaaggaacatgggggcccgaggagaggaagatgcacatgcccttccagaaggggatgccctttgacctctgcttcctggtgcagagctcagatttcaaggtgatggtgaacgggagcctcttcgtgcagtacttccaccgcgtgcccttccaccgtgtggacaccatctccgtcaatggctctgtgcagctgtcctacatcagcttccagaatccccgcgcagtccccgttcagcctgccttctccacggtgccgttctcccagcctgtctgtttcccacccaggcccagggggcgcagacaaaaacctcccagcgtgcggcctgccaacccagctcccattacccagacagtcatccacacggtgcagagtgcctctggacagatgttctctcagactcccgccatcccacctatgatgtacccccaccctgcctatccgatgcctttcatcaccaccattccgggagggctgtacccatccaagtccatcatcctgtcaggcactgtcctgcccagtgctcagaggttccacatcaacctgtgctctgggagccacatcgccttccacatgaacccccgttttgatgagaatgctgtggtccgtaacacccagatcaacaactcttgggggtctgaggagcgaagtctgccccgaaaaatgcccttcgtccgaggccagagcttctcggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacataggcggctccctggccctggggccgggggctggggtgtggggcagtctgggtcctctcatcatccccacttcccaggcccagcctttccaaccgtgcctgggatctgggctttaatgcagaggccatgtccttatctggtcctgcttctggctacagccaccctggaatcgagaaggcagctgactgggattgccttcctcagccgcagcagcacctggggcgccagctgctggaatcctacaatcccagaaggcgggcacagccagggagaggggaggagtgggcagtgaagatgaagccccatgctcagtcccctcccatcccccacgcagctccaccccagtctcaagccaccagctgtctgctcctggtgggagatggcctcctcagcccctcctctctgacctttaacctcactctcaccttgcaccctgcaccaacccttcacccctcctggaaagcaggcctgatggcttcccactggcctccaccaactgaccagagtgttctcttcaggggactggctcctttcccagtgtccttaaaataaagaaatgaaaatgcttgttggcacattca

SEQ ID NO: 4562 - DNA, 1117 bp, Homo sapiens
aagtcattccttctgcaaaggactgcctggcaggtgtcaaaggcagtggtggccacagaggcggtggagagatggccttcagcggttgccaggctccctatctgagcccagtttgctgtggactttcagacgggcttcagtggaaacgacattgccttccacttcaaccctcggtttgaagacggagggtatgtggtgtgcaacacgaggcagaaaggaacatgggggcccgaggagaggaagatgcacatgcccttccagaaggggatgccctttgacctctgcttcctggtgcagagctcagatttcaaggtgatggtgaacgggagcctcttcgtgcagtacttccaccgcgtgcccttccaccgtgtggacaccatctccgtcaatggctctgtgcagctgtcctacatcagcttccagaatccccgcgcagtccccgttcagcctgccttctccacggtgccgttctcccagcctgtctgtttcccacccaggcccagggggcgcagacaaaaacctcccagcgtgcggcctgccaacccagctcccattacccagacagtcatccacacggtgcagagtgcctctggacagatgttctctcagactcccgccatcccacctatgatgtacccccaccctgcctatccgatgcctttcatcaccaccattccgggagggctgtacccatccaagtccatcatcctgtcaggcactgtcctgcccagtgctcagaggttccacatcaacctgtgctctgggagccacatcgccttccacatgaacccccgttttgatgagaatgctgtggtccgtaacacccagatcaacaactcttgggggtctgaggagcgaagtctgccccgaaaaatgcccttcgtccgaggccagagcttctcggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacataggcggctccctggccctggggccgggggctggggtgtggggcagtctgggtcctctcatcatccccac

SEQ ID NO: 4563 - DNA, 3539 bp, Homo sapiens
gcaggacagccccgggatccccgcccgcgcgccgcgtcccacgtaccccgccgcgccgggcaagaagatggcgggatcagtggccgacagcgatgccgtggtgaaactagatgatggccatttaaacaactctttgagctctccagttcaagcggacgtgtacttcccacgactgatagttccattttgtgggcacattaaaggtggcatgagaccaggcaagaaggtgttagtgatgggcatcgtagacctcaacccagagagctttgcaatcagcttgacctgtggggactcagaagaccctcctgccgatgtggcaatcgaactcaaagctgtgttcacagatcggcagctactcagaaattcttgtatatctggggagaggggtgaagaacagtcagcaatcccttactttccattcattccagaccagccattcagggtggaaattctttgtgagcacccacgtttccgagtgtttgtggatggacaccaactttttgatttttaccatcgcattcaaacgttatctgcaattgacaccataaagataaatggagacctccagatcaccaagcttggctgatttaaaccacctctatttcaaataggatcacgtgccacaactatctgactgttggtctggaagaagtgtcctagcaagatctggagacttaaaaagaaaacaaaaacaaatggcaagtttcacttaagggtggtttgcccttaagaagaaagctgttgggacaaagacaccgagccattatacccagaataaaataatacatttatgctggattttattcagaccaaactaaaatggatttgtgatgatttgtgatttggtagcaaattattcatcttttcaaagcaaggcaatgcttagaaacagaagtgctaaagacacttaaaaagccaacaacaacggtacagtgaaatcaatgcatttctgcactaaagtggaattgtgtagcacaaccaatattttagtcagggtatttacatagaatgtaggttgttcaaggtttgactttttttttgttttttgtttttgtttttgtttttgttttgcacagcataatgttaattcagattgttgaagctttcttgtagttatttatttatactcaatgtatgtattaaagaatgaacaatgtctcaagaacagcaagttgtaaacttttgaatgtataaatatcttaggtccaaggggagaaaattacatattacaattatgaaacaggtgaatttctgctttaaagaattgagattctccatacccctaaacttaggatctcttgatataaactgctgtaagtgcttttgggaaacctttgcaaaaccattttgataaaactgctttccaagttattgttggttatgtaaaattctatttacattgctttttctccttactgggaattagcacattattggcttccttaagactaattatttctctcttgatttatataatagctcattaagttgttattaatcaaaaacacaaagaggtgattgcttagacaatttttaaagtgactatagtataaacttttaaaagaataatatgaaaatgactgtggaatgcagtgtaaagcagaagcaaacggccctgaataacttacttggaagtaatttatatcaacttaagctgttagctcattgtataacttttcttatgtgaccctcaccaatatccctaagtaatgcctttggaagcttcagagtagaagatgcttcctactgtgttggctctgaggagatagtaggattagataggatccagattaggaaatgatccagttagtttatctgaaaggttaactcccaggactccaggtctttgaatccagccagtagagtgaatgcttccaattaagctgtaggtgttaccctgcacttacggaactgatcaaacaggtgactccaacaggaggttgcagtactgtaaacgtcaccgcaaggcaagggatgcttaaagtcctgggttctggactttaaaagctacattggccctggagggagggacccttggcattgctttgatcaggtagtgagggaagacagggttctggggtgggggtgtatttatatataatttaggttttgtttgtacagcatactgtgtcttgtaatgacacatccttgtcctgctttccttttttgagttttttttttttttttacacaacatgcagaggcactgaagtgaccatgtcattttcaagtgtcaagaatgtagacagtgtttcagtaccaaagtctaaaataaactaaaattatgaattttttataggtgatacatttggattcttctcaactttgaaactgtttagcacagttccattgtattatataagaagacactgtatccaacaagactggctgtacattgaaaagctttatgtaccagccaacttatttaaccatattcagcctgttccgtgggggctgttctgtggttccaggtattttcaagcctgtgattaacttctcatggcttgtcacttaaaagtccctaaatttgagagacttaaagggcaccttgaaatacatttgtggagttttgatccaacttatggtggaagagccccataggaagactgttttgagtggccaaccattcccacccactgcataattcagcagaaactagaggagcagggcgtgtactgattggaattgacacgcttattctgtctacctatcagctaactcattagcagccaagcccttaggcagcttagtgtgaaaatacaatgttaactgtttgtttctctgtgaggttagtgggaaccgcttggataagcctattgggattaatctaaatgatgtgatgatttgattcaggtatagcccaaattagtaaggggctttagctgtaaactgaaaacaatattcacaccctctcctgggcctgtaaggtctaaggtgagaatttcaggatggaaaatgcaatgtaaagcttccacaggaaagtattcgggtatgtaaggtgttatttctgaccagagccctagttctgcaataaccaaaaccaaggagtataaataacaatcaggctctgggggaatagaaagcaggctttagacaatctgtccatttctacagtaaaattggagtgagtgtgtatatctacttaaaacttaatagaagtgacttctactttttgggctattccagaagtattttaaaattattatttaaaattttgaagccccatttcaaatcttgccgaccttagttcaaagccccctgagagatcacttttagaattgaggatttgttaaaatggcaagtcatttcatttgtgttaaaaagaaaatacccaaaaggaaggagggagccctgtttgccttgagataaacggccttggcattttctggcattaatgtagaaataatgttcctatgatgacatattttcaaagaaacactttcttatttactgtgtggtgtaaaatgttgctaaatgtgttgttacattatgtcactgctgaaagtaatttgcactataataaaggaattttctacaaaa

SEQ ID NO: 4564 - DNA, 1929 bp, Homo sapiens
agttgttgaccagcctgccacttgcctccctgcctgcttctggccgccttgaatgcctggtccttcaagctccttctgggtctgacaaagcagggaccatgtctacctttggctaccgaagaggactcagtaaatacgaatccatcgacgaggatgaactcctcgcctccctgtcagccgaggagctgaaggagctagagagagagttggaagacattgaacctgaccgcaaccttcccgtggggctaaggcaaaagagcctgacagagaaaacccccacagggacattcagcagagaggcactgatggcctattgggaaaaggagtcccaaaaactcttggagaaggagaggctgggggaatgtggaaaggttgcagaagacaaagaggaaagtgaggaggaagaagacagtgacgaagaggaaagaacaattgaaactgcaaaagggattaatggaactgtaaattatgatagtgtcaattctgacaactctaagccaaagatatttaaaagtcaaatagagaacataaatttgaccaatggcagcaatgggaggaacacagagtccccagctgccattcacccttgtggaaatcctacagtgattgaggacgctttggacaagattaaaagcaatgaccctgacaccacagaagtcaatttgaacaacattgagaacatcacaacacagacccttacccgctttgctgaagccctcaaggacaacactgtggtgaagacgttcagtctggccaacacgcatgccgacgacagtgcagccatggccattgcagagatgctcaaagtcaatgagcacatcaccaacgtaaacgtcgagtccaacttcataacgggaaaggggatcctggccatcatgagagctctccagcacaacacggtgctcacggagctgcgtttccataaccagaggcacatcatgggcagccaggtggaaatggagattgtcaagctgctgaaggagaacacgacgctgctgaggctgggataccattttgaactcccaggaccaagaatgagcatgacgagcattttgacaagaaatatggataaacagaggcaaaaacgtttgcaggagcaaaaacagcaggagggatacgatggaggacccaatcttaggaccaaagtctggcaaagaggaacacctagctcttcaccttatgtatctcccaggcactcaccctggtcatccccaaaactccccaaaaaagtccagactgtgaggagccgtcctctgtctcctgtggccacacctcctcctcctccccctcctccactcccagagaaaaagctcattaccagaaacattgcagaagtcatcaaacaacaggagagtgcccaacgggcattacaaaatggacaaaaaaagaaaaaagggaaaaaggtcaagaaacagccaaacagtattctaaaggaaataaaaaattctctgaggtcagtgcaagagaagaaaatggaagacagttcccgaccttctaccccacagagatcagctcatgagaatctcatggaagcaattcggggaagcagcataaaacagctaaagcgggtggaagttccagaagccctgcgataaaaacatgatctttagaagaggatgcagaactgttcagtggtattacatgaaatgcattgtgagatgtttctaaaataccttcttcaattcaaaatgatccctgactttaaaaataatctcacccattaattccaaagagaatcttaagaaacaatcagcatgtttcttctgtaaatatgaaaataaatttcttttttatgtcgtgagatttgtattggcaagaagcagttaatttaaagatgctcttcctatctgtggatgtgttggtaactccgagttgtaatgagttcatgaaatgtgctgttatttttgtaatctcaataaatgtggattg

SEQ ID NO: 4565 - DNA, 2165 bp, Homo sapiens
accagttgttgaccagcctgccacttgcctccctgcctgcttctggccgccttgaatgcctggtccttcaagctccttctgggtctgacaaagcagggaccatgtctacctttggctaccgaagaggactcagtaaatacgaatccatcgacgaggatgaactcctcgcctccctgtcagccgaggagctgaaggagctagagagagagttggaagacattgaacctgaccgcaaccttcccgtggggctaaggcaaaagagcctgacagagaaaacccccacagggacattcagcagagaggcactgatggcctattgggaaaaggagtcccaaaaactcttggagaaggagaggctgggggaatgtggaaaggttgcagaagacaaagaggaaagaacaattgaaactgcaaaagggattaatggaactgtaaattatgatagtgtcaattctgacaactctaagccaaagatatttaaaagtcaaatagagaacataaatttgaccaatggcagcaatgggaggaacacagagtccccagctgccattcacccttgtggaaatcctacagtgattgaggacgctttggacaagattaaaagcaatgaccctgacaccacagaagtcaatttgaacaacattgagaacatcacaacacagacccttacccgctttgctgaagccctcaaggacaacactgtggtgaagacgttcagtctggccaacacgcatgccgacgacagtgcagccatggccattgcagagatgctcaaagtcaatgagcacatcaccaacgtaaacgtcgagtccaacttcataacgggaaaggggatcctggccatcatgagagctctccagcacaacacggtgctcacggagctgcgtttccataaccagaggcacatcatgggcagccaggtggaaatggagattgtcaagctgctgaaggagaacacgacgctgctgaggctgggataccattttgaactcccaggaccaagaatgagcatgacgagcattttgacaagaaatatggataaacagaggcaaaaacgtttgcaggagcaaaaacagcaggagggatacgatggaggacccaatcttaggaccaaagtctggcaaagaggaacacctagctcttcaccttatgtatctcccaggcactcaccctggtcatccccaaaactccccaaaaaagtccagactgtgaggagccgtcctctgtctcctgtggccacacctcctcctcctccccctcctcctcctcctccccctccttcttcccaaaggctgccaccacctcctcctcctccccctcctccactcccagagaaaaagctcattaccagaaacattgcagaagtcatcaaacaacaggagagtgcccaacgggcattacaaaatggacaaaaaaagaaaaaagggaaaaaggtcaagaaacagccaaacagtattctaaaggaaataaaaaattctctgaggtcagtgcaagagaagaaaatggaagacagttcccgaccttctaccccacagagatcagctcatgagaatctcatggaagcaattcggggaagcagcataaaacagctaaagcgggtggaagttccagaagccctgcgataaaaacatgatctttagaagaggatgcagaactgttcagtggtattacatgaaatgcattgtgagatgtttctaaaataccttcttcaattcaaaatgatccctgactttaaaaataatctcacccattaattccaaagagaatcttaagaaacaatcagcatgtttcttctgtaaatatgaaaataaatttcttttttatgtcgtgagatttgtattggcaagaagcagttaatttaaagatgctcttcctatctgtggatgtgttggtaactccgagttgtaatgagttcatgaaatgtgctgttatttttgtaatctcaataaatgtggattgaagttttttccctttttttaaagccaaactaatatttttctgtgacttgatacatctgtcagatttttgtaatctcgataaatgtgtattgaagttttttccctttttttaaaaagccaaactaatatttttctgtgagttaatacatctgtcaggtgtgtatgtaacattactggacattaaaaaaaaatattacattctcaccc

SEQ ID NO: 4566 - DNA, 2346 bp, Homo sapiens
gcattgtcacagccctgtatcaccactcttaaaaggctcccacagccactcctagcaccagttgttgaccagcctgccacttgcctccctgcctgcttctggccgccttgaatgcctggtccttcaagctccttctgggtctgacaaagcagggaccatgtctacctttggctaccgaagaggactcagtaaatacgaatccatcgacgaggatgaactcctcgcctccctgtcagccgaggagctgaaggagctagagagagagttggaagacattgaacctgaccgcaaccttcccgtggggctaaggcaaaagagcctgacagagaaaacccccacagggacattcagcagagaggcactgatggcctattgggaaaaggagtcccaaaaactcttggagaaggagaggctgggggaatgtggaaaggttgcagaagacaaagaggaaagtgaagaagagcttatctttactgaaagtaacagtgaggtttctgaggaagtgtatacagaggaggaggaggaggagtcccaggaggaagaggaggaagaagacagtgacgaagaggaaagaacaattgaaactgcaaaagggattaatggaactgtaaattatgatagtgtcaattctgacaactctaagccaaagatatttaaaagtcaaatagagaacataaatttgaccaatggcagcaatgggaggaacacagagtccccagctgccattcacccttgtggaaatcctacagtgattgaggacgctttggacaagattaaaagcaatgaccctgacaccacagaagtcaatttgaacaacattgagaacatcacaacacagacccttacccgctttgctgaagccctcaaggacaacactgtggtgaagacgttcagtctggccaacacgcatgccgacgacagtgcagccatggccattgcagagatgctcaaagtcaatgagcacatcaccaacgtaaacgtcgagtccaacttcataacgggaaaggggatcctggccatcatgagagctctccagcacaacacggtgctcacggagctgcgtttccataaccagaggcacatcatgggcagccaggtggaaatggagattgtcaagctgctgaaggagaacacgacgctgctgaggctgggataccattttgaactcccaggaccaagaatgagcatgacgagcattttgacaagaaatatggataaacagaggcaaaaacgtttgcaggagcaaaaacagcaggagggatacgatggaggacccaatcttaggaccaaagtctggcaaagaggaacacctagctcttcaccttatgtatctcccaggcactcaccctggtcatccccaaaactccccaaaaaagtccagactgtgaggagccgtcctctgtctcctgtggccacacctcctcctcctccccctcctcctcctcctccccctccttcttcccaaaggctgccaccacctcctcctcctccccctcctccactcccagagaaaaagctcattaccagaaacattgcagaagtcatcaaacaacaggagagtgcccaacgggcattacaaaatggacaaaaaaagaaaaaagggaaaaaggtcaagaaacagccaaacagtattctaaaggaaataaaaaattctctgaggtcagtgcaagagaagaaaatggaagacagttcccgaccttctaccccacagagatcagctcatgagaatctcatggaagcaattcggggaagcagcataaaacagctaaagcgggtggaagttccagaagccctgcgataaaaacatgatctttagaagaggatgcagaactgttcagtggtattacatgaaatgcattgtgagatgtttctaaaataccttcttcaattcaaaatgatccctgactttaaaaataatctcacccattaattccaaagagaatcttaagaaacaatcagcatgtttcttctgtaaatatgaaaataaatttcttttttatgtcgtgagatttgtattggcaagaagcagttaatttaaagatgctcttcctatctgtggatgtgttggtaactccgagttgtaatgagttcatgaaatgtgctgttatttttgtaatctcaataaatgtggattgaagttttttccctttttttaaagccaaactaatatttttctgtgacttgatacatctgtcagatttttgtaatctcgataaatgtgtattgaagttttttccctttttttaaaaagccaaactaatatttttctgtgagttaatacatctgtcaggtgtgtatgtaacattactggacattaaaaaaaaatattacattctcacccaaaaa

SEQ ID NO: 4567 - DNA, 2635 bp, Homo sapiens
gcatttcccctcggctgccggcggctccgacatcatgctccggctcctccggccgctgctgctactgctgctgctgcctcccccggggtcccctgagccccccggcctgacccagctgtccccgggggcgcccccgcaggcccccgacttgctctacgctgacgggctgcgcgcctacgcggccggggcttgggcgccggccgtggcgctgctgcgggaggcgctgcggagccaggcggcgctgggccgggtgcggctggattgcggggcgagctgcgcggccgatccgggcgccgcgctccccgccgtgcttctcggggccccggagcccgactccgggccgggacccacgcaggggtcctgggagcgacagcttctccgtgcagcgctccgccgcgcagactgcctgacccagtgcgcagcacggaggctgggccccgggggcgcggcgcgccgcgtggggagcgcgctccgggacgccttccgccgtcgggagccctacaactacctgcagagggcctattaccagttgaagaagctggatctggcagctgcggcagcacacaccttctttgtagcaaaccccatgcacctgcagatgcgggaggacatggctaagtacagacgaatgtcgggagttcggccccagagcttccgggacctggagacgcccccacactgggcagcctatgacactggcctggagctactggggcgccaggaggcaggactggcactgcccaggctagaggaggctcttcaggggagcctggcccagatggagagctgccgtgctgactgtgaggggcctgaggagcagcagggggctgaagaagaggaggatggggctgcgagccaggggggcctctatgaggccattgcaggacactggattcaggtcctgcagtgccggcaacgctgtgtgggggaaacagccacacgccctggtcgcagcttccctgtcccagacttccttcccaaccagctgaggcggctacatgaggcccatgctcaggtgggcaatctgtcccaggctatagaaaatgtcctgagtgtcctgctcttctacccggaggatgaggctgccaagagggctctgaaccagtaccaggcccagctgggagagccgagacctggcctcggacccagagaggacatccagcgcttcatcctccgatccctgggggagaagaggcagctctactatgccatggagcacctggggaccagcttcaaggatcctgacccctggacccctgcagctctcatccctgaggcacttagagaaaagctcagagaggatcaagagaagaggccttgggaccatgagcccgtgaagccaaagcccttgacctactggaaggatgtccttctcctggagggtgtgaccttgacccaggattccaggcagctgaatgggtcggagcgggcggtgttggatgggctgctcaccccagccgagtgtggggtgctgctgcagctggctaaggatgcagctggggctggagccaggtctggctatcgtggtcgccgctcccctcacaccccccatgaacgcttcgaggggctcacggtgcttaaggctgcgcagctggcccgggctgggacagtgggcagtcagggtgctaagctgcttctggaggtgagcgagcgggtgcggaccttgacccaggcctacttctccccggaacggcccctgcatctgtccttcacccacctggtgtgccgcagcgccatagaaggagagcaagagcagcgcatggacctgagtcacccagtgcacgcagacaactgcgtcctggaccctgacacgggagagtgctggcgggagcccccagcctacacctatcgggactacagcggactcctctacctcaacgatgacttccagggtggggacctgttcttcacggagcccaacgccctcactgtcacggctcgggtgcgtcctcgctgtgggcgccttgtggccttcagctccggtgtcgagaatccccatggggtgtgggccgtgactcggggacggcgctgtgccctggcactgtggcacacgtgggcacctgagcacagggagcaggagtggatagaagccaaagaactgctgcaggagtcacaggaggaggaggaagaggaagaggaagaaatgcccagcaaagacccttccccagagccccctagccgcaggcaccagagggtccaagacaagactggaagggcacctcgggttcgggaggagctgtgagtggctgagccagctccttgaggatgtggccacttgacttgtggaaggccatcttgatgccaggacacacaggaagcccctgtgtgacatcaggagcagaacagcaagctctctgtccctgcacccccaccatcttggggacctacaagggcctggactcagaggacagtgcacaggctagcctggagctcaccaggcctggggagctgggacggggccccgctgccggacctgcagccctggacagatggggaacactgtgcctccctgaacagaaatggcaggggaggaggctgatgctttaaatgaagaggatggtggggttgggaggtataaccctgctcctctctcccagtctgtgcaataaaggtcgtgaagatctctcagccaggg

SEQ ID NO: 4568 - DNA, 3518 bp, Homo sapiens
cacaggtgctaccaagcgacagccaacatgtcttttgcagctcaggatcagggtggcagcctgacagttgccagggtagggcttcgcctttctatggagttgctcccaccggcctgactgggaaaaatctcccagggatcaggtcactggcctggtgccccagggccagggctgctgtgtctcctccccaccctaggctccatgcatgggtcctgctgcctcgggggagggcagcccctctctgtgtttgcatcattgcacatgggccccgagggcctggcactcaaggcaggcaggggatggtgtccgaccttccagagctttcctgagcctactcctagctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccacctttgacgacccctatgccctggtggtgctggctgaggaggagctggtggtgattgacctgcagacagcaggctggccaccggtccagctgccctacctggcttctctgcactgttccgccatcacctgctctcaccacgtctccaacatcccgctgaagctgtgggagcggatcattgccgccggcagccggcagaacgcacacttctccaccatggagtggccaattgatggtggcaccagcctgaccccagccccaccccagagggacctgctgctcacagggcacgaggacggcacggtgcggttctgggatgcctcgggtgtctgcctgcggctgctctacaaactcagcactgtgcgcgtgttcctcaccgacacggaccccaacgagaacttcagtgcccagggcgaggacgagtggcccccactccgcaaggtgggctcctttgacccctacagtgatgacccccggctgggcatccagaagatcttcctctgcaagtacagcggctacctggctgtggcaggcacggcagggcaggtgctggtactggaactgaatgacgaggcagcggagcaggctgtggagcaggtggaggccgacctgctgcaggaccaagagggctaccgctggaaggggcacgagcgcctggcagcccgctcagggcccgtgcgctttgagcctggctttcagcccttcgtgttggtgcagtgtcagcccccggctgtggtcacctccttggccctgcactctgagtggcggctcgtggccttcggcaccagccatggctttggcctctttgaccaccagcagcggcggcaggtctttgttaagtgcacactgcaccccagtgaccagctggccttggagggcccactctcccgcgtcaagtccctcaagaagtccttgcgtcagtcattccgccggatgcgtcggagccgggtgtccagccggaagcggcacccggctggccccccaggagaggcacaggaggggagtgccaaggctgagcggccaggcctccagaacatggagctggcgcctgtgcagcgcaagatcgaggctcgctcggcagaggactccttcacaggcttcgtccggaccctgtactttgctgacacctacctgaaggacagctcccggcactgcccctcgctgtgggctggcaccaatgggggcaccatctatgccttctccctgcgtgtgcctcccgccgagcggagaatggatgagcctgtgcgggcagagcaggccaaggagatccagctgatgcaccgggcgccggtggtgggcatcctggtgctcgacggacacagcgtaccccttcccgagcccctcgaagtggcccatgatctgtcgaagagccctgacatgcagggaagccaccagctgctcgtcgtatcagaggagcagttcaaggtgttcacgctgcccaaggtgagtgccaagctgaagttgaagctgacggccctggagggctcaagagtgcggcgggtcagcgtggcccacttcggcagtcgtcgagccgaggactacggggagcaccacctggcagtccttaccaacctgggcgacatccaggtggtctcgctgcccctgctcaagccccaggtgcgctacagctgcatccgccgggaggacgtcagtggcatcgcctcctgcgtcttcaccaaatatggccaaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcagggactcagagtgatggcgaggagaagcagcccggcctggtgatggagcgcgctctgctcagtgatgagagagcggcaactggcgttcacatcgagccgccgtggggtgcagcctcagcaatggcggagcagagtgagtggctgagcgtccaggctgcgcgatgagcacacactactactgatggcctttcgggggtccctgccccaaccggagaggccggtgcacagggccccgccaggggctgggggcatcccggcttccacaatgcagctgctctgggcctcgggagaggagagaccccagtcccctgggctgcccttcccgggcctcgtctgtctgggtcctttggtcaatgttgcacagtttttattgctcccatccctttttgtagtgggctgggttttaagttataaatgttaactgcctctgggtgaaaaagtttttaataaacacctattacctcttg

SEQ ID NO: 4569 - DNA, 2830 bp, Homo sapiens
gggaagtccaggagcatgggtggtttttttccccctaccgaggtccgtgaggtgtgtgctaaccaaggggcggctcacaaccgtgacagactgccattcctgagtctcttctggccatgggcccccggagccgtgagcgtcgggcaggcgcggtacagaacaccaacgacagcagcgccctcagcaagcgttccctggccgcgcgcgggtacgtgcaggacccctttgccgcgttgctggttccgggcgcggcgcgccgcgcaccgctcattcaccgaggctactacgtccgcgcacgcgccgtgaggcactgcgtgcgcgcttttttggagcagattggcgcgccccaggccgcgcttcgcgcgcagatcttgtctctcggcgctggcttcgactcgctctattttcgcttaaaaaccgcgggccgcctggcccgggctgcagtctgggaggtggattttccggacgtggcgcggcgcaaagcagaaaggattggagagacgccagagctgtgcgcgttaaccgggcctttcgagaggggggagcccgcgtccgcgctgtgctttgagagcgcagactactgcatcctgggtctggacttgcggcagctccagcgagtggaggaggccctgggcgccgcggggctcgacgcagcctcacccactctgctcctggccgaggcggtgctgacctacctcgagccggagagtgccgcggccctcatcgcctgggcagcccagcgttttcctaatgcccttttcgtggtctatgagcagatgaggcctcaagacgcctttggccagttcatgctgcaacattttcggcagctaaactcccccctgcatggcctggagcgttttcctgacgtggaggcgcagcggcgccgcttccttcaagctggctggaccgcctgcggtgccgtggacatgaatgaattctatcactgctttcttcccgcagaagaacgccggcgggtggaaaatattgaaccctttgacgaatttgaggagtggcatctgaagtgcgcccattatttcattctggcagcttctaggggagacaccctctcccacaccctagtgtttccatcctcagaggcatttcctcgcgtaaatcctgcttcgccttcaggggtattccctgccagcgtagtcagtagcgagggccaggtcccaaacctgaagagatatggccacgcctctgtcttcttgagcccagacgttattctcagtgcaggaggatttggagagcaggaggggcggcactgccgagtgagccagtttcacttgctctcaagagattgtgactctgaatggaaaggcagccaaataggcagttgtgggactggagttcagtgggatggacgcctttatcacaccatgacaagactctcagagagtcgggttctggttctgggagggagactgtccccagtaagtccagccttgggggttctccagcttcatttttttaagagtgaggataataacactgaggacctgaaagtgacaataacaaaggctggccgaaaggatgattccactttgtgttgttggcggcattcaacaacagaagtgtcctgtcagaatcaggaatatttgtttgtgtatgggggtcgaagcgtggtggaacctgtactaagtgactggcatttcctccatgtagggacaatggcttgggtcaggatcccagtggagggagaagtacctgaagcccggcattctcacagtgcctgcacttggcaagggggagcccttattgctggaggtctcggggcttctgaggagccattgaactctgtgctctttctgagaccaatctcttgtggattcctctgggagtcagtagacatccagcctcccattaccccaaggtactcccacacagctcatgtgctcaatggaaagctgttactggttggagggatctggattcattcctcctcatttcctggagtgactgtgatcaatttgactacaggattgagctctgagtatcagattgacacaacatatgtgccatggccattaatgttacacaaccatactagtatccttcttcctgaagagcaacagctcctgctccttggaggtggtgggaactgcttttcctttggtacctacttcaacccccatacagtcacattagacctttcttccttaagtgctgggcagtaaggactggactaatattcaggacccactaaagtagacaataaagttttccacaaataggatgaccctctagctatagatactgccactcctcctttccccatcctttttttcccttagcactattcagtgcaaaaagtgaaaaaggttggtaaaataggtaaaatacctagaaacaatcactacagaaaacagctgaagacagtggccatgcagtccgagaggagtagtggtctgcctctaattttctaatctaagttcgtttattgagttacagtggtctttagtaaagtaaaacaatttcccaatcccaggccttgtgatttgagatggtaccttagaaaaagttacacgcagttccgtggttgaatatatttgagatggtaccttagaaaaagtttcacgcagatccttggttgaatatagttgagggagcgtagtattgacaattcttcatgtaggaaacctgaaatgaacacagtcacagtttgattaaaacattgtcctgtttgttgcaacagaaaactcggatagttttaacaacaggaaacacttgtaggacttcctttaccaacatactttttaaatgttttgctattggttccatatttatttagatttataagtgtcaataaagcaaacttttgatgcctcaa

SEQ ID NO: 4570 - DNA, 1538 bp, Homo sapiens
ccccctaccgaggtccgtgaggtgtgtgctaaccaaggggcggctcacaaccgtgacagactgccattcctgagtctcttctggccatgggcccccggagccgtgagcgtcgggcaggcgcggtacagaacaccaacgacagcagcgccctcagcaagcgttccctggccgcgcgcggaagaacgccggcgggtggaaaatattgaaccctttgacgaatttgaggagtggcatctgaagtgcgcccattatttcattctggcagcttctaggggagacaccctctcccacaccctagtgtttccatcctcagaggcatttcctcgcgtaaatcctgcttcgccttcaggggtattccctgccagcgtagtcagtagcgagggccaggtcccaaacctgaagagatatggccacgcctctgtcttcttgagcccagacgttattctcagtgcaggaggatttggagagcaggaggggcggcactgccgagtgagccagtttcacttgctctcaagagattgtgactctgaatggaaaggcagccaaataggcagttgtgggactggagttcagtgggatggacgcctttatcacaccatgacaagactctcagagagtcgggttctggttctgggagggagactgtccccagtaagtccagccttgggggttctccagcttcatttttttaagagtgaggataataacactgaggacctgaaagtgacaataacaaaggctggccgaaaggatgattccactttgtgttgttggcggcattcaacaacagaagtgtcctgtcagaatcaggaatatttgtttgtgtatgggggtcgaagcgtggtggaacctgtactaagtgactggcatttcctccatgtagggacaatggcttgggtcaggatcccagtggagggagaagtacctgaagcccggcattctcacagtgcctgcacttggcaagggggagcccttattgctggaggtctcggggcttctgaggagccattgaactctgtgctctttctgagaccaatctcttgtggattcctctgggagtcagtagacatccagcctcccattaccccaaggtactcccacacagctcatgtgctcaatggaaagctgttactggttggagggatctggattcattcctcctcatttcctggagtgactgtgatcaatttgactacaggattgagctctgagtatcagattgacacaacatatgtgccatggccattaatgttacacaaccatactagtatccttcttcctgaagagcaacagctcctgctccttggaggtggtgggaactgcttttcctttggtacctacttcaacccccatacagtcacattagacctttcttccttaagtgctgggcagtaaggactggactaatattcaggacccactaaagtagacaataaagttttccacaaataggatgaccctctagctatagatactgccactcctcctttccccatcctttttttcccttagcactattcagtgcaaaaagtgaaaaa

SEQ ID NO: 4571 - DNA, 621 bp, Homo sapiens
tggcggcgcggtcgcccgggagaccgggaaagccgtttcacacccgtcctagtcgaagtcgagatttcctttggcttcaaagctctctcaccatattttgggaagttatggatcatcacattcccatgcatgcgttgcctgaagaaatccaaaagatgttgcctgaagaaaaagtttgtaagtactgtggagtcagctatctaattcttcatgaatttaaggctatggaagaaaaagtgaaagcaatggaaaaagagatgaaattttatcaaggaagtgtagatcgtgaaaagagacttcaagaaaagctgcattctcttagccaagaacttgaacagtacaaaattgacaacaaatccaaaacagaaagaatttacgatgtaggcatgcagttaaaaagtcaacaaaatgaatttcagaaagtaaagaaacaactgagtcatttgcaagatgagctaaaaattaaatatagacaatcatacatcttcagattgtgcttttgctgatgtctgtaagaactctgtctaagccggtcagaaggattttctcctgtattttcttctaagtgttttatagttttagctcttctttagatctatgatctatttcagctaacttctg

SEQ ID NO: 4572 - DNA, 2211 bp, Homo sapiens
cgcggcgcgcggcggcggtgccccaagtgggtgcctcctcccggccccgcacggcccccctcccggcgcgggggaaggccggggcggggggcccgggggccggcgcggctccggcaccgtcggggcggctggggggcggccggggcggggcgatgcctggcggtggcagtggcggcggccccggccggggcccgtgaccatgggcatcgccgagtccacgccggatgagctgccgtcggacgcagaggagcagctgcgcagcggcgaccagcagctggagctgagcgggcggcggttgcggcggctgcccagcgcagtgtgcgcgctgagccgcctgcagaagctgtatgtgagcggcacggggctgcgcgagctgccggaggagatcgaggagctgcgcgagctgcgcatcctggcgctggacttcaacaagctcgagcgactgcctgacggcctgtgccgcctgccgcgcctcacgcgcctctatctgggcggcaaccggctgctggcgctgcccgccgacttcgcgcagttgcagagcctgcgctgcctctggatcgagggcaacttcttgcggcgcttcccgcggccgctgctgcgcctggtggcgctgcagtcgctccagatgggcgacaaccggctgcgcgcgctgccggccgagctgccgcgcatgacgggcttgcgcggcctctggctctacggcaaccgcttcgaggagttcccgcccgcgctgctgcgcatgggccgcctgcacatcctcgacctcgaccgcaaccgcctgggcggcttccccgacctgcacccgctgcgcgcgctgcgcgtcttctcctacgaccacaaccccgtcaccgggcccccgcgcgtcgcggacaccgtgttcctcgtgggcgagggcgccgtcgagcgcatggcggagcgcgacgagcccacgccccggcctccgccccggcgcccagcgcgggcctttgaggatgaggaggaggaagacctgctcataggcggcgctggttcccgggctctgggcgcccccgggggcagcttccgcgccctggaagccgctccaggactgggcacctgagcctatgttctggctgatgggcttcagccactctgagaggaggggctctaggaagctttggctggttaggcctgcgggactggtgggtccctacttaggtcaatggaacggctacttttggcgagttgccgggcacaggcagggctggggctcatcttcagacactcctaggtagtaagaggactgactataccctggctgatctgtgggcaattgtcagaccaagaagtctgggctgggtccagtccccgatggagccactgataacagaggcaccagcttcctcctggaaccagggtctctgagggccacagaattgtcacgtctccctgagtctggatgcagggcacccaacaccctccctctttctggggtttgggtctcctaggcccaccctttctaggacaggagccgctacctctgggatggactgcgtgcctgtgtggggcaggactgcccttgcgaggagggcctggcccaggagcaggggcttggagtggggctggtgcccgggacagaagtgggaaatagatgggggccccaacaccgaagctgccctcacccctccatcagggctgatcgtacatacctccctcctcggccccctgagattggtatggggcacagaaggcagggggtcacccccaccctattctgttctcttctcccagcctcccagcatgtgcctggaaccttgctgggaagagagagctccccctccactccccaccccatagcctgagccttccagctgtcaagtttgaaaagaagccaccgtgcctccagggcctcctgcaccgcagagaggggctctctgctctgggaggctgctcagcgcctctcccacggcctgcactctcctttcccttaaatgggcacagccagggtggctggcatgggactggcactctgtacctccactccgtcaccagggacagccccgagggggtgaggagaggggccttgctctgcaattcccagagccagatcttcctcatccaagcaataacgggacgagggagccagggccaaggacactcagggacactgttggggcagcggccccacatggtaatgttttctttagagagaagaaaaaacaactggctgtaaacgtaaattatatttcttgg

SEQ ID NO: 4573 - DNA, 5323 bp, Homo sapiens
cggggctggaggcggtggctgcggttgcgggaccggcactatgctgggccttcctaccacttgtgtgtggcttggtagtggcctagggtctctcctccctgctgaagtccctctcctgcaggtggccgtctgcccggcccagcaccatgcacacgcttgtgttcttgagcacacggcaggtgctgcagtgccagccagctgcctgccaggccctgcccttgctgccacgcgaactcttccccctgctgttcaaggtggccttcatggacaagaagacagtggtactgcgcgagttggtacacacgtggcccttcccgctgctcagtttccagcagctgctacaggagtgtgcccactgcagccgtgccctcctgcaggagcggcctagcactgagagcatgcaggctgttatcctggggctgactgcccggctccacacctcagagcctggggccagcacacagcccctctgcaggaagcatgcgctgcgggtgctggacatgacgggcctcttggatgatggtgtggaacaggatcctggcaccatgagcatgtgggactgtactgctgccgtagctcgcacatgcattgcccagcagcagggtggggccgcagagcctgggccagcccccatccccgtggaggtgcgcgtggacctgcgggtgaaccgggcctcctatgcgttcctgcgggaggcactccgaagcagcgtgggcagcccgctgcggctctgctgccgggacctgcgagctgaggacctgcccatgcgcaacactgtggccctgctgcagcttctggatgcaggctgcctgcgccgcgtggacctgcgcttcaacaatctgggcctgcgcggcctgtctgtgatcatcccacacgtggcccgcttccagcacctggccagcctgcggctccactatgtgcatggggattcaaggcagccctccgtggatggcgaggacaacttccgctacttccttgcccagatgggccgcttcacctgtctgcgtgagctcagcatgggctcctctctcctttcagggaggctggaccagctgctcagcaccctgcagagccccctggagagcctggagttggccttctgtgctctgctgcctgaggacctacgcttcctggcacggagcccacatgctgcccacctcaagaagttggacctgagtggtaacgacctgtctggcagccagctggcacccttccagggtctgttgcaggcatcagcagccacactgttgcatctggagctgactgagtgtcagctcgcagacacccagctgttggccacactacccatcctgactcagtgcgccagtctccggtaccttggcctctatggcaacccactgtccatggcgggcctcaaggagctgctgcgggactcagtggcacaggctgagctgcgtactgtggtgcaccccttccctgtggactgctatgagggcttgccctggccgccgcctgcctctgtcctgctggaggcctccatcaatgaggagaagtttgcccgcgtagaagctgagttgcaccagctgcttctagcctcaggccgtgcccatgtgctctggaccacggacatctacgggcgactggctgcggactacttcagcctatgatgaagtagctctgggtgagacacaggccgccctgcagtctctttaggtaggcagggcctttgctgggacccctggtggaggccttcacaaaagcactggttactggtttcctgctgggtctaccttgcttctgggcacacctcaagcctcccctgctttctgcagtgccccacgcggttttccctgcacttgctccataattggctgatcatctgtgggccccggggctggatgtcaggcctccattgccctgctcagtttggctgcatttggctgccgtctggggtcctggtcctttgtgcaaatgctttgggattccagttgtgagctgagagagatgatggcctctctgggcctttcctctccctttactgagagctcagtgcttctggggttgaagttggacagaggcctgcttcagggaagctgggagtccccaggcactcacgcctcttacgtgttccctaccctgccacccagccaccccactgggctgggctcgggctggagggggtcatcaaggtacacatgtgcctggaagttgaatttgtggctgtttttttttctgtccacgttggtcacccttatccttatctctgctgtcacccccaacatggccacccggcaacaactgccatccagcctgtcgccccgcccttcgcggggcagccccgtcggcactgccggccagtccttgctcttcccacctttcggaggcccaagatcctactgtggccggccagggccagcgagggaccccccccatgcagagctggaggttggggtgatgtcttttcggaagagcttcaagggaggtgttggggcctccccggccaccttccattgctaccccaggattcccgagtgcaacgttcccggctcgcgccccacacacggctcagcgcacactgcgcggcttccacctttactgacggagcatgcgcgaggccgcaccggccaatctccggcgcccacgtcatccgcgcgcccgcggccctagcagtggatctcgtaggcgaccggcgggggcacgcggagtcccggccccgccccctgttccgggccgcagtcagcgggcgcctccgccggaccctcggcgaagagcggcttggagcggttgatgacgaacatctcgtggccgcgctcgtcgcggagctcctctagctgtgcgaacgtacaggggccgtccaagtagtcgttgacgaacagcgctccctcccccggaggcccccgcgccttttttcgcctgcggcgccggcgacagatcatggcgaccaggagcagcgccgtgagcgccagcagcgcgatggccgccgcaatggccgtctgtgtggccacgcccagggcgcggaaggccatgctgcccgcctcgggccggggctcgctgccggcggggcgggcggccggaggcggcggttgcgcgggctgctgcggctgctgccgggacgcgttgaccaggagccggaagggcacgcgggcagcgccgccggcgttggaggcctcgcactcgtacttaccggcgtgcgccagcgtgatgttgctgaggaagagcatgccgctgcccgtgtcggatgccgagtgtccgcccaggcccagcaacccgccttctagctgggcctgggctcgcggccggccctcgcgaggctggggcacctttctccaggtcaccaatggctgcgggtagccggaggcttggcaggcaacccgcaggtcctcacccaggttggctgtgagctccagcggctgcacgtggacagagggcggaatgcagatgaggctgctgtgggatacgtccaggagactctggagcgccaggcgcgggggctctgcacacatgatcttcctgtccctggaggtgagcagccgctggccgccctccttgatccaggcacccagccagtgcagggcgcagtcacagcgccatgggttctctgtgggagagcagcgttaggcaggtggcttgagggtgctgctaaaacagcctgtgcagttggggttttgcaggccaggacagaggcctctttcccacctcccacagcgttttcacacggagtccaaggccctgccaccccttccttgaccccaagctccttggggcggcaggcccttcaccctcgcccccctcccctttagctctgtgatgcctgcctgttacagatcacttctccgtcggtctctgagaaagcacctgctccttaagtcttcctgcaacaagtgccactgtttttaggaacctgggcgtccacatagacatctcaccagcactgaaacctcacaagtcctctcagccttgcctttggatgccctctcttgggaatgtccccagtcctggtcagctgtctctctcctttgcaattttgtctgcctcccctcagcctaaaagtgtgcagaaccctcaattctgttaagtcaccctgtggagttcctgtcttctgttttccccaggcagggtgcctgagctgtattccccagcacacccactcccgcagccctccagtgtggctgcaggcggtggtgcagccttccagactgctgcccagttgcctgatgtcagagcccctccacacatgagcctgctccctactgccaacaccgtggcccagacagagacgctttccgaggaagaggtacctgtgaggcgcaggacttgcagactggccaggggctgcagggcctctcggctgatggtgcccagctggttcctgctgaggtccagcagtgctagggaggacagccccgctagagcctggtcctccagcagctcaatgctgttttcttgcaggtgaagctcctgcagtcgctgaagtaaggacagcagatcgtgaggaaaaagggcgccgaggttgggggcatgtctctcttcttaccaagctagactgggttgccttttctaactattccagccctacagggcgaggggccataatggagtatcccgcccctttagaccccaggcgctcaccggcaggtgcaagaaggtgaaatccagcagccgcgccagctggttgcccgccaggtagagcacgcgcagctgggccaggcctacgaaggcgccgctgcgcaagccgcgcagccggttgctagtgagcgccagctccagcaggcgcggctgcgcgcggaaggcgccggcctccagggcgcgcaggctgttgttgtgcaggtagagccggcgcagagcggcgagtggcgccagggctcccggctctaggcgggcgatgttgttgtcctgcaggaacagtgtctgcaggccggggaaagaggaggcgcttaccccgttgcgggggtcttcctctccctgggggcaccccgtcctcccgcagctccacacggtgcccacctgcgtccctggcgggattcccagcgggacgacgcgcaaccgcagggcgccacactccaccgtggcgctgtagcagcggcaggctgctgggcagccggcggcgcggagcggcagtagtagcagcagcagcggcagcagtgcgggggccctcagggccatctcccgaggcccggttcctcaccggcccttccgcggttcagccgcagacgcgtgccctcctgaaacacaggttggcaggccagtctcggcagtcgagagccagccaatagatggaatggaggcctgcacctgcgtctaacttttgacgctataaataggttcaagaaactaataaaacgttctggttttctcctttgac

SEQ ID NO: 4574 - DNA, 1573 bp, Homo sapiens
gtcgtggggagcggtcctgtctcgggccatggacacaatgaggtcactccgcttcatttctgcagaagctctggtgtcccacccccaggtggcccggcagagcctggacagcgtggcccacaacctctacccactcctgttcaaagccagctacctgctggagcaggcggaggtgacgcgcgcggtgctggggcgctggcccctggaggagttccggctgggagcgctgctgggtcctggtgccgaccacccccaggacctgcgcgacagaacctgcagggcctgcctggaggcgctggtgcgcggcctcgcggaccacgtgctgcaggaccggagccgccggcggctgcgggtggctgacctcacgggcatccgagatgtgcaggtgcagcggtgcccgtgcgggagggcgctgggcaggtggggccgcacccagctgctggccaggacctgctgtgagctgcaggcagagcccctcgcagccgggcgccccgtcgaggtcctcgccgacctcttcgtcactgagggcaacttcgaggcggtggtgcaggctctgaggccagcgggcccggcccctctgcgggtgcactgcccctcgttccgggcggacagcctgagccccagccagctcctgcacgtgctgcgtctggctggcccgggtgccctgcgcaagctggaggtggtgcacaacgtgcggctgcatgcgggccacgtgcagcagcttctggcccaggtgggcttcccccggctggcctcgctcaccctgcccaccaaggcctttgatgcaccccccacctacgcctccactcccgacggcgaggaccccctcctcgcctccatcgcccgggagctcagcaagatggcgcagctcactgagctcagtgtggccttctccacgctgaccgggaagatcccgacgctgcttggccccctacagaccccgctgcgagtactggacctggccaactgtgccctgaaccacacggacatggccttcttggcagactgtgcccacgctgcccacctggaggtgctggacctcagtggacacaacctggtcagcctgtacccctcgaccttcttcaggctgctcagccaggcttcccggacgctgaggatcctgacactggaggagtgtggcatcgtagacagccacgttggcatgctgatcctgggcctgagcccctgccaccggctgcgccagctcaagttcctcgggaacccgctgtcggcccgcgccctccggcgcctcttcaccgcactctgtgagctccccgagctgcgctgcattgagttcccggtgcccaaggactgctaccccgagggtgccgcctacccacaggacgagctggccatgtccaagttcaaccagcagaaatacgacgagatcgccgaggagctgcgtgccgtgctgctgcgggctgaccgagaggacatccaagtctccacacctctctttggaagttttgacccagacattcaagaaacaagcaatgagcttggtgctttcttgctgcaagctttcaaaactgctctagaaaacttctccagagcactcaaacaaatagagtag

SEQ ID NO: 4575 - DNA, 4450 bp, Homo sapiens
ggaggagcgctcaagcagccgcccctgaccggagcgggctcggccgctgctgcagcgctcagcgcccgggccctgctgaagccgggtctagcatgtgccgcggctccccggcggcggcggcggctcctctgcagcagcctcagcagcagcggccgccatggccaagcccagcgtggagctcacccgcgagttgcaagacagcatccggaggtgcctgagccaaggggccgtgctccaacaacatcatgtgaagttggagacaaagcccaagaagtttgaggaccgagtgctggccctgacctcctggcgcctccacctcttcctccttaaagtcccggccaaggtggagagctccttcaatgtcctggagatccgtgccttcaacacgctcagtcagaatcagatcctggtggagacggagcgtggcatggtgagcatgcgactgccatcagctgaaagtgtggaccaggtgacacgacatgtgagctctgccctgtccaaggtctgccctggccctgggtgtttgatccggcgtggaaacgcagacaccccagaggggccccgagatacatcccccaactctgagacttccacatctaccacccacagtgtctgcggtggcttctctgagacctacgctgctctgtgtgactacaatgggctacactgccgtgaggaggttcaatgggatgtggacaccatctaccatgctgaagataaccgggagttcaatcttttggatttcagccacttggagagccgagacttggccctaatggtagcagccctggcctacaaccagtggttcaccaaactctactgcaaggacttgcggctgggctctgaagtgctagaacaggtgctacataccctaagcaagtcggggagcctcgaagagctggtgctggacaacgccgggcttaagacggactttgtccagaagctggccggggtgtttggggagaacgggagctgtgtgctgcatgccctcactctgtcccacaaccccatcgaggacaagggttttctcagtctgagccagcagctcctctgcttcccctctggcctcaccaaactgtgcctggccaagactgccatttcccctcgagggctccaggcactcggccagaccttcggggcaaacccagcatttgccagctcccttcgatacctggacctgagcaagaatcctgggctcctcgccacggatgaggccaatgccctctacagtttcctggcccaacccaacgccctggtgcacctggacctgtcaggaactgactgcgtcatcgacttgcttctcggtgccctgctccacggctgctgctcccacctcacctacctcaacctggctcgcaacagctgctcccacaggaagggtcgagaggccccgccggccttcaagcagttcttcagcagcgcctacacactgagccacgtcaatctgtcggccacaaagctgcccctggaggccctcagggcgctgcttcagggcctctccctcaacagtcacctcagtgacctgcacctggatctcagcagctgcgagctccgttcagcgggagcccaagccttgcaggagcagctgggagctgtcacctgtgtaggcagcctggatctgtcagacaatgggttcgactcggacctcctgacactggtgcctgcacttggcaagaacaagtccctcaagcacctgtttttgggcaagaacttcaatgtcaaggccaagaccctggaggagatcctccacaagctggtgcagctgatccaggaagaggactgttccctgcagtcactgtcggtggcagactcccggctgaagcttcgcaccagcatcctcatcaatgccctgggcagcaacacctgcctggccaaggtggatctgagcggcaatggcatggaggacatcggggccaagatgctgtctaaggccctgcagataaactcctccctcagaactatcctatgggatcggaacaatacatctgccctgggcttcctggacatcgcaagggccctggagagcaaccacacgctgcgcttcatgtccttccccgtgagcgacatctcccaagcctatcgcagcgcgcctgagcgcaccgaggacgtctggcagaagatccaatggtgcttagtgaggaacaaccactcccagacgtgcccccaggagcaggccttcaggttgcagcagggcctggtgaccagcagcgccgagcaaatgctgcagcggctgtgtggacgagtgcaggaggaggtgcgggccctgagactatgccccctggagcctgtgcaggatgagctactctacgctcgggacctcatcaaagatgccaagaactcccgggcgctgtttcccagcctctatgagctgggccacgtgctggccaatgatgggcctgtgcggcagaggctggaatcagtagcaagtgaggtgtccaaagctgtggacaaggagctgcaggtgatcctggagtccatggtcagcctgacacaggagttatgccctgtggccatgcgggtggccgagggacacaacaagatgctgagcaatgtggcggagcgtgtcactgtgccccggaacttcatccgaggggcactgctggagcaagcaggacaggacattcagaacaagctggatgaagtgaagctctcagtcgtcacctacctaaccagctccatagtggatgagatcctgcaagagctctaccattcccacaagagcctggcccggcacctgacccagctaaggacgctgtcagatccaccagggtgcccaggccaagggcaggatctgtcctcccggggccgaggccggaaccatgaccatgaggagaccacagatgatgaacttgggaccaacattgacaccatggccatcaaaaagcagaaacgctgccgcaagattcggccggtgtctgccttcatcagcgggagccctcaggacatggaaagccaactggggaatctggggatcccccctggctggttctcaggacttgggggcagccagcccacagctagtggctcctgggaaggtctatctgagctgcccactcatggttacaaactaaggcatcaaacacaagggaggccccgcccccccaggaccacacctccaggacctggtcgacccagtatgccagcacctgggactcgtcaggagaatgggatggccacccgcctggatgaagggctggaggacttcttcagccgaagggtcctggaggaaagttctagctacccccggactctgaggaccgtgcggccaggactctcggaggcaccgctgcctccactccagaagaagaggcgccggggcctgtttcactttcgccggccccggagcttcaagggggacagggggccggggtcccctaccactggactcctcctccctccacccccaccccctcccccgactcaggagagcccccctagcccagaccccccaagcctcggcaataactcctctccctgctggagcccagaggaggagagcagcctcctccctggatttggtgggggccggggaccttccttccgccggaagatgggcccaggcccagaccaggagggcagcacccaggcctggcagaaacggcgctcttcagacgacgcagggcctggatcctggaagcccccaccaccgccccaaagcaccaaaccaagcttcagcgccatgcgcagagcagaggccacatggcacatagctgaagagagtgcccccaaccacagctgccagagtcccagcccagcctcccaagatggggaagaggagaaggaggggaccctcttcccagagaggacacttccagctaggaatgccaagctacaggaccccgctctagctccatggcctcccaagccagtggctgtgcccaggggccgccagcctccccaggagccaggggtcagggaggaggctgaggctggagatgcagctccaggagtcaacaaaccccggctgaggctgagctcacagcaagaccaagaggagcccgaagtccaagggccccctgatccaggccggcggactgcccccctgaagcccaagaggacacggcgggcacagtcctgtgacaagctggaacctgatagaagacggcctcctgaccccacaggaaccagtgagccaggaacagactgacaactgccacaacaccctcctcagccctcgacatgtgcctcgcaaggactcagacccctatccacccccagtccccagggccccctgccagcccctgtcctacaggggcaagacggcaggaccaggcatgggggagctggaggcagggactagaacagagggagccacctggagagacggaggctgtcagtgcctgcctcgatacctctctctgcagagagcttctgggtgggggcttatctcctcccccaggagggtggatctctgtccctctatccccagggactctctcccctcttgtat

SEQ ID NO: 4576 - DNA, 4597 bp, Homo sapiens
ggagcgctcaagcagccgcccctgaccggagcgggctcggccgctgctgcagcgctcagcgcccgggccctgctgaagccgggtctagcatgtgccgcggctccccggcggcggcggcggctcctctgcagcagcctcagcagcagcggccgccatggccaagcccagcgtggagctcacccgcgagttgcaagacagcatccggaggtgcctgagccaaggggccgtgctccaacaacatcatgtgaagttggagacaaagcccaagaagtttgaggaccgagtgctggccctgacctcctggcgcctccacctcttcctccttaaagtcccggccaaggtggagagctccttcaatgtcctggagatccgtgccttcaacacgctcagtcagaatcagatcctggtggagacggagcgtggcatggtgagcatgcgactgccatcagctgaaagtgtggaccaggtgacacgacatgtgagctctgccctgtccaaggtctgccctggccctgggtgtttgatccggcgtggaaacgcagacaccccagaggggccccgagatacatcccccaactctgagacttccacatctaccacccacagtgtctgcggtggcttctctgagacctacgctgctctgtgtgactacaatgggctacactgccgtgaggaggttcaatgggatgtggacaccatctaccatgctgaagataaccgggagttcaatcttttggatttcagccacttggagagccgagacttggccctaatggtagcagccctggcctacaaccagtggttcaccaaactctactgcaaggacttgcggctgggctctgaagtgctagaacaggtgctacataccctaagcaagtcggggagcctcgaagagctggtgctggacaacgccgggcttaagacggactttgtccagaagctggccggggtgtttggggagaacgggagctgtgtgctgcatgccctcactctgtcccacaaccccatcgaggacaagggttttctcagtctgagccagcagctcctctgcttcccctctggcctcaccaaactgtgcctggccaagactgccatttcccctcgagggctccaggcactcggccagaccttcggggcaaacccagcatttgccagctcccttcgatacctggacctgagcaagaatcctgggctcctcgccacggatgaggccaatgccctctacagtttcctggcccaacccaacgccctggtgcacctggacctgtcaggaactgactgcgtcatcgacttgcttctcggtgccctgctccacggctgctgctcccacctcacctacctcaacctggctcgcaacagctgctcccacaggaagggtcgagaggccccgccggccttcaagcagttcttcagcagcgcctacacactgagccacgtcaatctgtcggccacaaagctgcccctggaggccctcagggcgctgcttcagggcctctccctcaacagtcacctcagtgacctgcacctggatctcagcagctgcgagctccgttcagcgggagcccaagccttgcaggagcagctgggagctgtcacctgtgtaggcagcctggatctgtcagacaatgggttcgactcggacctcctgacactggtgcctgcacttggcaagaacaagtccctcaagcacctgtttttgggcaagaacttcaatgtcaaggccaagaccctggaggagatcctccacaagctggtgcagctgatccaggaagaggactgttccctgcagtcactgtcggtggcagactcccggctgaagcttcgcaccagcatcctcatcaatgccctgggcagcaacacctgcctggccaaggtggatctgagcggcaatggcatggaggacatcggggccaagatgctgtctaaggccctgcagataaactcctccctcagaactatcctatgggatcggaacaatacatctgccctgggcttcctggacatcgcaagggccctggagagcaaccacacgctgcgcttcatgtccttccccgtgagcgacatctcccaagcctatcgcagcgcgcctgagcgcaccgaggacgtctggcagaagatccaatggtgcttagtgaggaacaaccactcccagacgtgcccccaggagcaggccttcaggttgcagcagggcctggtgaccagcagcgccgagcaaatgctgcagcggctgtgtggacgagtgcaggaggaggtgcgggccctgagactatgccccctggagcctgtgcaggatgagctactctacgctcgggacctcatcaaagatgccaagaactcccgggcgctgtttcccagcctctatgagctgggccacgtgctggccaatgatgggcctgtgcggcagaggctggaatcagtagcaagtgaggtgtccaaagctgtggacaaggagctgcaggtgatcctggagtccatggtcagcctgacacaggagttatgccctgtggccatgcgggtggccgagggacacaacaagatgctgagcaatgtggcggagcgtgtcactgtgccccggaacttcatccgaggggcactgctggagcaagcaggacaggacattcagaacaagctggatgaagtgaagctctcagtcgtcacctacctaaccagctccatagtggatgagatcctgcaagagctctaccattcccacaagagcctggcccggcacctgacccagctaaggacgctgtcagatccaccagggtgcccaggccaagggcaggatctgtcctcccggggccgaggccggaaccatgaccatgaggagaccacagatgatgaacttgggaccaacattgacaccatggccatcaaaaagcagaaacgctgccgcaagattcggccggtgtctgccttcatcagcgggagccctcaggacatggaaagccaactggggaatctggggatcccccctggctggttctcaggacttgggggcagccagcccacagctagtggctcctgggaaggtctatctgagctgcccactcatggttacaaactaaggcatcaaacacaagggaggccccgcccccccaggaccacacctccaggacctggtcgacccagtatgccagcacctgggactcgtcaggagaatgggatggccacccgcctggatgaagggctggaggacttcttcagccgaagggtcctggaggaaagttctagctacccccggactctgaggaccgtgcggccaggactctcggaggcaccgctgcctccactccagaagaagaggcgccggggcctgtttcactttcgccggccccggagcttcaagggggacagggggccggggtcccctaccactggactcctcctccctccacccccaccccctcccccgactcaggagagcccccctagcccagaccccccaagcctcggcaataactcctctccctgctggagcccagaggaggagagcagcctcctccctggatttggtgggggccggggaccttccttccgccggaagatgggcactgaggggtcagagccaggggaggggggcccagcccctgggacagcacagcagccaagggttcacggtgttgcccttcccgggttggaaagagccaagggttggagcttcgatgggaaacgagagggcccaggcccagaccaggagggcagcacccaggcctggcagaaacggcgctcttcagacgacgcagggcctggatcctggaagcccccaccaccgccccaaagcaccaaaccaagcttcagcgccatgcgcagagcagaggccacatggcacatagctgaagagagtgcccccaaccacagctgccagagtcccagcccagcctcccaagatggggaagaggagaaggaggggaccctcttcccagagaggacacttccagctaggaatgccaagctacaggaccccgctctagctccatggcctcccaagccagtggctgtgcccaggggccgccagcctccccaggagccaggggtcagggaggaggctgaggctggagatgcagctccaggagtcaacaaaccccggctgaggctgagctcacagcaagaccaagaggagcccgaagtccaagggccccctgatccaggccggcggactgcccccctgaagcccaagaggacacggcgggcacagtcctgtgacaagctggaacctgatagaagacggcctcctgaccccacaggaaccagtgagccaggaacagactgacaactgccacaacaccctcctcagccctcgacatgtgcctcgcaaggactcagacccctatccacccccagtccccagggccccctgccagcccctgtcctacaggggcaagacggcaggaccaggcatgggggagctggaggcagggactagaacagagggagccacctggagagacggaggctgtcagtgcctgcctcgatacctctctctgcagagagcttctgggtgggggcttatctcctcccccaggagggtggatctctgtccctctatccccagggactctctcccctcttgtatagaataaaaaaacaaaatcat

SEQ ID NO: 4577 - DNA, 3414 bp, Homo sapiens
ggaggctcagtccgaggatgcctagatgttagcgagggagcacgcgctgagcttcccgaaccccatgccacaaaaacaaggcgccagcaggtcccgctcacgtcccagcgggcttctttccctggggtggggaagtgggtcaacttcgttctgatctgaaggggggtttgggactatttgggtcgctcctcacctccccacccgctccccggcttggcatggtccagagcccgggctggagccagcggtagggccagcttgcacacatggctccggaggctccggttgcccatccgagcccctgccaggctctaacgttcccaactgacaacaccagtaactaaatataggagcagatggtggggacgggctgtcgcagcggctcctttgcagaggtctccggactgcagataaggctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgagagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaaggggcagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatctccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgctcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttcatc

SEQ ID NO: 4578 - DNA, 2906 bp, Homo sapiens
tcggaactcgcctggggcgccgccggcggcggagggagcgtgactgcgctgcgcagggcgctaggaggcattgtcgccgctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaaggggcagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatctccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgctcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttc

SEQ ID NO: 4579 - DNA, 2924 bp, Homo sapiens
tcggaactcgcctggggcgccgccggcggcggagggagcgtgactgcgctgcgcagggcgctaggaggcattgtcgccgctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaaggggcagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatctccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgctcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttc

SEQ ID NO: 4580 - DNA, 3095 bp, Homo sapiens
gcgtgactgcgctgcgcagggcgctaggaggcattgtcgccgtaagtggagccaaaagcggcccggagcgggaccacacgcttcttgccccgcaaagctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgagagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaaggggcagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatctccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgctcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttcatc

SEQ ID NO: 4581 - DNA, 2990 bp, Homo sapiens
gcttgcacacatggctccggaggctccggttgcccatccgagcccctgccaggctctaacgttcccaactgacaacaccagtaactaaatataggagcagatggtggggacgggctgtcgcagcggctcctttgcagaggtctccggactgcagataaggctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaaggggcagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatctccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgctcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttcatc

SEQ ID NO: 4582 - DNA, 3008 bp, Homo sapiens
gcttgcacacatggctccggaggctccggttgcccatccgagcccctgccaggctctaacgttcccaactgacaacaccagtaactaaatataggagcagatggtggggacgggctgtcgcagcggctcctttgcagaggtctccggactgcagataaggctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaaggggcagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatctccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgctcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttcatc

SEQ ID NO: 4583 - DNA, 663 bp, Homo sapiens
ggaactcgcctggggcgccgccggcggcggagggagcgtgactgcgctgcgcagggcgctaggaggcattgtcgccgctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgagagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtc

SEQ ID NO: 4584 - DNA, 1629 bp, Homo sapiens
agccccgccccctctcttctcgcttctcagccctgcccacttctttttgtcctcagccaattagcggcccaacgccccttccgcgcctcatccgggttcccgggacgggaaagtggcgtggtaaccaggcaactactgatcaatcccctccccggctgatttgcgcatcaggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaatggctgcccacccccctcacggaggacatgatgaaggaagggctttctctgctctgtaagacaggcaatgggctggctcatgcttatgtcaagctggaggttaaagagagggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggcccaaaacatgctgaagaaggtggaaggcttggaggatctgagcaatctcaccaccttgcatcttcgagacaaccagattgacaccctgagtggcttctccagagaaatgaaatcattgcagtacctcaacctgaggggcaacatggtggccaacctgggggagctggccaagcttcgagacctgcccaagctgcgagcgttggtgctgcttgataacccatgcacggacgaaaccagctaccgccaggaggccctggtgcagatgccataccttgaacgcctggacaaggaattctatgaggaggaggaacgggctgaggctgatgtgattcgacagaggctgaaggaagaaaaggagcaggagcctgagccccagcgtgacctggaacccgaacagtcattgatctagcagcagttctagcctctaaagatagagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgatgctcctgtgtctgac

SEQ ID NO: 4585 - DNA, 1208 bp, Homo sapiens
gaaagtggcgtggtaaccaggcaactactgatcaatcccctccccggctgatttgcgcatcaggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaatggctgcccacccccctcacggaggacatgatgaaggaagggctttctctgctctgtaagacaggcaatgggctggctcatgcttatgtcaagctggaggttaaagagagggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggcccaaaacatgctgaagaaggtggaaggcttggaggatctgagcaatctcaccaccttgcatcttcgagacaaccagattgacaccctgagtggcttctccagagaaatgaaatcattgcagtacctcaacctgaggagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgat

SEQ ID NO: 4586 - DNA, 572 bp, Homo sapiens
aaacagtccttccctctcgggaccaagggcctctccagaactgcttctgattgagcagaaacagggtctgagcccctttgctaaggcgaattgagtgggagggttggagactgcgctttaggctggtgtaccagagggcccaaggaaattggcccagtggggagggaaaagtagaagaaatgaatggagcagggattacggatggcgcaatgggagctgagaggagaggaggaggaattggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaatggctgcccacccccctcacggaggacatgatgaaggaagggctttctctgctctgtaagacaggcaatgggctggctcatgcttatgtcaagctggaggttaaagagagggacctgacagacatctacttgctgcgctcctacatccatctgcgct

SEQ ID NO: 4587 - DNA, 1628 bp, Homo sapiens
agtcgccgctctactctcaacggtggcgagctgcagttgccaagtgccccgtccccgttgccataacagcagtacacaacccctccttcccctcgcccgcttgctaaacagtccttccctctcgggaccaagggcctctccagaactgcttctgattgagcagaaacagggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaatggctgcccacccccctcacggaggacatgatgaaggaagggctttctctgctctgtaagacaggcaatgggctggctcatgcttatgtcaagctggaggttaaagagagggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggcccaaaacatgctgaagaaggtggaaggcttggaggatctgagcaatctcaccaccttgcatcttcgagacaaccagattgacaccctgagtggcttctccagagaaatgaaatcattgcagtacctcaacctgaggggcaacatggtggccaacctgggggagctggccaagcttcgagacctgcccaagctgcgagcgttggtgctgcttgataacccatgcacggacgaaaccagctaccgccaggaggccctggtgcagatgccataccttgaacgcctggacaaggaattctatgaggaggaggaacgggctgaggctgatgtgattcgacagaggctgaaggaagaaaaggagcaggagcctgagccccagcgtgacctggaacccgaacagtcattgatctagcagcagttctagcctctaaagatagagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgatgctcctgtgtctgac

SEQ ID NO: 4588 - DNA, 1629 bp, Homo sapiens; identical to SEQ ID NO: 4584

SEQ ID NO: 4589 - DNA, 1628 bp, Homo sapiens; identical to SEQ ID NO: 4587

SEQ ID NO: 4590 - DNA, 1809 bp, Homo sapiens
cggcgtctccatggcgaccgcgttggctgggtggcctccattgtcgggctgctgctctcagcggcggggctcgccagcgcttcagtgggcggggacgcggcaggtgactccagaccaaggaggatgagctgctgtccctggaagagaacggatggagggaagcagctcctacgaagttccctctgtggctgctgctgatctggaggagggtgctggtcagactaggagcttgcctgccaccccctccaaagatgttcacaagggtgttggaggcatcatcttttcctcctcaccgattttagacttgagtgaaagtggtctgtgccgtttggaggaggtctttagaatccccagccttcaacaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcaggacaagggtccctaggaaacaggctctgcagagactacatgagagaaaaactcgaatcatgggcgtggtagggcgtgcgcctacacatatgggagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagtattccaggccctgacacggtcatcagggaggttcattcttgtgttgctgtgactgccgccagtgccaccaccttgcgaggtgtgttggccgatggactcggtgtcctcagtgtcttctctgtcctccagctccactgaccacctggcttcacccctccctgggccccaggagtccggctggcatggaccacagccacagcacccccgtgcccctcacttggtggttggctttggccagcgggggcccccagcaggaggtcgaggaggaagggagagcgagggcctcgtctttactttcccggcttctttgtgagctgcctggagctggccgagtccagcctctccctccttctgggttccgacaatctctccttccctggtctgtcctgtgggcggctgcagcccggccctgactggcacagggctcttgcaccgcccctgtggctcacctgctccctccccaacatgaataaaccctcctgaagcc

SEQ ID NO: 4591 - DNA, 909 bp, Homo sapiens
attgtcgggctgctgctctcagcggcggggctcgccagcgcttcagtgggcggggacgcggcaggtgactccagaccaaggaggatgagctgctgtccctggaagagaacggatggagggaagcagctcctacgaagttccctctgtggctgctgctgatctggaggagggtgctggtcagactaggagcttgcctgccaccccctccaaagatgttcacaagggtgttggaggcatcatcttttcctcctcaccgattttagacttgagtgaaagtggtctgtgccgtttggaggaggtctttagaatccccagccttcaacaattgcatctgcaaaggaatgccctgtgtgtgattcctcaagatttctttcagttgcttccgaacctgacttggctggacctccggtacaatagaattaaagcgcttccttctgggattggagctcaccaggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgaggg

SEQ ID NO: 4592 - DNA, 7671 bp, Homo sapiens
atggatataaatacatataataatcaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagcccagaggatgaggaagaggaaggaagagctcagcaaactcctgcctccgcggaggagcatggtggcatcaaagattccctctgccacagatctgatagataacaggaaagtaccactgaatccgcctggaaaaatgaaaccaagcaaagagaaatcgccacaagcaagtaaagaaatgagtgccctgcaggagagaaatttagaagagaagataaaacagcacgtcctccaaatgcgtgagcaaagaagattccatggccaggccccactggaggagatgaggaaggctgccgaggatctggaaattgccacagagctacaggatgaagtattgaagctaaaattgggattaaccttgaacaaagatcgtcgacgggcggccctcactggaaacctttcgcttggcctgccggcagcacagcctcaaaatacattttttaacacaaaatatggagaatcaggaaatgttcgcagataccagtgacaccaggtggctggactgatggagacgtcttcagacaggagccgctcagtcttctttcccgggcgtcgcctcctgtgtggtgccggaagagcgccaggttcagtgttaccctgagggctgatttcgcgcagcctgttgttttccttagacaggtccacgtccctctcctgaggctgtggaagatttcagccgtattaaaagaaaggacactgtgagcacgtggtctcgccttcccttcttcctgcaggttcccgccaagccatgtgacagagtgctcacactcaggcacttgcctctctcctgtcctggagcccttgttacaaaagtactcacagctttccttcacttagttatttgagtgtgggagaggagaccaggtcacccgattcccgccaagccggaagtccctgcagcaccacctttggctaggagggaggggtgacagccaaaaagggcttcgggggagtggttaccctgctccctgcccagtgacaagccctcctttcccctgggggccctcctttcccctgctccctgcccagctacggggccctcctttcagccttgaccccttcctggttgctaccactcaggctgccactcagtggactccaccccagggacacggcagggtctgcagacctccccatgctagatcagccgtatttcatgctctgtctgcccaggctgtgtagattctgtgtgacttagtctcttgtgctgagtgtttgcttggatcttgaaaacatctttggtttgatttctttaacagaggtgagactattcagactttgtttatttttgtgttaattttggtaaatatggtttcagtgagtttcctcatttcatccaagttgtgcaatgtatcagcataaagttcctcttattttcagtatctttaggatccgtaataatgtcccctcttttattcttgacctggtgttcttcatcattcttgctatggatttatcaattttgttcctcttttccaaaagccccaggttttggcttcactggatttgctgtttgtcttctgtctcatgggtctctgcgccctgcacttcgtactttccgagagtttaactggtgcttagagagaaatgcatcacttccaaacccatgtattagagaagaagggcgtgaaatttatcacctaagctttccattcaggaagctagaaaaggtgtcagtgacctgttgcggcccagcggctggagcagcagacgtttgccatttctcacgcctgagggcaggcgttggagcagctcagccggcgttgctggtcagggtctcccgtgaggctggagtcagccgtgggttgagctgctctcctctgaaggtttaactgggcttggggctcagcttccaaggtgctcacctggttgttgatcagagagcgtgtccgttgtgatcccagtcctttgaaactgtgaagcctcgccccgcggcctgccgcaggatatgttttggtaaatgtagactgtgcacttgagaagaatgtattttgagttgttgggtacattgttttgtgtgtgtcaggtgacattgactaatcctgttgctcagagctcctgtacccttactgactgacttaagcctggtttctcagttactgagagaggcctgtgaacagttctagctatgatcatgaacatgtgttttcttcttagttatgtgagtttttgctatacgtgttttggggctattttgtcagatgcctacaaatttaggattgttttatcttcctgtcgaactgaccttgtcattattatgaactatttctcttcgcctctccttttcacttcttgccttctgtggattttgtctgatactaatccaggcacactgctgctgttttggtcagcgttttcataatgcatcttcttccctccttctactgtactggatttaaagcgcaccttatagagacatcatatactcgggactccttttctttctctagctgccagttctgtgtttcagttacagtgtttggccctcacatttaaggtgcgtgtgcgtacggcggattccgtgcccatctcatgtttttattccctttattcttcttttgctgctttctgatagtgatcaatttttttatttatatctcttgtattagagttttagtaatatcttttaatattattctcttgggtgttgccttagagatttcatacatgcccttgagttcattagcatttcctgaatgagccaatgaccctgagaaggtccctcccatctgccagttccctgccattgatgctgttgctctcgtccgcctcccttccacaggtaagcacgcaagacacaggtaccgtgtgccccaacggtgtcttgactcgctgttcctagacatcagtgtttgcttcactttacccatcccgatgctcttccttcctgcagcttcatgctccaatgagggctgattttcatttagctaaataacttttttttaagtatttctttgtatcatggttatgctttgactggccgtaagttctctcagcttttgtttgtctgaaaataaatttagttcgcctttattctgcacaggacagaattctaggtggatgatttttgccattcccagaactttaaagatgggctccactgtcttctggctcccatgtgttttgttaaaaattcagtgttcaggccgggtgctgtggctcacgcctgtaatcccagcactttgggaggccgaggcgagtggatcacgaggtcaggagatcgagaccatcctggctaacacggtgaaaccccgtctctactaaaaaatacaaaaaattagccgggcgtggtggctgtagtcgcagctactcaggaggctgaggcgggagaatggcgtgaacccaggagacggagcttgcagtgagccgagatcgcgccactgcactccagcctgggcgacagagcgagactccgtctcaaaaaaaaaaaaaaaagattcaatgttcattgttatttgttgctcctttgaaggtaatgggtcttttttctttgtcttaaaattgtttctccttatctttggttttcagcagtctgtgctgtgcctggatgtaattttctttttacgtatttttcttggaatatacagaactcaaatctgggagttagcatctttcatcagttttggaaaattcttagccattttttttttttttactattttttcccctgttctccctcttctccctgagacttcagttttgtgtgtgtgtgcacatgtgtgtatgcattcgtgcgtacgagtgtgtgcatgtgtgcgcccgtgtgtatgtgcatatgtgagtgtgtgtggctgtaacctgcacgtctcttctgtcatgtgttctatttttcattcctctctgtacatcaggctagatgcctcctgtctacgtggttttagatttacgaatcctgtcttctgttgtgtcccacagaaaaacccatgaggttttttaacattaaaaacagcagctttatgatagagaaaaaaacacaaacatagacgattgtaccattgcactcagaagaaacatcccaggccctgagcagcgtgtctttcctcggccgagtcaggcttcctggtgagcctcagggagtgcatggtctcagatgccatccttctcttctccagcatttccactcacctccgtgttcttggggagtgcgtggtgtcagatcccatcctgctcctctccagagtttccggtcacctccgtgttctcagggagtgcgtggtcttggatgccatcctgctcatctccagcatttcctctcacctccgtgttctcggggagtgcgtggtgtcagatcccatcctgctcatctccagcatttcctctcacctctgtgttctcggggagtgcgtggtgtcagatcccatcctgctcctctccagcatttcctctcacctccgtgttctcggggagtgcgtggtgtcagatcccatcctgctcctctccagagtttcctctcacctccgtgttctcggggagtgcgtggtctcagatcccatcctgctcctctccagagtttcctctcacctccgtgttctcagggagtgcgtggtcttggatgccatcctgctcatctccagcatttcctctcacctccgtgttctcggggagtgcgtggtgtcagatcccatcctgctcctctccagcatttcctctcacctccgagctctcggggagtgcgtggtctcagatcccatcctgctcctctccagagtttcctctcacctccgtgttctcgttctcatctctgccggaattccacatctgctcgtgcatgccatccaccttttccactagatccttttacatcatcattataatgatttttttttaataagtgttttctttcagttttaaatttcagatgttgtgtttttcaggtctaaggtgtctggtaattttttgtggatgccgattctctgttgaaattctccatcttttcatttcctttatatctcttttcttcttttttctataatatattacatttttctaataagtttttagtgagtgtccagcattgtataagttgacccttgaacaagagtttgaattataagggtccacttataagtggatttttaaaaaaatatatattgcaaaaatttttggaaatttgcaacaatttgaaaaactttgcagatgagccacatagcctagaaatatctgaaaaaagaaaaagttatgtcatgaatgcataaaatatacagaccatacatggaccattcacagtagagagaaatgtcgccgtaaagatgcagcattggccgagtgcagtggctcacgcctgtaatcccagcactttgggaggccgaggtgggcagatcacctaaggtcaggagttcaagaccagcctggccaacatggagaaaccccgtgactactaaaaataaaaaattagccaggcatggtggcacatgcctgtaactccagctacttgggaggctgaggcaggagaatcacttgaacccggaaggcagaggttgcagtgagccgagatcacgccattgcactccagcctgggcaacaagagcaaaactctgtctcaaaaaaaaaaaaatgcagcattaaattataactgcatgaaattaactgcagtccacagtgtgctgctggaataattacaaagccacctcctgttgctattgcagtgagcgcaagcatgtcaaggatccgcttaaaacatcgtgtggtgctaatctctgcacgagcggttcatgtcttcagtacattgtgtatcacggtaaaaagtgatctgttttaactggacatggtggcacacgcctgcagtcccagctactcaggaggctgaggcaggaggatcccttgagcccaggaggtcgaggctgcagtgagctgtgattgcaccactgcactcaagcctgggcaacagagtgagaccccaacttgaaaaaaaggggacatcgggatgttcttgtgtatttttcatgttgagcgcaatactgtaaaccttgaagaacactttgggacccatagagtgccaccagtcatgccaaagagctcctgagaagcagagaaaagtcatgacatttcaagaaaaagttgaatttcttgatatgttccgtagattgaggtttacagctgcggttgcctaccaattcaagataaatgaatccagcgtaaggaccatagtaaaaaaataaggaaatttgtgagcaggcacaaaagccttaacactttctgtgaaatacctttttatcttgtattgggaatgcagcttttatgtgggtataggattgctgtgtgtgatggttcatattaaatgtcaacttgattagattgaagaatgtaaagtattgtttctgggtgttgccagaagagattaacatttgagtcagtggactgggagaagacccaccacagtgtgggcaggcaccatccagtcggctgccagcatggctggaaaaagcaggcagaagaaggtggctgaagctgactggctgagtcttctggccttcatctctctcccatgctggatgcttcctgcccttgaacatcagactccaagttctttagcttttggactcttggacctacactggtgttttgccaggggctctcgggccttcggccacagactgaaggctgcactgtcggcttccctcctttagaggtttggggactcagactgagctactactggcttccttgcccctcagtttgcagacagcctattgtgggacttcaccctgtgatcctgtgcctcagttctccttaataaactccatttcatatg

SEQ ID NO: 4593 - DNA, 1765 bp, Homo sapiens
aacttacccatccaaacccaaagaatggactcagagaacagtggaagaaagactttttaatgacggtcttgcaagattgggtgtctgatgggcaggcacacccagcagggttacaacaagccatttatcccctggaaatacagatatggatataaatacatataataatcaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagcccagaggatgaggaagaggaaggaagagctcagcaaactcctgcctccgcggaggagcatggtggcatcaaagattccctctgccacagatctgatagataacaggaaagtaccactgaatccgcctggaaaaatgaaaccaagcaaagagaaatcgccacaagcaagtaaagaaatgagtgccctgcaggagagaaatttagaagagaagataaaacagcacgtcctccaaatgcgtgagcaaagaagattccatggccaggccccactggaggagatgaggaaggctgccgaggatctggaaattgccacagagctacaggatgaagtattgaagctaaaattgggattaaccttgaacaaagatcgtcgacgggcggccctcactggaaacctttcgcttggcctgccggcagcacagcctcaaaatacattttttaacacaaaatatggagaatcaggaaatgttcgcagataccagtgacaccaggtggctggactgatggagacgtcttcagacaggagccgctcagtcttctttcccgggcgtcgcctcctgtgtggtgccggaagagcgccaggttcagtgttaccctgagggctgatttcgcgcagcctgttgttttccttagacaggtccacgtccctctcctgaggctgtggaagatttcagccgtattaaaagaaaggacactgt

SEQ ID NO: 4594 - DNA, 2113 bp, Homo sapiens
agctcgctgagccctcgaggcgggcggcggcaggaaggtggtgcctcggcccgtcgtgccctgtcgcctagctccagccgcgatgctgaccgcaaaggctgcccttctgaggcctggaatgtgaggcccagagcgtcggacccaactcagcctcgcccggatggggaaatcgaggcagggagcgggggtgggcgtgcgtggggatcccttgaaggcagcctcggaaaccccacggagcctgcgctgcctgggccctgtgtgactccagaccaaggaggatgagctgctgtccctggaagagaacggatggagggaagcagctcctacgaagttccctctgtggctgctgctgatctggaggagggtgctggtcagactaggagcttgcctgccaccccctccaaagatgttcacaagggtgttggaggcatcatcttttcctcctcaccgattttagacttgagtgaaagtggtctgtgccgtttggaggaggtctttagaatccccagccttcaacaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagcccagaggatgaggaagaggaaggaagagctcagcaaactcctgcctccgcggaggagcatggtggcatcaaagattccctctgccacagatctgatagataacaggaaagtaccactgaatccgcctggaaaaatgaaaccaagcaaagagaaatcgccacaagcaagtaaagaaatgagtgccctgcaggagagaaatttagaagagaagataaaacagcacgtcctccaaatgcgtgagcaaagaagattccatggccaggccccactggaggagatgaggaaggctgccgaggatctggaaattgccacagagctacaggatgaagtattgaagctaaaattgggattaaccttgaacaaagatcgtcgacgggcggccctcactggaaacctttcgcttggcctgccggcagcacagcctcaaaatacattttttaacacaaaatatggagaatcaggaaatgttcgcagataccagtgacaccaggtggctggactgatggagacgtcttcagacaggagccgctcagtcttctttcccgggcgtcgcctcctgtgtggtgccggaagagcgccaggttcagtgttaccctgagggctgatttcgcgcagcctgttgttttccttagacaggtccacgtccctctcctgaggctgtggaagatttcagccgtattaaaagaaaggacactgtg

SEQ ID NO: 4595 - DNA, 6374 bp, Homo sapiens
ggctgctgctctcagcggcggggctcgccagcgcttcagtgggcggggacgcggcaggtgactccagaccaaggaggatgagctgctgtccctggaagagaacggatggagggaagcagctcctacgaagttccctctgtggctgctgctgatctggaggagggtgctggtcagactaggagcttgcctgccaccccctccaaagatgttcacaagggtgttggaggcatcatcttttcctcctcaccgattttagacttgagtgaaagtggtctgtgccgtttggaggaggtctttagaatccccagccttcaacaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagcccagaggatgaggaagaggaaggaagagctcagcaaactcctgcctccgcggaggagcatggtggcatcaaagattccctctgccacagatctgatagataacaggaaagtaccactgaatccgcctggaaaaatgaaaccaagcaaagagaaatcgccacaagcaagtaaagaaatgagtgccctgcaggagagaaatttagaagagaagataaaacagcacgtcctccaaatgcgtgagcaaagaagattccatggccaggccccactggaggagatgaggaaggctgccgaggatctggaaattgccacagagctacaggatgaagtattgaagctaaaattgggattaaccttgaacaaagatcgtcgacgggcggccctcactggaaacctttcgcttggcctgccggcagcacagcctcaaaatacattttttaacacaaaatatggagaatcaggaaatgttcgcagataccagtgacaccaggtggctggactgatggagacgtcttcagacaggagccgctcagtcttctttcccgggcgtcgcctcctgtgtggtgccggaagagcgccaggttcagtgttaccctgagggctgatttcgcgcagcctgttgttttccttagacaggtccacgtccctctcctgaggctgtggaagatttcagccgtattaaaagaaaggacactgtgagcacgtggtctcgccttcccttcttcctgcaggttcccgccaagccatgtgacagagtgctcacactcaggcacttgcctctctcctgtcctggagcccttgttacaaaagtactcacagctttccttcacttagttatttgagtgtgggagaggagaccaggtcacccgattcccgccaagccggaagtccctgcagcaccacctttggctaggagggaggggtgacagccaaaaagggcttcgggggagtggttaccctgctccctgcccagtgacaagccctcctttcccctgggggccctcctttcccctgctccctgcccagctacggggccctcctttcagccttgaccccttcctggttgctaccactcaggctgccactcagtggactccaccccagggacacggcagggtctgcagacctccccatgctagatcagccgtatttcatgctctgtctgcccaggctgtgtagattctgtgtgacttagtctcttgtgctgagtgtttgcttggatcttgaaaacatctttggtttgatttctttaacagaggtgagactattcagactttgtttatttttgtgttaattttggtaaatatggtttcagtgagtttcctcatttcatccaagttgtgcaatgtatcagcataaagttcctcttattttcagtatctttaggatccgtaataatgtcccctcttttattcttgacctggtgttcttcatcattcttgctatggatttatcaattttgttcctcttttccaaaagccccaggttttggcttcactggatttgctgtttgtcttctgtctcatgggtctctgcgccctgcacttcgtactttccgagagtttaactggtgcttagagagaaatgcatcacttccaaacccatgtattagagaagaagggcgtgaaatttatcacctaagctttccattcaggaagctagaaaaggtgtcagtgacctgttgcggcccagcggctggagcagcagacgtttgccatttctcacgcctgagggcaggcgttggagcagctcagccggcgttgctggtcagggtctcccgtgaggctggagtcagccgtgggttgagctgctctcctctgaaggtttaactgggcttggggctcagcttccaaggtgctcacctggttgttgatcagagagcgtgtccgttgtgatcccagtcctttgaaactgtgaagcctcgccccgcggcctgccgcaggatatgttttggtaaatgtagactgtgcacttgagaagaatgtattttgagttgttgggtacattgttttgtgtgtgtcaggtgacattgactaatcctgttgctcagagctcctgtacccttactgactgacttaagcctggtttctcagttactgagagaggcctgtgaacagttctagctatgatcatgaacatgtgttttcttcttagttatgtgagtttttgctatacgtgttttggggctattttgtcagatgcctacaaatttaggattgttttatcttcctgtcgaactgaccttgtcattattatgaactatttctcttcgcctctccttttcacttcttgccttctgtggattttgtctgatactaatccaggcacactgctgctgttttggtcagcgttttcataatgcatcttcttccctccttctactgtactggatttaaagcgcaccttatagagacatcatatactcgggactccttttctttctctagctgccagttctgtgtttcagttacagtgtttggccctcacatttaaggtgcgtgtgcgtacggcggattccgtgcccatctcatgtttttattccctttattcttcttttgctgctttctgatagtgatcaatttttttatttatatctcttgtattagagttttagtaatatcttttaatattattctcttgggtgttgccttagagatttcatacatgcccttgagttcattagcatttcctgaatgagccaatgaccctgagaaggtccctcccatctgccagttccctgccattgatgctgttgctctcgtccgcctcccttccacaggtaagcacgcaagacacaggtaccgtgtgccccaacggtgtcttgactcgctgttcctagacatcagtgtttgcttcactttacccatcccgatgctcttccttcctgcagcttcatgctccaatgagggctgattttcatttagctaaataacttttttttaagtatttctttgtatcatggttatgctttgactggccgtaagttctctcagcttttgtttgtctgaaaataaatttagttcgcctttattctgcacaggacagaattctaggtggatgatttttgccattcccagaactttaaagatgggctccactgtcttctggctcccatgtgttttgttaaaaattcagtgttcaggccgggtgctgtggctcacgcctgtaatcccagcactttgggaggccgaggcgagtggatcacgaggtcaggagatcgagaccatcctggctaacacggtgaaaccccgtctctactaaaaaatacaaaaaattagccgggcgtggtggctgtagtcgcagctactcaggaggctgaggcgggagaatggcgtgaacccaggagacggagcttgcagtgagccgagatcgcgccactgcactccagcctgggcgacagagcgagactccgtctcaaaaaaaaaaaaaaaagattcaatgttcattgttatttgttgctcctttgaaggtaatgggtcttttttctttgtcttaaaattgtttctccttatctttggttttcagcagtctgtgctgtgcctggatgtaattttctttttacgtatttttcttggaatatacagaactcaaatctgggagttagcatctttcatcagttttggaaaattcttagccattttttttttttttactattttttcccctgttctccctcttctccctgagacttcagttttgtgtgtgtgtgcacatgtgtgtatgcattcgtgcgtacgagtgtgtgcatgtgtgcgcccgtgtgtatgtgcatatgtgagtgtgtgtggctgtaacctgcacgtctcttctgtcatgtgttctatttttcattcctctctgtacatcaggctagatgcctcctgtctacgtggttttagatttacgaatcctgtcttctgttgtgtcccacagaaaaacccatgaggttttttaacattaaaaacagcagctttatgatagagaaaaaaacacaaacatagacgattgtaccattgcactcagaagaaacatcccaggccctgagcagcgtgtctttcctcggccgagtcaggcttcctggtgagcctcagggagtgcatggtctcagatgccatccttctcttctccagcatttccactcacctccgtgttcttggggagtgcgtggtgtcagatcccatcctgctcctctccagagtttccggtcacctccgtgttctcagggagtgcgtggtcttggatgccatcctgctcatctccagcatttcctctcacctccgtgttctcggggagtgcgtggtgtcagatcccatcctgctcatctccagcatttcctctcacctctgtgttctcggggagtgcgtggtgtcagatcccatcctgctcctctccagcatttcctctcacctccgtgttctcggggagtgcgtggtgtcagatcccatcctgctcctctccagagtttcctctcacctccgtgttctcggggagtgcgtggtctcagatcccatcctgctcctctccagagtttcctctcacctccgtgttctcagggagtgcgtggtcttggatgccatcctgctcatctccagcatttcctctcacctccgtgttctcggggagtgcgtggtgtcagatcccatcctgctcctctccagcatttcctctcacctccgagctctcggggagtgcgtggtctcagatcccatcctgctcctctccagagtttcctctcacctccgtgttctcgttctcatctctgccggaattccacatctgctcgtgcatgccatccaccttttccactagatccttttacatcatcattataatgatttttttttaataagtgttttctttcagttttaaatttcagatgttgtgtttttcaggtctaaggtgtctggtaattttttgtggatgccgattctctgttgaaattctccatcttttcatttcctttatatctcttttcttcttttttctataatatattacatttttctaataagtttttagtgagtgtccagcattgtataagttgacccttgaacaagagtttgaattataagggtccacttataagtggatttttaaaaaaatatatattgcaaaaatttttggaaatttgcaacaatttgaaaaactttgcagatgagccacatagcctagaaatatctg

SEQ ID NO: 4596 - DNA, 1782 bp, Homo sapiens
acagacacactcgcgctcagcgtggcgcctgcgggattccgtaccggcgtctccatggcgaccgcgttggctgggtggcctccattgtcgggctgctgctctcagcggcggggctcgccagcgcttcagtgggcggggacgcggcaggtgactccagaccaaggaggatgagctgctgtccctggaagagaacggatggagggaagcagctcctacgaagttccctctgtggctgctgctgatctggaggagggtgctggtcagactaggagcttgcctgccaccccctccaaagatgttcacaagggtgttggaggcatcatcttttcctcctcaccgattttagacttgagtgaaagtggtctgtgccgtttggaggaggtctttagaatccccagccttcaacaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgtcctttcctcctcattttccctagagtattccaggccctgacacggtcatcagggaggttcattcttgtgttgctgtgactgccgccagtgccaccaccttgcgaggtgtgttggccgatggactcggtgtcctcagtgtcttctctgtcctccagctccactgaccacctggcttcacccctccctgggccccaggagtccggctggcatggaccacagccacagcacccccgtgcccctcacttggtggttggctttggccagcgggggcccccagcaggaggtcgaggaggaagggagagcgagggcctcgtctttactttcccggcttctttgtgagctgcctggagctggccgagtccagcctctccctccttctgggttccgacaatctctccttccctggtctgtcctgtgggcggctgcagcccggccctgactggcacagggctcttgcaccgcccctgtggctcacctgctccctccccaacatgaataaaccctcctgaagcc

SEQ ID NO: 4597 - DNA, 8147 bp, Homo sapiens
acagacacactcgcgctcagcgtggcgcctgcgggattccgtaccggcgtctccatggcgaccgcgttggctgggtggcctccattgtcgggctgctgctctcagcggcggggctcgccagcgcttcagtgggcggggacgcggcaggtgactccagaccaaggaggatgagctgctgtccctggaagagaacggatggagggaagcagctcctacgaagttccctctgtggctgctgctgatctggaggagggtgctggtcagactaggagcttgcctgccaccccctccaaagatgttcacaagggtgttggaggcatcatcttttcctcctcaccgattttagacttgagtgaaagtggtctgtgccgtttggaggaggtctttagaatccccagccttcaacaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcaggacaagggtccctaggaaacaggctctgcagagactacatgagagaaaaactcgaatcatgggcgtggtagggcgtgcgcctacacatatgggagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagcccagaggatgaggaagaggaaggaagagctcagcaaactcctgcctccgcggaggagcatggtggcatcaaagattccctctgccacagatctgatagataacaggaaagtaccactgaatccgcctggaaaaatgaaaccaagcaaagagaaatcgccacaagcaagtaaagaaatgagtgccctgcaggagagaaatttagaagagaagataaaacagcacgtcctccaaatgcgtgagcaaagaagattccatggccaggccccactggaggagatgaggaaggctgccgaggatctggaaattgccacagagctacaggatgaagtattgaagctaaaattgggattaaccttgaacaaagatcgtcgacgggcggccctcactggaaacctttcgcttggcctgccggcagcacagcctcaaaatacattttttaacacaaaatatggagaatcaggaaatgttcgcagataccagtgacaccaggtggctggactgatggagacgtcttcagacaggagccgctcagtcttctttcccgggcgtcgcctcctgtgtggtgccggaagagcgccaggttcagtgttaccctgagggctgatttcgcgcagcctgttgttttccttagacaggtccacgtccctctcctgaggctgtggaagatttcagccgtattaaaagaaaggacactgtgagcacgtggtctcgccttcccttcttcctgcaggttcccgccaagccatgtgacagagtgctcacactcaggcacttgcctctctcctgtcctggagcccttgttacaaaagtactcacagctttccttcacttagttatttgagtgtgggagaggagaccaggtcacccgattcccgccaagccggaagtccctgcagcaccacctttggctaggagggaggggtgacagccaaaaagggcttcgggggagtggttaccctgctccctgcccagtgacaagccctcctttcccctgggggccctcctttcccctgctccctgcccagctacggggccctcctttcagccttgaccccttcctggttgctaccactcaggctgccactcagtggactccaccccagggacacggcagggtctgcagacctccccatgctagatcagccgtatttcatgctctgtctgcccaggctgtgtagattctgtgtgacttagtctcttgtgctgagtgtttgcttggatcttgaaaacatctttggtttgatttctttaacagaggtgagactattcagactttgtttatttttgtgttaattttggtaaatatggtttcagtgagtttcctcatttcatccaagttgtgcaatgtatcagcataaagttcctcttattttcagtatctttaggatccgtaataatgtcccctcttttattcttgacctggtgttcttcatcattcttgctatggatttatcaattttgttcctcttttccaaaagccccaggttttggcttcactggatttgctgtttgtcttctgtctcatgggtctctgcgccctgcacttcgtactttccgagagtttaactggtgcttagagagaaatgcatcacttccaaacccatgtattagagaagaagggcgtgaaatttatcacctaagctttccattcaggaagctagaaaaggtgtcagtgacctgttgcggcccagcggctggagcagcagacgtttgccatttctcacgcctgagggcaggcgttggagcagctcagccggcgttgctggtcagggtctcccgtgaggctggagtcagccgtgggttgagctgctctcctctgaaggtttaactgggcttggggctcagcttccaaggtgctcacctggttgttgatcagagagcgtgtccgttgtgatcccagtcctttgaaactgtgaagcctcgccccgcggcctgccgcaggatatgttttggtaaatgtagactgtgcacttgagaagaatgtattttgagttgttgggtacattgttttgtgtgtgtcaggtgacattgactaatcctgttgctcagagctcctgtacccttactgactgacttaagcctggtttctcagttactgagagaggcctgtgaacagttctagctatgatcatgaacatgtgttttcttcttagttatgtgagtttttgctatacgtgttttggggctattttgtcagatgcctacaaatttaggattgttttatcttcctgtcgaactgaccttgtcattattatgaactatttctcttcgcctctccttttcacttcttgccttctgtggattttgtctgatactaatccaggcacactgctgctgttttggtcagcgttttcataatgcatcttcttccctccttctactgtactggatttaaagcgcaccttatagagacatcatatactcgggactccttttctttctctagctgccagttctgtgtttcagttacagtgtttggccctcacatttaaggtgcgtgtgcgtacggcggattccgtgcccatctcatgtttttattccctttattcttcttttgctgctttctgatagtgatcaatttttttatttatatctcttgtattagagttttagtaatatcttttaatattattctcttgggtgttgccttagagatttcatacatgcccttgagttcattagcatttcctgaatgagccaatgaccctgagaaggtccctcccatctgccagttccctgccattgatgctgttgctctcgtccgcctcccttccacaggtaagcacgcaagacacaggtaccgtgtgccccaacggtgtcttgactcgctgttcctagacatcagtgtttgcttcactttacccatcccgatgctcttccttcctgcagcttcatgctccaatgagggctgattttcatttagctaaataacttttttttaagtatttctttgtatcatggttatgctttgactggccgtaagttctctcagcttttgtttgtctgaaaataaatttagttcgcctttattctgcacaggacagaattctaggtggatgatttttgccattcccagaactttaaagatgggctccactgtcttctggctcccatgtgttttgttaaaaattcagtgttcaggccgggtgctgtggctcacgcctgtaatcccagcactttgggaggccgaggcgagtggatcacgaggtcaggagatcgagaccatcctggctaacacggtgaaaccccgtctctactaaaaaatacaaaaaattagccgggcgtggtggctgtagtcgcagctactcaggaggctgaggcgggagaatggcgtgaacccaggagacggagcttgcagtgagccgagatcgcgccactgcactccagcctgggcgacagagcgagactccgtctcaaaaaaaaaaaaaaaagattcaatgttcattgttatttgttgctcctttgaaggtaatgggtcttttttctttgtcttaaaattgtttctccttatctttggttttcagcagtctgtgctgtgcctggatgtaattttctttttacgtatttttcttggaatatacagaactcaaatctgggagttagcatctttcatcagttttggaaaattcttagccattttttttttttttactattttttcccctgttctccctcttctccctgagacttcagttttgtgtgtgtgtgcacatgtgtgtatgcattcgtgcgtacgagtgtgtgcatgtgtgcgcccgtgtgtatgtgcatatgtgagtgtgtgtggctgtaacctgcacgtctcttctgtcatgtgttctatttttcattcctctctgtacatcaggctagatgcctcctgtctacgtggttttagatttacgaatcctgtcttctgttgtgtcccacagaaaaacccatgaggttttttaacattaaaaacagcagctttatgatagagaaaaaaacacaaacatagacgattgtaccattgcactcagaagaaacatcccaggccctgagcagcgtgtctttcctcggccgagtcaggcttcctggtgagcctcagggagtgcatggtctcagatgccatccttctcttctccagcatttccactcacctccgtgttcttggggagtgcgtggtgtcagatcccatcctgctcctctccagagtttccggtcacctccgtgttctcagggagtgcgtggtcttggatgccatcctgctcatctccagcatttcctctcacctccgtgttctcggggagtgcgtggtgtcagatcccatcctgctcatctccagcatttcctctcacctctgtgttctcggggagtgcgtggtgtcagatcccatcctgctcctctccagcatttcctctcacctccgtgttctcggggagtgcgtggtgtcagatcccatcctgctcctctccagagtttcctctcacctccgtgttctcggggagtgcgtggtctcagatcccatcctgctcctctccagagtttcctctcacctccgtgttctcagggagtgcgtggtcttggatgccatcctgctcatctccagcatttcctctcacctccgtgttctcggggagtgcgtggtgtcagatcccatcctgctcctctccagcatttcctctcacctccgagctctcggggagtgcgtggtctcagatcccatcctgctcctctccagagtttcctctcacctccgtgttctcgttctcatctctgccggaattccacatctgctcgtgcatgccatccaccttttccactagatccttttacatcatcattataatgatttttttttaataagtgttttctttcagttttaaatttcagatgttgtgtttttcaggtctaaggtgtctggtaattttttgtggatgccgattctctgttgaaattctccatcttttcatttcctttatatctcttttcttcttttttctataatatattacatttttctaataagtttttagtgagtgtccagcattgtataagttgacccttgaacaagagtttgaattataagggtccacttataagtggatttttaaaaaaatatatattgcaaaaatttttggaaatttgcaacaatttgaaaaactttgcagatgagccacatagcctagaaatatctgaaaaaagaaaaagttatgtcatgaatgcataaaatatacagaccatacatggaccattcacagtagagagaaatgtcgccgtaaagatgcagcattggccgagtgcagtggctcacgcctgtaatcccagcactttgggaggccgaggtgggcagatcacctaaggtcaggagttcaagaccagcctggccaacatggagaaaccccgtgactactaaaaataaaaaattagccaggcatggtggcacatgcctgtaactccagctacttgggaggctgaggcaggagaatcacttgaacccggaaggcagaggttgcagtgagccgagatcacgccattgcactccagcctgggcaacaagagcaaaactctgtctcaaaaaaaaaaaaatgcagcattaaattataactgcatgaaattaactgcagtccacagtgtgctgctggaataattacaaagccacctcctgttgctattgcagtgagcgcaagcatgtcaaggatccgcttaaaacatcgtgtggtgctaatctctgcacgagcggttcatgtcttcagtacattgtgtatcacggtaaaaagtgatctgttttaactggacatggtggcacacgcctgcagtcccagctactcaggaggctgaggcaggaggatcccttgagcccaggaggtcgaggctgcagtgagctgtgattgcaccactgcactcaagcctgggcaacagagtgagaccccaacttgaaaaaaaggggacatcgggatgttcttgtgtatttttcatgttgagcgcaatactgtaaaccttgaagaacactttgggacccatagagtgccaccagtcatgccaaagagctcctgagaagcagagaaaagtcatgacatttcaagaaaaagttgaatttcttgatatgttccgtagattgaggtttacagctgcggttgcctaccaattcaagataaatgaatccagcgtaaggaccatagtaaaaaaataaggaaatttgtgagcaggcacaaaagccttaacactttctgtgaaatacctttttatcttgtattgggaatgcagcttttatgtgggtataggattgctgtgtgtgatggttcatattaaatgtcaacttgattagattgaagaatgtaaagtattgtttctgggtgttgccagaagagattaacatttgagtcagtggactgggagaagacccaccacagtgtgggcaggcaccatccagtcggctgccagcatggctggaaaaagcaggcagaagaaggtggctgaagctgactggctgagtcttctggccttcatctctctcccatgctggatgcttcctgcccttgaacatcagactccaagttctttagcttttggactcttggacctacactggtgttttgccaggggctctcgggccttcggccacagactgaaggctgcactgtcggcttccctcctttagaggtttggggactcagactgagctactactggcttccttgcccctcagtttgcagacagcctattgtgggacttcaccctgtgatcctgtgcctcagttctccttaataaactccatttcatatg

SEQ ID NO: 4598 - DNA, 1401 bp, Homo sapiens
agttccggctccaaaggccgccggaaggagtcctggttcttttctttctgattcttttgtctactgtttacatcttttaaggcaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagcccagaggatgaggaagaggaaggaagagctcagcaaactcctgcctccgcggaggagcatggtggcatcaaagattccctctgccacagatctgatagataacaggaaagtaccactgaatccgcctggaaaaatgaaaccaagcaaagagaaatcgccacaagcaagtaaagaaatgagtgccctgcaggagagaaatttagaagagaagataaaacagcacgtcctccaaatgcgtgagcaaagaagattccatggccaggccccactggaggagatgaggaaggctgccgaggatctggaaattagccggagatgggagagaggaggcatgagggcaggatgtggagccacttcatggagaccccacccaacctgactcggaccccacttctgagactcttttcctcctcagcccaa

SEQ ID NO: 4599 - DNA, 774 bp, Homo sapiens
tgttccgaacatctgtttctactccctcaggaaatacagatatggatataaatacatataataatcaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacg

SEQ ID NO: 4600 - DNA, 5971 bp, Homo sapiens
cccgctccctcttccccagctccctctggcgcgggttccgctccacccccggagccccgcccccgacgcccggcgctccgccccgccctcgcctggctccctgccccgccccgcccgccgtcccccgcttggcttccagcgccgcttgcgctccggagcgctggctctgctggcgctgagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaagatttgaactttctgtctccaatctcattacccagaagtctcctagagctgctgcactgccctctggggcactgtcatcggtgtagtgagcctatgtttaccatcgtctaccccaagctctttcccttgagagagacgccaatggcagggctgcaccagtggaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcactgcagaactctctagaaatgtcatgattgagcttcagagctaaaatgccttcacccttcccccaagttggaatatatcctcccccaaattaaggacccatttgtcttctgtgtttttcctttttatgtgagtgtgtcttttacagaaaccatttagattgatgggcctccccaaatctaatttaaagcaagtttccggtccttggagaacagtgacttgatcatctagccagattcccttttgaacacacataccttcagtgatgcttcctctcctctcccctcccttgctttccccagagagttatttccctgagaccatgttctccacagtgtctccagtggaaacttgtcagtttttgaggagtttcagcaaaccccgtggcctcaatggtcttgagtagcagggtggggcgcctgagttggcagcaaagtgaggctcccatggaggctcagtgagggtcccagagcacacaccctctggaaagttccagccttgtttatacgttctacagtgtagcaacagacttttgtgagggattttaaaaacaaaaatgtagattgtaatgaaatacacttcctgttttttaaaagtgtttgcagaaaaatgatttttgaagtttttaaatttcctgataagattttttttatatgagaagaatttgaggaatatttgaagctttacaagatctgatttttttctttctcaatataaagtttccatacaatgagaaagggggagaaaacacacattgaaataagacctccgtgttcttttttgatgggtttatgattcagtttatactgactttgaaatatttttgtcacatgtgaaaggcttcagctacttccactactggtttttttttgttgttgttgagacggagtctcgctctgtcgcccaggctggagtgcagtggcgggatctcggctcactgcaagctccgcctcccgggttcacgccattctcctgcctcagcctcccaagtagctgggaccacaggcgcccgccaccacgcccggctaattttttgtatttttagtagagacggggtttcaccgtgttagccgggatggtctcgatctcctgacctcgtgatccgcacgcctcggcctcccaaagtgctgggattacaggcgtgagccaccgcgcccggcccactactggtttttaacaggatgattcaaagtacagcccgtgcacatttacttcgtcacctggtgcaccacactgtcttcatgttggccctcgtttcttgtatacttagcttactgcccagatgcaactgagaaaatacaggaaaagcaggtccaaattcagccttcgacttctgcaaaagtccataaacagaaagtctgtgagcctccaccctgccagaaagaactcttcatgaagaagtcacgtatttgctcttcctttcaaaggatggcattttaatgttgctttgctgccagatgttcatctgcttgctgtgaagtgattctttttttaaaatgttttttaatgatgtaagttttctaaaaggcagggctgaatggagaaccaagaatttgcttggtagaaaaattatttttttttaatttcagacttatcaaaaatttggttgagggaatttttattagctgccctgactttataatgctacgctcttaacagtgccaaaaatcctacatagttactgacaaatgtgtgatctttttacagtcacaacacctgctgcccggaaagcacaccgtccacgtagaatggagaaggcagaaagttaccgtgtgttcccactgtatctgcactgttcttacttcctcttgtcccttttcatatcttggtctattcagccttaacatttcaaaggcttatagtaaaataggaactgaagatctgtatcaaaatgtaacactttcatcctttggaataattgaagtttaacataacctctacatgtatataagttagctggtgaaaatgtggcatgaaacttcacaattgtgcttcaggcctaagtgactgctacctatgatttaagtgacagtaaatgtcttgctacatttttctatttcatcctctacaatcatatgtcatggaatggagctatgaaatgtgctaacttggtattcaggattctcattgtgataaggtgatacattagttttaccttgtttgaaattttacaaaaatgcttacaatccaggcattctttctctacctattatgaactacggtgtgttaaacaacagcagtgggctgggcagacaacctttgggcagtctcaaccttaatccttgggtacagcacctgaacttaattgatgagaagtggaacttaagtggtttccctggtgctgttcattatggaaattttatgctggatttatcgatgtcattcttaatcttttgatactataaaggagtcttaccaactggagaaaatttgcctacatgctatatatttgaattgtgtccaaagctttgcagaaaagcaaatctgaagttattatatatgttgttttcttgagcaacagttacactaggtagaaaagtattcacacaataatagtaatgcaaaaaaagtgagctacttggaaagtatcatctctgttcaggtaagtttacttcagtgaactcttgtgtggttagcgataagttttaaagtccaggatagcctcatgagcataggccttcctatgaagtagtgcaaagggggccgattttagtggattaccctatcagtgttcttcagtatgtccaattgttatcataccaaaaaccttaattacataacattgtgtggatgaaatgctgcatcttcagttaatacatgttttgagcacattcttaaaatacataataattaaatgatccctattcaaaagaaccctggcttgggtggaggatccactctggctaacggataagagtgatgaacttctttgttacctgacccttctcttctggaaaagtgaggtgtacattaaacatcttttggtcaccgtgcctcactaagacctttcacattccagcttgtccgactagtgtaatgtacctctcacttctgttttacgttgagcattacgaattaaaatctttacagtctagggggaaaaaaaggcttcaataccagttggcttatgaggctctgcatataattttctctaaaatatgtaactattttgtagtctgtggggactttcaaagccaatttttaaaattagtagtagtaaaggtttttccctttcctgaatgaaaaatcagaaattctaatctttgctataaagtacttaaacacaatacattgcctcagcataaataaaaacatttttattaagatgatttatgaacatggatttctaactggaccaacactaatgttgcaacctgataaaatttgagatgtaaattcatttcacagactcataaacacactctctttaagactcttctttaaatggatccttacattaccctgcctgttttattatgccttcatttttgtggttttcattcactcctgcttgcttctattgaggttctcctacatttcccagaaactcagtgaatatcttgccttttcttcaaacaaagggggtttttataaagtttgtatttttgaaactagctctatgtctatctaaaaatcaagtctcggcagtggctcatgcctataatcccagcactttgggaggccgaggagggcagatcatctgaggtcaggagtttgagaccagcctggccagcatggtgaaaccccatctctactaaaaatacaaaaaattagccaggcgtggtggcgcgcacctgcagtcccagctactcgggaggctgaggcaggagaattgcttgaacccggcaggaagaggttgcattgagctgagatcacgccattacactccagcctgggcaacagagcgagactccgtctcaaaaaaaaatcattcaagtttcactgtgcctacagtgaggagctacctccttgtgtcatcagctaatagatctgaaagtgatgccggtgtctctaggaaaggaattgatcatagccaagtgactgacattctctcggtcaggaaaagagcttgcttcacagcctttgaagtatgactgtatgtgtggtccccttgtactttggagacagaaggtactggcagcgagtgtggtggatgggcagaaggtgtagcattcggagattatttctgtatgtaattaagagactttcaagggttagccagacttttttccactcaagtgtggattatctttgctacctgtgttaaagaatatcaggttttgtttcttattgtgatttttgagtctaaatgatccaagatttttaaaatagatacataatgaaatccaggcctctgaaaaattatggcaacattcatttggagtgtggctaaaaactcatactttatccaatttggttgcctctctcagttactgcagtttatagaataattgagcttgaaccatgtgaatgctcagaatgtcaatggtggagtatttattcaagagaaatggctgaatctcgatacgaa

SEQ ID NO: 4601 - DNA, 1343 bp, Homo sapiens
gcttggcttccagcgccgcttgcgctccggagcgctggctctgctggcgctgagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaagatttgaactttctgtctccaatctcattacccagaagtctcctagagctgctgcactgccctctggggcactgtcatcggtgtagtgagcctatgtttaccatcgtctaccccaagctctttcccttgagagagacgccaatggcagggctgcaccagtggaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcactgcagaactctctagaaatgtcatgattgagcttcagagctaaaatgccttcacccttcccccaagttggaatatatcctcccccaaattaaggacccatttgtcttctgtgtttttcctttttatgtgagtgtgtcttttacagaaaccatttagattgatgggcctccccaaatctaatttaaagcaagtttccggtccttggagaacagtgacttgatcatctagccaga

SEQ ID NO: 4602 - DNA, 1070 bp, Homo sapiens
gcttgcgctccggagcgctggctctgctggcgctgagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtgggcttctgtactgctgcacatgctgttccctctgcttggaatgctcataacacatttccatttattccagctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaagatttgaactttctgtctccaatctcattacccagaagtctcctagagctgctgcactgccctctggggcactgtcatcggtgtagtgagcctatgtttaccatcgtctaccccaagctctttcccttg

SEQ ID NO: 4603 - DNA, 1235 bp, Homo sapiens
gcttgcgctccggagcgctggctctgctggcgctgagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaaggaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcactgcagaactctctagaaatgtcatgattgagcttcagagctaaaatgccttcacccttcccccaagttggaatatatcctcccccaaattaagga

SEQ ID NO: 4604 - DNA, 744 bp, Homo sapiens
tggctggctaactcgggcgaaacggcgtgtgttttgcctaagactctgccagtgtttgttaccacagctgagaaaatagccttttacaaatgcttttaatatgtagcttatagttctctaatctccagcgttaggaaattggaatgcgtattctactaaattgagtacggggagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatgg

SEQ ID NO: 4605 - DNA, 1303 bp, Homo sapiens
atggcggagtcgctgcccctggagatgctcacatatattctgagcttcctgcctctgtcagatcagaaagaggcctccctcgtgagttgggcttggtaccgtgctgcccagaatgcccttcgggagcaaccaggccttacctccctggacctcagtggctgctcagaactgactgatggggcgctcttggccgtgagccggggcctgcggcacctgcggcgcctgagcctggggaagctgcagcggctgacagatgcaggatgtacagctctgggtggcctgcaggagctgcagagcctcgacatggccgagggcgggaactggcccaggccctgggctgtatgcacggggctccatcccagctggcctccctcagcctggcccactgctcttcattgaagtcacgcccagagctggagcatcaggcctcaggtaccaaggacgcctgtccagagccacagggcccctccctgctcacgctgcgggccctgcaggagttggacctcacagcctgcagcaagctgactgatgccagtttagccaaggtgctccagtttctccagctgaggcagctgtcccttagcctgttgccagaactcacagacaacggcttggttgctgtggccaggggctgtcctagcctggagcacttggcgctgagtcactgcagccgactcagtgacaagggctgggcccaggcagccagctcctggccaaggctgcagcatctcaacctgtccagctgcagtcagctcatagagcagacactggatgctattgggcaggcgtgcaggcagctccgggtgttggatgtggccacgtgccctggcatcaacatggccgccgtcagacgcttccaagcccagctgccccaggtgtcctgtgtccagtcccgcttcgtgggaggggctgacctgaccctaacactctgaggccagaccctctaggactgggggtggggccaatccagggcagcccagagggaacatcctgccacaccgcctggcagtagcctctttccagctacacgtcgctgccacaggcccctggaaatgctacctacgtgttgccgccacaggctcctgctctctggccaagccctgggtgggaggccaggcccccagcgggcagggtctggtgctgggaggagcagagcctctgcctcttgcctgccctcctctcagacctaaggccgggctccacctactcctgtgggactctcccagcaccctgtgtgcactgagcttcagcagctgagcctaggtctgtgctgtaaatcctaagattaaacattccagatagt

SEQ ID NO: 4606 - DNA, 1468 bp, Homo sapiens
gttcctcctttgggccactctgtccctttagcttgggggaccgtcctccccttccctatcggccccagaagatagctgccctgtcatctccgcgagaacaggccctctgcccatccccttcccttgaagtggctgtctcctccccgctcagttctggaagatgtccgctccatctcatcgtcccgaaggatgctcacatatattctgagcttcctgcctctgtcagatcagaaagaggcctccctcgtgagttgggcttggtaccgtgctgcccagaatgcccttcgggagcaaccaggccttacctccctggacctcagtggctgctcagaactgactgatggggcgctcttggccgtgagccggggcctgcggcacctgcggcgcctgagcctggggaagctgcagcggctgacagatgcaggatgtacagctctgggtggcctgcaggagctgcagagcctcgacatggccgagggcgggaactggcccaggccctgggctgtatgcacggggctccatcccagctggcctccctcagcctggcccactgctcttcattgaagtcacgcccagagctggagcatcaggcctcaggtaccaaggacgcctgtccagagccacagggcccctccctgctcacgctgcgggccctgcaggagttggacctcacagcctgcagcaagctgactgatgccagtttagccaaggtgctccagtttctccagctgaggcagctgtcccttagcctgttgccagaactcacagacaacggcttggttgctgtggccaggggctgtcctagcctggagcacttggcgctgagtcactgcagccgactcagtgacaagggctgggcccaggcagccagctcctggccaaggctgcagcatctcaacctgtccagctgcagtcagctcatagagcagacactggatgctattgggcaggcgtgcaggcagctccgggtgttggatgtggccacgtgccctggcatcaacatggccgccgtcagacgcttccaagcccagctgccccaggtgtcctgtgtccagtcccgcttcgtgggaggggctgacctgaccctaacactctgaggccagaccctctaggactgggggtggggccaatccagggcagcccagagggaacatcctgccacaccgcctggcagtagcctctttccagctacacgtcgctgccacaggcccctggaaatgctacctacgtgttgccgccacaggctcctgctctctggccaagccctgggtgggaggccaggcccccagcgggcagggtctggtgctgggaggagcagagcctctgcctcttgcctgccctcctctcagacctaaggccgggctccacctactcctgtgggactctcccagcaccctgtgtgcactgagcttcagcagctgagcctaggtctgtgctgtaaatcctaagattaaacattccagatagt

SEQ ID NO: 4607 - DNA, 1940 bp, Homo sapiens
cccaatgcccagcaccctctgaagccagagggctacccccaggcctgctgctgctccgtagacagatgtgcgatacaacatccccgtgtcctctgcctccctctcggccatcaagagcctgggcctcaggggcatctgctgcatcagcctgaccaacctggatggctctctggcttcacaccaggtgctacaatctgttgcttaccacctgggcccacacctgcagagcttgtccctgggtggaggcagccccacagaggcctcctctgtggccctgatcctgggctgcccagccctgtgtgtccttgacctcagtggctgcaatagcctcttcacctcgggcacactgctggctcagccagagatggcacagagcgtccagcaggctttgagcggcctccgtgagctcaacctggctggcctgcgagacctggctgacctcagcttcaaccagctcagcagctgtgcccccagcctggagcgcctctccttggcatactgccacctcaccttcgagctaggcccagcctgaggctccatcggcccccaagactcctctcccgcccagttctccttctgcaacctgctgcgattagtgcaagagcgggctggcaggctgcgtgccctggacctgagtggcactggcttgccccccgaggccctgcaggctctgggccaggtagctgggctgcagcttcaggagctgagcctgcacagctgccgggacctctccacagaggctgtggctaccctgtgcttccagcaaccaggccttacctccctggacctcagtggctgctcagaactgactgatggggcgctcttggccgtgagccggggcctgcggcacctgcggcgcctgagcctggggaagctgcagcggctgacagatgcaggatgtacagctctgggtggcctgcaggagctgcagagcctcgacatggccgagggcgggaactggcccaggccctgggctgtatgcacggggctccatcccagctggcctccctcagcctggcccactgctcttcattgaagtcacgcccagagctggagcatcaggcctcaggtaccaaggacgcctgtccagagccacagggcccctccctgctcacgctgcgggccctgcaggagttggacctcacagcctgcagcaagctgactgatgccagtttagccaaggtgctccagtttctccagctgaggcagctgtcccttagcctgttgccagaactcacagacaacggcttggttgctgtggccaggggctgtcctagcctggagcacttggcgctgagtcactgcagccgactcagtgacaagggctgggcccaggcagccagctcctggccaaggctgcagcatctcaacctgtccagctgcagtcagctcatagagcagacactggatgctattgggcaggcgtgcaggcagctccgggtgttggatgtggccacgtgccctggcatcaacatggccgccgtcagacgcttccaagcccagctgccccaggtgtcctgtgtccagtcccgcttcgtgggaggggctgacctgaccctaacactctgaggccagaccctctaggactgggggtggggccaatccagggcagcccagagggaacatcctgccacaccgcctggcagtagcctctttccagctacacgtcgctgccacaggcccctggaaatgctacctacgtgttgccgccacaggctcctgctctctggccaagccctgggtgggaggccaggcccccagcgggcagggtctggtgctgggaggagcagagcctctgcctcttgcctgccctcctctcagacctaaggccgggctccacctactcctgtgggactctcccagcaccctgtgtgcactgagcttcagcagctgagcctaggtctgtgctgtaaatcctaagattaaacattccagatagt

SEQ ID NO: 4608 - DNA, 1410 bp, Homo sapiens
ggcagggatgcgatggcggagtcgctgcccctggagatgctcacatatattctgagcttcctgcctctgtcagatcagaaagaggcctccctcgtgagttgggcttggtaccgtgctgcccagaatgcccttcgggagcaaccaggccttacctccctggacctcagtggctgctcagaactgactgatggggcgctcttggccgtgagccggggcctgcggcacctgcggcgcctgagcctggggaagctgcagcggctgacagatgcaggatgtacagctctgggtggcctgcaggagctgcagagcctcgacatggccgagggcgggaactggcccaggccctgggctgtatgcacggggctccatcccagctggcctccctcagcctggcccactgctcttcattgaagtcacgcccagagctggagcatcaggcctcaggtaccaaggacgcctgtccagagccacagggcccctccctgctcacgctgcgggccctgcaggagttggacctcacagcctgcagcaagctgactgatgccagtttagccaaggtgctccagtttctccagctgaggcagctgtcccttagcctgttgccagaactcacagacaacggcttggttgctgtggccaggggctgtcctagcctggagcacttggcgctgagtcactgcagccgactcagtgacaagggctgggcccaggcagccagctcctggccaaggctgcagcatctcaacctgtccagctgcagtcagctcatagagcagacactggatgctattgggcaggcgtgcaggcagctccgggtgttggatgtggccacgtgccctggcatcaacatggccgccgtcagacgcttccaagcccagctgccccaggtgtcctgtgtccagtcccgcttcgtgggaggggctgacctgaccctaacactctgaggccaggtcagtaaccagccctgcagcacagcctccttgactcccccagtctccaaccctggccttgacccgggttgctttttgcctccctctactgcagaccctctaggactgggggtggggccaatccagggcagcccagagggaacatcctgccacaccgcctggcagtagcctctttccagctacacgtcgctgccacaggcccctggaaatgctacctacgtgttgccgccacaggctcctgctctctggccaagccctgggtgggaggccaggcccccagcgggcagggtctggtgctgggaggagcagagcctctgcctcttgcctgccctcctctcagacctaaggccgggctccacctactcctgtgggactctcccagcaccctgtgtgcactgagcttcagcagctgagcctaggtctgtgctgtaaatcctaagattaaacattccagatagta

SEQ ID NO: 4609 - DNA, 785 bp, Homo sapiens
ccagcctggcggaaacgacccgccctcccgatcccgggaccttctagctctggatgctcacatatattctgagcttcctgcctctgtcagatcagaaagaggcctccctcgtgagttgggcttggtaccgtgctgcccagaatgcccttcgggagcaaccaggccttacctccctggacctcagtggctgctcagaactgactgatggggcgctcttggccgtgagccggggcctgcggcacctgcggcgcctgagcctggggaagctgcagcggctgacagatgcaggatgtacagctctgggtggcctgcaggagctgcagagcctcgacatggccgagggcgggaactggcccaggccctgggctgtatgcacggggctccatcccagctggcctccctcagcctggcccactgctcttcattgaagtcacgcccagagctggagcatcaggcctcaggtaccaaggacgcctgtccagagccacagggcccctccctgctcacgctgcgggccctgcaggagttggacctcacagcctgcagcaagctgactgatgccagtttagccaaggtgctccagtttctccagctgaggcagctgtcccttagcctgttgccagaactcacagacaacggcttggttgctgtggccaggggctgtcctagcctggagcacttggcgctgagtcactgcagccgactcagtgacaagggctgggcccaggcagccagctcctggccaaggctgcagcatctcaacctgtccagctgcagtcagctca

SEQ ID NO: 4610 - DNA, 906 bp, Homo sapiens
atgggggccaggcagtcaagggccagctccaaggataagggccccaagaggatgctgttcacggggaggagacagaagttttctccgtgggacgatgccctgctctcgggaagggacccgcggtccctgctgaagcggggcatgcaccacgtcagcttcagcctggtcacgagaggaatgacagacatccccgactttctgtggggcttgtccgaggtccagaaactcaatctgtctcacaaccagctccgggttctccctcccgaggtggggaaactgacccggatcgtggtcctgaacttgtgcgggaaccgcctgaagagcctgcccagagaagtgagcctcctacagtgcctcaaggtcctgtttgtcaacatgaactgcctgacagaggtgccggccgagctgagcttgtgccgaaagctggaggtcctgagcttgtcgcacaactgcctgtcccagctccctgcatgcttcgccgacctctctagactgaggaagctaaacctcagcaacaacttcttcgcgcacatccccatgtgtgtgttctccctgaaggaactgattttcttgcacgtgggctcgaatcgcctggaaaacatcgctgagagcatccagcacctggccagcctgcagatcttcatcgcagagggcaacaacatccactccttcccgaggtcgctttgcctggtcaccagcctggagctgctgaacctcaacaacaatgacatccagaccctcccgagcgaactccacctgctgtgtagactggtgaggatcgcctggaatcccatggacaaagggctccacatttcccacaaccctttatccaagcctctgccggagctggtggaggggggcctggagatgctcttcggctacctgaaggacaaaaaacacacctga

SEQ ID NO: 4611 - DNA, 2355 bp, Homo sapiens
tgtaggggaggatattttgattgaacacaggcttgacagaatcttcttttcttcttagaaatcctagaaaacagaaagcaacaggaagatgtcttattgggaactacccccatcaacttcaccatgagtcaaacaaggaagaaaacttcctcagaaggagaaactaagccccagacttcaactgtcaacaaatttctcaggggctccaatgctgaaagcagaaaagaggacaatgaccttaaaacaagtgattcccaacccagcgactggatacagaagacagccacctcagagactgctaagcctctcagttcagaaatggaatggagatccagtatggagaaaaatgagcatttcctgcagaagctgggcaaaaaggctgtcaacaagtgtctagatttgaataactgtggattaacaacagcggacatgaaagaaatgggagaagcatttgagatgattcctgaacttgaagagctaaatttgtcttggaacagtaaagtgggaggaaatttgcctctgatccttcagaagttccaaaaagggagcaagatacaaatgattgagcttgtggattgctccctcacgtcagaagatgggacatttctgggtcaactgctacctatgctgcaaagtctcgaagtacttgatctttccattaacagagacattgttggcagtctgaacagtattgctcagggattaaaaagcacctcaaatctgaaagtactgaagttacattcatgtggattatcacaaaagagtgtcaaaatattggatgctgcttttaggtatttgggtgagctgaggaaattagatctttcctgcaataaggatctaggtggaggttttgaagactcgccggctcagttggtcatgctaaagcatctacaagtcctagatcttcaccagtgctcactaacagcagatgacgtgatgtcactgacccaggtcattcctttactttcaaatcttcaagaattggatttatcagccaacaaaaagatgggcagttcttctgaaaacttactcagcaggctccgatttttaccagcattgaagtcattagttatcaacaactgtgctttggagagtgagacttttacagctcttgctgaagcctctgttcacctctctgctctggaagtattcaacctttcttggaacaagtgtgttggtggcaacttgaagctgcttctggaaacactaaagctttccatgtctcttcaagtgctgaggctgagcagctgttccctggtgacagaggatgtggctctcctggcatcggtcatacagacgggtcatctggccaaactgcaaaagctggacctgagctacaatgacagcatctgtgatgcggggtggaccatgttctgccaaaacgtgcggttcctcaaagagctaatcgagctggatattagccttcgaccatcaaattttcgagattgtggacaatggtttagacacttgttatatgctgtgaccaagcttcctcagatcactgagataggaatgaaaagatggattctcccagcttcacaggaggaagaactagaatgctttgaccaagataaaaaaagaagcattcactttgaccatggtgggtttcagtaaactgatttcccatgtcctactaagctacaaaccattctccaaaggaaaagaacatgaacgaattccagagtcatgaactgaatttcaacttctgggccatttaatgggacttatattacaagagctttgtaaatatatatatatattacatatatatatgtaatatacatatatacacatatatataatatacatatataatacacatatatatgtaaatatatatataatatctaatatgagcatgccattattctctgtctatgaaacaaaaatggcatttttcaatggatttgttttggatatataattagttcatttgctgtttagaagccttgccaaaagtgtttagattttggtactgcaactgctttcctcttgcccagaaatgttttgcctcttcttttcctacaagttaaatgttctaaatataaaggggtatgtgtgtgtgtgtgtaattctaatgtgaaaggcactagctgtctaatagtttcatgtatcattactattactatatgtatcttaatgtagtctatgtaggtttttatcagaaagtgtacctttctatggtttattattttatattctggtgccttttatctcagatataaaccatgaacagtaatgatagtcactgacatataaatcttagtaaaaagtgattaaaaatctaaaactcagtatgaaaaacatatcttgttagaataaattaaaaccttttattgtttaaaaaattgttaa

SEQ ID NO: 4612 - DNA, 2520 bp, Homo sapiens
agaaaacagaaagcaacaggaagatgtcttattgggaactacccccatcaacttcaccatgagtcaaacaaggaagaaaacttcctcagaaggagaaactaagccccagacttcaactgtcaacaaatttctcaggggctccaatgctgaaagcagaaaagaggacaatgaccttaaaacaagtgattcccaacccagcgactggatacagaagacagccacctcagagactgctaagcctctcagttcagaaatggaatggagatccagtatggagaaaaatgagcatttcctgcagaagctgggcaaaaaggctgtcaacaagtgtctagatttgaataactgtggattaacaacagcggacatgaaagaaatggttgccttgctgccttttctcccagacttggaagaactggatatctcctggaatggttttgtaggtggaaccctcctttccatcactcagcaaatgcatctggtcagcaagttaaaaatcttgaggctgggtagctgcagactcaccactgacgatgttcaagcactgggagaagcatttgagatgattcctgaacttgaagagctaaatttgtcttggaacagtaaagtgggaggaaatttgcctctgatccttcagaagttccaaaaagggagcaagatacaaatgattgagcttgtggattgctccctcacgtcagaagatgggacatttctgggtcaactgctacctatgctgcaaagtctcgaagtacttgatctttccattaacagagacattgttggcagtctgaacagtattgctcagggattaaaaagcacctcaaatctgaaagtactgaagttacattcatgtggattatcacaaaagagtgtcaaaatattggatgctgcttttaggtatttgggtgagctgaggaaattagatctttcctgcaataaggatctaggtggaggttttgaagactcgccggctcagttggtcatgctaaagcatctacaagtcctagatcttcaccagtgctcactaacagcagatgacgtgatgtcactgacccaggtcattcctttactttcaaatcttcaagaattggatttatcagccaacaaaaagatgggcagttcttctgaaaacttactcagcaggctccgatttttaccagcattgaagtcattagttatcaacaactgtgctttggagagtgagacttttacagctcttgctgaagcctctgttcacctctctgctctggaagtattcaacctttcttggaacaagtgtgttggtggcaacttgaagctgcttctggaaacactaaagctttccatgtctcttcaagtgctgaggctgagcagctgttccctggtgacagaggatgtggctctcctggcatcggtcatacagacgggtcatctggccaaactgcaaaagctggacctgagctacaatgacagcatctgtgatgcggggtggaccatgttctgccaaaacgtgcggttcctcaaagagctaatcgagctggatattagccttcgaccatcaaattttcgagattgtggacaatggtttagacacttgttatatgctgtgaccaagcttcctcagatcactgagataggaatgaaaagatggattctcccagcttcacaggaggaagaactagaatgctttgaccaagataaaaaaagaagcattcactttgaccatggtgggtttcagtaaactgatttcccatgtcctactaagctacaaaccattctccaaaggaaaagaacatgaacgaattccagagtcatgaactgaatttcaacttctgggccatttaatgggacttatattacaagagctttgtaaatatatatatatattacatatatatatgtaatatacatatatacacatatatataatatacatatataatacacatatatatgtaaatatatatataatatctaatatgagcatgccattattctctgtctatgaaacaaaaatggcatttttcaatggatttgttttggatatataattagttcatttgctgtttagaagccttgccaaaagtgtttagattttggtactgcaactgctttcctcttgcccagaaatgttttgcctcttcttttcctacaagttaaatgttctaaatataaaggggtatgtgtgtgtgtgtgtaattctaatgtgaaaggcactagctgtctaatagtttcatgtatcattactattactatatgtatcttaatgtagtctatgtaggtttttatcagaaagtgtacctttctatggtttattattttatattctggtgccttttatctcagatataaaccatgaacagtaatgatagtcactgacatataaatcttagtaaaaagtgattaaaaatctaaaactcagtatgaaaaacatatcttgttagaataaattaaaaccttttattgtttaaaaaattgttaacatattgcctccaggcatttctttgaaatggaatttgcttcataaaactaatttaattcgtt

SEQ ID NO: 4613 - DNA, 1744 bp, Homo sapiens
ggagcccctcaaacctcgggaactcctccctgcaaaggagccaggacgccctccctcaggctgcctttaaccagggcagggtgacaaaggacctccacagagtaggcggtcactgccttagcagtgaggcctcagggcccgggcaggcacagccagcgggactcgaagcaggctggcgccgaggctcgtgtagccgcctcacagctgcaggcggactgtaagtgcgcgcgcggtcgccatggcagcgcagccgccgcggccagtgggtgagaggagcatggggagctcccgggaggccgcccgtgcgccggccaggtccccggcttgggcctccactcaggccagtactccgggcgcggccctggcggtccagcgcgaatctccagaatctggtctccagaaacattattctaatctgtgtatggaaaaatcccagaaaattaatccttttatattgcatatactccaagaagtggatgaagaaattaaaaaggggctagcagcaggaatcacattaaacattgctggtaacaatcgcttagtgccagtagaaagagttacaggtgaagatttttggattctttccaaaattttaaagaattgtctgtatattaatggtttggatgttggatataaccttctatgtgatgttggtgcatactatgctgcgaaactgcttcagaaacaacttaatctcatttacttaaacctcatgtttaatgatattgggcccgaaggtggagaattgattgctaaagtgctacataagaatcggactctgaaatacctaagaatgactggaaacaaaattgaaaataaaggtggaatgttttttgctgcaatgctgcaaattaattcatcattagagaaattagatctgggtgactgtgatctggaagagtctacagtccatgtaggccgcatgttgaaagaaaatcactgtcttgttgcactacacatgtgtaagcatgatataaaaaacagtggtatacaacagttatgtgatgcactgtatctgaacagtagcctgcgctaccttgatgtcagctgcaacaaaataactcatgatggaatggtgtatttggctgatgtactgaaaagcaacactaccctggaagtaatagatctttcctttaacagaatagaaaatgcaggcgcaaactatctcagtgaaactcttacttcacacaacaggagtcttaaagcgttgtcagtagtcagcaacaacatagagggagaaggacttgttgcactttcacaatcaatgaaaacaaatctcactttctctcatatctacatttggggaaacaaatttgatgaggctacgtgtatagcatattcagacttaattcaaatgggttgtctaaaaccagacaatacagatgtggagccatttgtggtagatggacgtgtatatcttgcagaagtctccaatggccttaaaaagcattattattggacatcaacttatggagaatcttatgaccactcatctaatgcaggttttgctcttgttccagtaggtcaacagccatgaaaaagtagctgtaaaataattttcatacacttgtcttattgtttcacagagattaatattctatagcctattttcttttataaattaaaacaagttacttttttcaaatgtgtaaaagataatgactgtattaaactttgtataactgtctattgtgaaaaactgagtagggtaattttttaaaagaaattttacaatatagagact

SEQ ID NO: 4614 - DNA, 1718 bp, Homo sapiens
agtgaggcctcagggcccgggcaggcacagccagcgggactcgaagcaggctggcgccgaggctcgtgtagccgcctcacagctgcaggcggactgtaagtgcgcgcgcggtcgccatggcagcgcagccgccgcggccagtgggtgagaggagcatggggagctcccgggaggccgcccgtgcgccggccaggtccccggcttgggcctccactcaggccagtactccgggcgcggccctggcggtccagcgcgaatctccagaatctggtctccagaaacattattctaatctgtgtatggaaaaatcccagaaaattaatccttttatattgcatatactccaagaagtggatgaagaaattaaaaaggggctagcagcaggaatcacattaaacattgctggtaacaatcgcttagtgccagtagaaagagttacaggtgaagatttttggattctttccaaaattttaaagaattgtctgtatattaatggtttggatgttggatataaccttctatgtgatgttggtgcatactatgctgcgaaactgcttcagaaacaacttaatctcatttacttaaacctcatgtttaatgatattgggcccgaaggtggagaattgattgctaaagtgctacataagaatcggactctgaaatacctaagaatgactggaaacaaaattgaaaataaaggtggaatgttttttgctgcaatgctgcaaattaattcatcattagagaaattagatctgggtgactgtgatctgggaatgcaaagtgtgatagcatttgctacagtactaactcaaaaccaagcaattaaggcaataaacctaaaccgacctatactgtacagtgaacaggaagagtctacagtccatgtaggccgcatgttgaaagaaaatcactgtcttgttgcactacacatgtgtaagcatgatataaaaaacagtggtatacaacagttatgtgatgcactgtatctgaacagtagcctgcgctaccttgatgtcagctgcaacaaaataactcatgatggaatggtgtatttggctgatgtactgaaaagcaacactaccctggaagtaatagatctttcctttaacagaatagaaaatgcaggcgcaaactatctcagtgaaactcttacttcacacaacaggagtcttaaagcgttgtcagtagtcagcaacaacatagagggagaaggacttgttgcactttcacaatcaatgaaaacaaatctcactttctctcatatctacatttggggaaacaaatttgatgaggctacgtgtatagcatattcagacttaattcaaatgggttgtctaaaaccagacaatacagatgtggagccatttgtggtagatggacgtgtatatcttgcagaagtctccaatggccttaaaaagcattattattggacatcaacttatggagaatcttatgaccactcatctaatgcaggttttgctcttgttccagtaggtcaacagccatgaaaaagtagctgtaaaataattttcatacacttgtcttattgtttcacagagattaatattctatagcctattttcttttataaattaaaacaagttacttttttcaaatgtgtaaaagataatgactgtattaaactttgtataactgtctattgtgaaaaactgagtagggtaattttttaaaagaaattttacaatatagagact

SEQ ID NO: 4615 - DNA, 1899 bp, Homo sapiens
agatgtcacctccttcaggaagccctccctggtggccccgccctttgggagcacaaaaccctttatgctcccaaagcccaacgcctttatcatgtgctgatgctactctgcttcttcgctggcccggcaggccggtgcacactttgtaggagcgggctttgtcataatcttctttgtagccccagccctagctcagcagcggagcccctcaaacctcgggaactcctccctgcaaaggagccaggacgccctccctcaggctgcctttaaccagggcagggtgacaaaggacctccacagagtaggcggtcactgccttagcagtgaggcctcagggcccgggcaggcacagccagcgggactcgaagcaggctggcgccgaggctcgtgtagccgcctcacagctgcaggcggactgtaagtgcgcgcgcggtcgccatggcagcgcagccgccgcggccagtgggtgagaggagcatggggagctcccgggaggccgcccgtgcgccggccaggtccccggcttgggcctccactcaggccagtactccgggcgcggccctggcggtccagcgcgaatctccagaatctggtctccagaaacattattctaatctgtgtatggaaaaatcccagaaaattaatccttttatattgcatatactccaagaagtggatgaagaaattaaaaaggggctagcagcaggaatcacattaaacattgctggtaacaatcgcttagtgccagtagaaagagttacaggtgaagatttttggattctttccaaaattttaaagaattgtctgtatattaatggtttggatgttggatataaccttctatgtgatgttggtgcatactatgctgcgaaactgcttcagaaacaacttaatctcatttacttaaacctcatgtttaatgatattgggcccgaaggtggagaattgattgctaaagtgctacataagaatcggactctgaaatacctaagaatgactggaaacaaaattgaaaataaaggtggaatgttttttgctgcaatgctgcaaattaattcatcattagagaaattagatctgggtgactgtgatctggaagagtctacagtccatgtaggccgcatgttgaaagaaaatcactgtcttgttgcactacacatgtgtaagcatgatataaaaaacagtggtatacaacagttatgtgatgcactgtatctgaacagtagcctgcgctaccttgatgtcagctgcaacaaaataactcatgatggaatggtgtatttggctgatgtactgaaaagcaacactaccctggaagtaatagatctttcctttaacagaatagaaaatgcaggcgcaaactatctcagtgaaactcttacttcacacaacaggagtcttaaagcgttgtcagtagtcagcaacaacatagagggagaaggacttgttgcactttcacaatcaatgaaaacaaatctcactttctctcatatctacatttggggaaacaaatttgatgaggctacgtgtatagcatattcagacttaattcaaatgggttgtctaaaaccagacaatacagatgtggagccatttgtggtagatggacgtgtatatcttgcagaagtctccaatggccttaaaaagcattattattggacatcaacttatggagaatcttatgaccactcatctaatgcaggttttgctcttgttccagtaggtcaacagccatgaaaaagtagctgtaaaataattttcatacacttgtcttattgtttcacagagattaatattctatagcctattttcttttataaattaaaacaagttacttttttcaaatgtgtaaaagataatgactgtattaaactttgtataactgtctattgtgaaaaa

SEQ ID NO: 4616 - DNA, 2028 bp, Homo sapiens
aacacaccaagatgagactggtcctaatttttcctctgcgaatatggttttctgattaactactagttatgtctatgccaaaaaaagaaacatgctcagaccacggtttttgcctccagatgaccgaactgtacgtgaaggtgagagaaaagctgccaagctgcattttagtcagttgggcaacagtgaaaattttcttttagaggtggaaaaaagctctagggagaagacaatgaaaaactgtgtaacaggtgagagctctgcatcaaaagtcagtgctaatgttgacagcaggattgaaatggaaagagtcttgctctgtcgcccagactggagtgctgtggcgcgatctcggctcactgcaacctctacctcctgggttcaagcagttctcctgcctcagcctagcgagcagctgggattacagactcaaacaaaggactttttattcccttccccaaccgggaaataaaggattccctaagtacttctgcaactcagggcaatggtacacgtgatcagaaattagacaccttcccactggggacacagagttcagacactactcgcctcgtcagtccacagtccgatccccagagaagatgactagagaagggtaccaagtatcttttttggacaataagtcttcaggttcttctccagaaaaggaattgataccaaaacctgatacttttcatcttacccatgatgcctcattgagtaaatgcctggatgtgggtgattctagccagatccatccctatcagttaccttcagatgttggtctggaaaattatgacagttgttattctcaaactctatccctgcatggaagtcttggtaaaaggcctcagagaagcaagaactatcaagagtatagcataaagccttcaaatgacataaagaccaccgcttcacattcctgtggagacttattaacttctctgtcaaaccctgactccagcactggaaggcttttgaagcttagttcagatctgtatgccacaacccatttcaacagtgaccctgctgtacttgtcaatgtagagcaacaattatctaccagcctggatgatttaacaccagcacatggttctgtcccaaacaacgctgtcctgggaaacaggacaactcctctgcggacactgctgttgtctcctgggacttcagaacacagaaagatttttaccaagaggtcactaagcccatcgaagagaggattcaaatggaaggacaatatccttgccaacctgaatctaaagcatggtttccaagatgctacaggcagcgagcctctctctagtgacctgggtagtttgcacggtttggctggaaaccacagtccccccatctctgccagaaccccccatgtggccactgtcctcagacagctcctggagcttgtggataagcactggaatggctccggctccctcctcctcaacaagaagtttctcggaaagtttgaagcaaaaactggtcagagtgctggaggaaaacctcattttgtcagaaaaaattcaacagttggaggaaggtgctgccatctcaattgtgagtgggcaacagtcacatacttatgatgatcttctgcacaaaaaccaacagctgaccatgcaggtggcttgcctgaaccaggagcttgcccagctgaaaaagctggagaagacagttgccattctccatgaaagtcagagatccctggtggtaactaatgagtatctgctgcagcagctgaataaggagccaaaaggttattccgggaaagcgctcctgcctcctgagaagggtcatcatctggggagatcatcgccctttgggaaaagcacgttgtcttcctcctcaccagtggcacatgagactggtcagtatctaatacagagcgtcttggatgctgccccagagcctggcttatagagctagcatggaactcacaccacagcttccctggtccacagaggctctcaccgccattgccaccagtatggtggtatgtactcacaaagattaagaaagaaatgtattctg

SEQ ID NO: 4617 - DNA, 2398 bp, Homo sapiens
aggtgagcggcgggcggggatggcggagcaatgggagctggacgaggaaggcattcgccgcctgggggcgctgacgctggagcagccggaactggtggagtctctttcattgcagggatcttatgctggcaaaatccattccattggtgatgccttcagaaattttaaaaatctccgatccttagatttatcaaggaatttgatcactagccttaagggaatccagtatttatgttcactccaagacctgaatttatattataacaacattccttcattagtggaagtgtcccgtctacaaccgttacccttcctcaaagaactggatttgagacttaatcctgttgtaaggaaagatacagattataggctctttgctgtatatacactacaaactctggagaaattagatgaccgaactgtacgtgaaggtgagagaaaagctgccaagctgcattttagtcagttgggcaacagtgaaaattttcttttagaggtggaaaaaagctctagggagaagacaatgaaaaactgtgtaacaggtgagagctctgcatcaaaagtcagtgctaatgttgacagcaggattgaaatggactcaaacaaaggactttttattcccttccccaaccgggaaataaaggattccctaagtacttctgcaactcagggcaatggtacacgtgatcagaaattagacaccttcccactggggacacagacacaggaagtagcaagaagggagatgccaagtgacaatcaccaggaagatgagttcagacactactcgcctcgtcagtccacagtccgatccccagagaagatgactagagaagggtaccaagtatcttttttggacaataagtcttcaggttcttctccagaaaaggaattgataccaaaacctgatacttttcatcttacccatgatgcctcattgagtaaatgcctggatgtgggtgattctagccagatccatccctatcagttaccttcagatgttggtctggaaaattatgacagttgttattctcaaactctatccctgcatggaagtcttggtaaaaggcctcagagaagcaagaactatcaagagtatagcataaagccttcaaatgacataaagaccaccgcttcacattcctgtggagacttattaacttctctgtcaaaccctgactccagcactggaaggcttttgaagcttagttcagatctgtatgccacaacccatttcaacagtgaccctgctgtacttgtcaatgtagagcaacaattatctaccagcctggatgatttaacaccagcacatggttctgtcccaaacaacgctgtcctgggaaacaggacaactcctctgcggacactgctgttgtctcctgggacttcagaacacagaaagatttttaccaagaggtcactaagcccatcgaagagaggattcaaatggaaggacaatatccttgccaacctgaatctaaagcatggtttccaagatgctacaggcagcgagcctctctctagtgacctgggtagtttgcacggtttggctggaaaccacagtccccccatctctgccagaaccccccatgtggccactgtcctcagacagctcctggagcttgtggataagcactggaatggctccggctccctcctcctcaacaagaagtttctcggtcctgcccgagatttgcttctgtctttggtagtcccggctccttctcagccgaggtgttgctcacatcctgaagacacgatgaaagcattctgcaggagggagcttgaactgaaggaggctgcgcagctggtccctaatgacatggaaagtttgaagcaaaaactggtcagagtgctggaggaaaacctcattttgtcagaaaaaattcaacagttggaggaaggtgctgccatctcaattgtgagtgggcaacagtcacatacttatgatgatcttctgcacaaaaaccaacagctgaccatgcaggtggcttgcctgaaccaggagcttgcccagctgaaaaagctggagaagacagttgccattctccatgaaagtcagagatccctggtggtaactaatgagtatctgctgcagcagctgaataaggagccaaaaggttattccgggaaagcgctcctgcctcctgagaagggtcatcatctggggagatcatcgccctttgggaaaagcacgttgtcttcctcctcaccagtggcacatgagactggtcagtatctaatacagagcgtcttggatgctgccccagagcctggcttatagagctagcatggaactcacaccacagcttccctggtccacagaggctctcaccgccattgccaccagtatggtggtatgtactcacaaagattaagaaagaaatgtattctgatt

SEQ ID NO: 4618 - DNA, 1760 bp, Homo sapiens
cctctgcgaatatggttttctgattaactactagttatgtctatgccaaaaaaagaaacatgctcagaccacggtttttgcctccagatgaccgaactgtacgtgaaggtgagagaaaagctgccaagctgcattttagtcagttgggcaacagtgaaaattttcttttagaggtggaaaaaagctctagggagaagacaatgaaaaactgtgtaacaggtgagagctctgcatcaaaagtcagtgctaatgttgacagcaggattgaaatggactcaaacaaaggactttttattcccttccccaaccgggaaataaaggattccctaagtacttctgcaactcagggcaatggtacacgtgatcagaaattagacaccttcccactggggacacagacacaggaagtagcaagaagggagatgccaagtgacaatcaccaggaagatgagttcagacactactcgcctcgtcagtccacagtccgatccccagagaagatgactagagaagggtaccaagtatcttttttggacaataagtcttcaggttcttctccagaaaaggaattgataccaaaacctgatacttttcatcttacccatgatgcctcattgagtaaatgcctggatgtgggtgattctagccagatccatccctatcagttaccttcagatgttggtctggaaaattatgacagttgttattctcaaactctatccctgcatggaagtcttggtaaaaggcctcagagaagcaagaactatcaagagtatagcataaagccttcaaatgacataaagaccaccgcttcacattcctgtggagacttattaacttctctgtcaaaccctgactccagcactggaaggcttttgaagcttagttcagatctgtatgccacaacccatttcaacagtgaccctgctgtacttgtcaatgtagagcaacaattatctaccagcctggatgatttaacaccagcacatggttctgtcccaaacaacgctgtcctgggaaacaggacaactcctctgcggacactgctgttgtctcctgggacttcagaacacagaaagatttttaccaagaggtcactaagcccatcgaagagaggattcaaatggaaggacaatatccttgccaacctgaatctaaagcatggtttccaagatgctacaggcagcgaggaaagtttgaagcaaaaactggtcagagtgctggaggaaaacctcattttgtcagaaaaaattcaacagttggaggaaggtgctgccatctcaattgtgagtgggcaacagtcacatacttatgatgatcttctgcacaaaaaccaacagctgaccatgcaggtggcttgcctgaaccaggagcttgcccagctgaaaaagctggagaagacagttgccattctccatgaaagtcagagatccctggtggtaactaatgagtatctgctgcagcagctgaataaggagccaaaaggttattccgggaaagcgctcctgcctcctgagaagggtcatcatctggggagatcatcgccctttgggaaaagcacgttgtcttcctcctcaccagtggcacatgagactggtcagtatctaatacagagcgtcttggatgctgccccagagcctggcttatagagctagcatggaactcacaccacagcttccctggtccacagaggctctcaccgccattgccaccagtatggtggtatgtactcacaaagattaagaaagaaatgtattctg

SEQ ID NO: 4619 - DNA, 1387 bp, Homo sapiens
ctgtctctaacacaccaagatgagactggtcctaatttttcctctgcgaatatggttttctgattaactactagttatgtctatgccaaaaaaagaaacatgctcagaccacggtttttgcctccagatgaccgaactgtacgtgaaggtgagagaaaagctgccaagctgcattttagtcagttgggcaacagtgaaaattttcttttagaggtggaaaaaagctctagggagaagacaatgaaaaactgtgtaacaggtgagagctctgcatcaaaagtcagtgctaatgttgacagcaggattgaaatggactcaaacaaaggactttttattcccttccccaaccgggaaataaaggattccctaagtacttctgcaactcagggcaatggtacacgtgatcagaaattagacaccttcccactggggacacagatctgtatgccacaacccatttcaacagtgaccctgctgtacttgtcaatgtagagcaacaattatctaccagcctggatgatttaacaccagcacatggttctgtcccaaacaacgctgtcctgggaaacaggacaactcctctgcggacactgctgttgtctcctgggacttcagaacacagaaagatttttaccaagaggtcactaagcccatcgaagagaggattcaaatggaaggacaatatccttgccaacctgaatctaaagcatggtttccaagatgctacaggcagcgagtgacctgggtagtttgcacggtttggctggaaaccacagtccccccatctctgccagaaccccccatgtggccactgtcctcagacagctcctggagcttgtggataagcactggaatggctccggctccctcctcctcaacaagaagtttctcggaaagtttgaagcaaaaactggtcagagtgctggaggaaaacctcattttgtcagaaaaaattcaacagttggaggaaggtgctgccatctcaattgtgagtgggcaacagtcacatacttatgatgatcttctgcacaaaaaccaacagctgaccatgcaggtggcttgcctgaaccaggagcttgcccagctgaaaaagctggagaagacagttgccattctccatgaaagtcagagatccctggtggtaactaatgagtatctgctgcagcagctgaataaggagccaaaaggttattccgggaaagcgctcctgcctcctgagaagggtcatcatctggggagatcatcgccctttgggaaaagcacgttgtcttcctcctcaccagtggcacatgagactggtcagtatctaatacagagcgtcttggatgctgccccagagcctggcttatagagctagcatggaactcacaccacagcttccctggtc

SEQ ID NO: 4620 - DNA, 2104 bp, Homo sapiens
aacacaccaagatgagactggtcctaatttttcctctgcgaatatggttttctgattaactactagttatgtctatgccaaaaaaagaaacatgctcagaccacggtttttgcctccagatgaccgaactgtacgtgaaggtgagagaaaagctgccaagctgcattttagtcagttgggcaacagtgaaaattttcttttagaggtggaaaaaagctctagggagaagacaatgaaaaactgtgtaacaggtgagagctctgcatcaaaagtcagtgctaatgttgacagcaggattgaaatggactcaaacaaaggactttttattcccttccccaaccgggaaataaaggattccctaagtacttctgcaactcagggcaatggtacacgtgatcagaaattagacaccttcccactggggacacagacacaggaagtagcaagaagggagatgccaagtgacaatcaccaggaagatgagttcagacactactcgcctcgtcagtccacagtccgatccccagagaagatgactagagaagggtaccaagtatcttttttggacaataagtcttcaggttcttctccagaaaaggaattgataccaaaacctgatacttttcatcttacccatgatgcctcattgagtaaatgcctggatgtgggtgattctagccagatccatccctatcagttaccttcagatgttggtctggaaaattatgacagttgttattctcaaactctatccctgcatggaagtcttggtaaaaggcctcagagaagcaagaactatcaagagtatagcataaagccttcaaatgacataaagaccaccgcttcacattcctgtggagacttattaacttctctgtcaaaccctgactccagcactggaaggcttttgaagcttagttcagatctgtatgccacaacccatttcaacagtgaccctgctgtacttgtcaatgtagagcaacaattatctaccagcctggatgatttaacaccagcacatggttctgtcccaaacaacgctgtcctgggaaacaggacaactcctctgcggacactgctgttgtctcctgggacttcagaacacagaaagatttttaccaagaggtcactaagcccatcgaagagaggattcaaatggaaggacaatatccttgccaacctgaatctaaagcatggtttccaagatgctacaggcagcgagcctctctctagtgacctgggtagtttgcacggtttggctggaaaccacagtccccccatctctgccagaaccccccatgtggccactgtcctcagacagctcctggagcttgtggataagcactggaatggctccggctccctcctcctcaacaagaagtttctcggtcctgcccgagatttgcttctgtctttggtagtcccggctccttctcagccgaggtgttgctcacatcctgaagacacgatgaaagcattctgcaggagggagcttgaactgaaggaggctgcgcagctggtccctaatgacatggaaagtttgaagcaaaaactggtcagagtgctggaggaaaacctcattttgtcagaaaaaattcaacagttggaggaaggtgctgccatctcaattgtgagtgggcaacagtcacatacttatgatgatcttctgcacaaaaaccaacagctgaccatgcaggtggcttgcctgaaccaggagcttgcccagctgaaaaagctggagaagacagttgccattctccatgaaagtcagagatccctggtggtaactaatgagtatctgctgcagcagctgaataaggagccaaaaggttattccgggaaagcgctcctgcctcctgagaagggtcatcatctggggagatcatcgccctttgggaaaagcacgttgtcttcctcctcaccagtggcacatgagactggtcagtatctaatacagagcgtcttggatgctgccccagagcctggcttatagagctagcatggaactcacaccacagcttccctggtccacagaggctctcaccgccattgccaccagtatggtggtatgtactcacaaagattaagaaagaaatgtattctg

SEQ ID NO: 4621 - DNA, 5669 bp, Homo sapiens
gctgaagtgcaatgttgtgatctcggctcactgcaacctctgcctcccaggttcaagcgattctcctgctttggcctcctgagtagctgggattgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggggcattttcagatttctgccatggaggggatgctcttcgcgaagggagagtcaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaatgaa

SEQ ID NO: 4622 - DNA, 5177 bp, Homo sapiens
agaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggggcattttcagatttctgccatggaggggatgctcttcgcgaagggagagtcaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaatgaa

SEQ ID NO: 4623 - DNA, 1396 bp, Homo sapiens
atcatttggagccacactgaaaaaaaaatttccccctgcaatctactcttaactgatagtcgctaactttggttatgtgtgaacagtctgaaacattgctttttttctctggtacatttaggtcctttctgaaatggtatctatgattcagctattcaaaacctaatgaagttggtgactatgacaatgtggagaaatcatgacagaaaatgtggtttgtactggggctgtcaatgctgtaaaggaagtttgggaaaaaagaataaagaaactcaatgaagacctgaagcgagagaaggaatttcaacacaagctagtgcggatctgggaagaacgagtaagcttaaccaagctaagagaaaaggtcaccagggaagatggaagagtcattttgaagatagaaaaagaggaatggaagaccctcccttcttctctgctgaaactgaatcaactacaggaatggcaacttcatagaactggtttgctgaaaattcctgaattcattggaagattccagaacctcattgtgttagatttatctcgaaacacaatttcagagataccaccagggattggactgcttactagacttcaggaactgattctcagctacaacaaaatcaagactgtccccaaggaactaagtaattgtgccagcttggagaaactagaactggctgttaacagagatatatgtgatcttccacaagagctcagcaatctgctaaaacttactcaccttgatctgagtatgaacgattttactacaatccctcttgctgtgttgaacatgcctgcccttgagtggctggacatgggaagcaacaaacttgaacaacttcctgatactatagaaagaatgcaaaatctacatacgttatggctgcaacgaaatgaaataacatgcttgcctcaaacaatcagcaatatgaaaaatctgggtactcttgttctcagcaacaataaactgcaagatattccagtatgcatggaagaaatggcaaatctgaggtttgtcaacttcagagacaacccactgaaattgaaagtatcacttcctcccagtgaaggcacagatgaagaagaggaacgggaattatttggccttcagtttatgcacacatacatacaagagtcacggagaagagcagatcaccaagtcaacggttcaactactttaccaatctccataaatacggatggataatataattcaagatgcccttctaaagaggattactttggtgaattctctaatgtttggatttctgaagtaaaaagaaaagctattaccaaagtttaatgaggccacagcattttttaaagttcatattatttgctatttaaagtatatatttttttgatataaaaatataattaaaaaattttttttggt

SEQ ID NO: 4624 - DNA, 1219 bp, Homo sapiens
atcatttggagccacactgaaaaaaaaatttccccctgcaatctactcttaactgatagtcgctaactttggttatgtgtgaacagtctgaaacattgctttttttctctggtacatttaggtcctttctgaaatggtatctatgattcagctattcaaaacctaatgaagttggtgactatgacaatgtggagaaatcatgacagaaaatgtggtttgtactggggctgtcaatgctgtaaaggaagtttgggaaaaaagaataaagaaactcaatgaagacctgaagcgagagaaggaatttcaacacaagctagtgcggatctgggaagaacgagtaagcttaaccaagctaagagaaaaggtcaccagggaagatggaagagtcattttgaagatagaaaaagaggaatggaagaccctcccttcttctctgctgaaactgaatcaactacaggaatggcaacttcatagaactggtttgctgaaaattcctgaattcattggaagattccagaacctcattgtgttagatttatctcgaaacacaatttcagagataccaccagggattggactgcttactagacttcaggaactgattctcagctacaacaaaatcaagactgtccccaaggaactaagtaattgtgccagcttggagaaactagaactggctgttaacagagatatatgtgatcttccacaagagctcagcaatctgctaaaacttactcaccttgatctgagtatgaacgattttactacaatccctcttgctgtgttgaacatgcctgcccttgagtggctggacatgggaagcaacaaacttgaacaacttcctgatactatagaaagaatgcaaaatctacatacgttatggctgcaacgaaatgaaataacatgcttgcctcaaacaatcagcaatatgaaaaatctgggtactcttgttctcagcaacaataaactgcaagatattccagtatgcatggaagaaatggcaaatctgaggtttgtcaacttcagagacaacccactgaaattgaaagtatcacttcctcccagtgaaggcacagatgaagaagaggaacgggaattatttggccttcagtttatgcacacatacatacaagagtcacggagaagagcagctcttcagttttgtgtttgtcatggacagattctgacaatatatacatgtatggctctggaaatttga

SEQ ID NO: 4625 - DNA, 1396 bp, Homo sapiens
atcatttggagccacactgaaaaaaaaatttccccctgcaatctactcttaactgatagtcgctaactttggttatgtgtgtctattcagaatattacattaattgatttctcaaacaaaggtcctttctgaaatggtatctatgattcagctattcaaaacctaatgaagttggtgactatgacaatgtggagaaatcatgacagaaaatgtggtttgtactggggctgtcaatgctgtaaaggaagtttgggaaaaaagaataaagaaactcaatgaagacctgaagcgagagaaggaatttcaacacaagctagtgcggatctgggaagaacgagtaagcttaaccaagctaagagaaaaggtcaccagggaagatggaagagtcattttgaagatagaaaaagaggaatggaagaccctcccttcttctctgctgaaactgaatcaactacaggaatggcaacttcatagaactggtttgctgaaaattcctgaattcattggaagattccagaacctcattgtgttagatttatctcgaaacacaatttcagagataccaccagggattggactgcttactagacttcaggaactgattctcagctacaacaaaatcaagactgtccccaaggaactaagtaattgtgccagcttggagaaactagaactggctgttaacagagatatatgtgatcttccacaagagctcagcaatctgctaaaacttactcaccttgatctgagtatgaacgattttactacaatccctcttgctgtgttgaacatgcctgcccttgagtggctggacatgggaagcaacaaacttgaacaacttcctgatactatagaaagaatgcaaaatctacatacgttatggctgcaacgaaatgaaataacatgcttgcctcaaacaatcagcaatatgaaaaatctgggtactcttgttctcagcaacaataaactgcaagatattccagtatgcatggaagaaatggcaaatctgaggtttgtcaacttcagagacaacccactgaaattgaaagtatcacttcctcccagtgaaggcacagatgaagaagaggaacgggaattatttggccttcagtttatgcacacatacatacaagagtcacggagaagagcagatcaccaagtcaacggttcaactactttaccaatctccataaatacggatggataatataattcaagatgcccttctaaagaggattactttggtgaattctctaatgtttggatttctgaagtaaaaagaaaagctattaccaaagtttaatgaggccacagcattttttaaagttcatattatttgctatttaaagtatatatttttttgatataaaaatataattaaaaaattttttttggt

SEQ ID NO: 4626 - DNA, 1466 bp, Homo sapiens
atcatttggagccacactgaaaaaaaaatttccccctgcaatctactcttaactgatagtcgctaactttggttatgtgtgtctattcagaatattacattaattgatttctcaaacaaaggtcctttctgaaatggtatctatgattcagctattcaaaacctaatgaagttggtgactatgacaatgtggagaaatcatgacagaaaatgtggtttgtactggggctgtcaatgctgtaaaggaagtttgggaaaaaagaataaagaaactcaatgaagacctgaagcgagagaaggaatttcaacacaagctagtgcggatctgggaagaacgagtaagcttaaccaagctaagagaaaaggtcaccagggaagatggaagagtcattttgaagatagaaaaagaggaatggaagaccctcccttcttctctgctgaaactgaatcaactacaggaatggcaacttcatagaactggtttgctgaaaattcctgaattcattggaagattccagaacctcattgtgttagatttatctcgaaacacaatttcagagataccaccagggattggactgcttactagacttcaggaactgattctcagctacaacaaaatcaagactgtccccaaggaactaagtaattgtgccagcttggagaaactagaactggctgttaacagagatatatgtgatcttccacaagagctcagcaatctgctaaaacttactcaccttgatctgagtatgaacgattttactacaatccctcttgctgtgttgaacatgcctgcccttgagtggctggacatgggaagcaacaaacttgaacaacttcctgatactatagaaagaatgcaaaatctacatacgttatggctgcaacgaaatgaaataacatgcttgcctcaaacaatcagcaatatgaaaaatctgggtactcttgttctcagcaacaataaactgcaagatattccagtatgcatggaagaaatggcaaatctgaggtttgtcaacttcagagacaacccactgaaattgaaagtatcacttcctcccagtgaaggcacagatgaagaagaggaacgggaattatttggccttcagtttatgcacacatacatacaagagtcacggagaagagcagctcttcagttttgtgtttgtcatggacagattctgacaatatatacatgtatggctctggaaatttgaagatcaccaagtcaacggttcaactactttaccaatctccataaatacggatggataatataattcaagatgcccttctaaagaggattactttggtgaattctctaatgtttggatttctgaagtaaaaagaaaagctattaccaaagtttaatgaggccacagcattttttaaagttcatattatttgctatttaaagtatatatttttttgatataaaaatataattaaaaaattttttttggt

SEQ ID NO: 4627 - DNA, 2884 bp, Homo sapiens
gaaaggagcggggcatcccaacggcgccacctttaagcgtcacgggtggggctgcagcttctggacctaggactttgaacatgtcgcgcctgaagcggatagcggggcaggatctccgcgctggtttcaaagcaggtggaagagactgcggtacctcggtaccccaagggctgttgaaggcagcgaggaagagcggccagttaaacctgtcgggtagaaacctcagtgaagtgccgcagtgtgtctggagaataaatgtggatatccctgaggaagctaatcagaatctttcgtttggtgctactgaaagatggtgggagcagacagatttgaccaaactaataatatcaaacaataaacttcagtcacttacagatgacctgcgactcttgcctgcactgactgttcttgatatacatgataatcagttgacatcccttccttctgctataagagagctagaaaatcttcagaaacttaatgtcagccataataaactgaaaatactccctgaagaaattacaaacctaagaaacctgaagtgcctgtatctccagcataatgaattaacctgcatatcagagggatttgaacaactttccaatttagaagatttagatctttcaaacaatcatcttacaactgttcctgctagtttttcttctctgtccagtctggtgcgactcaatctttctagtaatgaactgaagagtttgccagcagaaataaatagaatgaaaaggttgaagcatttggattgtaattcaaatctcttggaaactatacctcctgaattggctggcatggaatcactagaattgctttatttgcggaggaataaattacgttttctaccagaatttccttcttgtagtctattgaaggaattgcacgtaggtgaaaaccagattgaaatgttagaggcagaacatcttaaacatctgaattcaattcttgtgctagacctgagggataacaagttaaaatctgttccagatgaaattatactactacggtccttggaaaggcttgacctaagcaacaatgatattagtagtcttccctattcattggggaaccttcatttgaaatttttggcattagaaggaaatcctttgagaacaattcgaagagaaattataagtaaaggaacacaagaagtcctaaaatatctacgaagcaagatcaaagatgatggacctagccaaagtgagtctgctactgagactgccatgacactaccaagtgaatccagagtcaatatacatgccatcattacattaaaaatattagactatagtgataaacaagcaactttgattcctgatgaggtgtttgatgcagtaaaaagcaacatcgtcacttctattaacttcagtaagaatcaactatgtgaaattccaaaaaggatggtagaactgaaggaaatggtttctgatgtcgatctcagttttaataaactttcctttatatccttggagttatgtgtgcttcagaaattgacttttttagatctcaggaacaattttttaaattctttgccagaagaaatggaatcactggtaagactgcaaacgatcaatctttcctttaataggtttaaaatgctacctgaagttctatatcgtatcttcacacttgaaacaattctgattagtaataatcaggttggatctgtggaccctcagaaaatgaagatgatggaaaatctgaccacgttggaccttcaaaataatgacctcttacaaattccaccagagctcggtaattgtgtaaacttaagaacattactactggatggaaatccattccgagttcctcgagcagccatattaatgaaaggaacagctgctatacttgaatatttgagagaccgaattcctacttaacatggagttgctttataacccttgtcatgtattattaaccctggttaattctaaggaggatgtaacatttgttttagtatcatcttaaaaggtgattattgtaattgatcttgtagtttcccagtatcacctacctgttggtataattagcctgggccatattcactgccagtaaatatttttacatttttatttaagatttttgtaaggtgttgtatacatttgtaatggtgataaccacaatgtgttcatacatttgttctaaatgttttgcttatgatttatcctgctaactttcattttcttatagcaagcagttttttcaaaaatgaatttttatttaatgtggttcagtattataataacaaagcatttttgtagaactggttttttttctcatttatttttgtattccatacaatgtgaccaattgacttgaatatgactagccagtttctatgtttttgttagatataaaattaaatcgaattttgttgaatactgttctttggcatttaaaaaataagaccttcttatcttgggccacatgtcaaaagaaaaaggaaacaaaaatatattaaaaataagacttttcattacccatgataggacttttgtgatatggctaatctcagtacacatttcaacttaaaacctttttatttacagcaccataattttaaaatttacttgcaatcttggtaagactaaacttgcagtgtttttctaaaagggaatttgataggtaaacttgatttaataaaaattaaatatcatttttgtttacaccaaaattatcagaagtaggttgattagtcattataacacttaccatatgattctattaagaagtcaattcagtagcatgtatatcaatttatatagataggtagatagcttttggatgattgaggcatgcttatattatgaaaaaaattgctaataaagataaatactacatgttcagaataaaagttacatttttcaaatattga

SEQ ID NO: 4628 - DNA, 2063 bp, Homo sapiens
gtagcggcggcaacgaccatggaggccacgtcccgggaggcggcgccagcgaagagctcggcctcgggccccaacgctccccccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcacccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggtgagcaccctggagtggcagggattgggcttagattgcctagcagcaccagctgtgtgcctaattctagggaggtgggaggggcaaattgggggtatgatcaggaggttagagaggaaggcttgtatgcctcatagcaggggagactgtcattgctagaagagaggaacataaagtctatacacttgattagttgttgaaagcaggggttcctgaggggcagtgagacaagccagctggaatctgaagaatgaatacattttagatatggaaggcagtccaagggcaggtgggagcagtatagtatatgcatgctcaggcagggctagagtttgacctcaccacctcaccagtcatattttaagtattcttgataatttgatctaacaatcctcacaaccctatgagggcaagtgacttcctcaggataacctagcaattatagagctaggattcaaaacccaggcaaccagactgcagattcatgctttcaaacaactatgctactctcctttccaccgtctctctcctatcagcattttaacaggtctccatcaaaaactgccaccaccacctccctctatgccatattaataaactgttatctcctgttcttc

SEQ ID NO: 4629 - DNA, 3190 bp, Homo sapiens
atgtactaccagccgcaggcagaggttaggggtagctgatgtttgcacccgaggaggctttgctaagaaacatccccttagtcataccacacccaagtataattgatctaggagtttatctaaaatagtagctcctaagagacttggaaagtgtgctaatttcttcgaaatttctttagaataattcacattcttccccatatcgcttatggagccgtcctaactgctgaccttttcaagatggcggtccgcgggcgacactctcgggctcgcgcacctccccaagatggcggcgcccgaggcctggcgcgcccggagttgctggttctgtgaggtagcggcggcaacgaccatggaggccacgtcccgggaggcggcgccagcgaagagctcggcctcgggccccaacgctccccccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcagttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatgggactcatcccaggccttcgcagattatgttagcaccatgtgatggggcccgtacctcacagtctcatgctcggtaccatcagcttgcaggggctgaagcatgggctgcccagaaccccaaccaccagttctatctttctctttctgtcaccttttttctcttttttccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcctgccttccctcctcaagcaggcacccaggctttagagaagtatagggggcttcttccctgctgggcttaccacactgctctcaggcctcaaaccctttcatacctttattcttttttttaaccaaaaaagtttttcttataaaataaattttgggcaaacatca

SEQ ID NO: 4630 - DNA, 2412 bp, Homo sapiens
aggtagcggcggcaacgaccatggaggccacgtcccgggaggcggcgccagcgaagagctcggcctcgggccccaacgctccccccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgccatagttggggaatgctggcctgctggccttggcagatgttttctcagaggattcatcctcctctctctgtcagctggacatcagttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatgggactcatcccaggccttcgcagattatgttagcaccatgtgatggggcccgtacctcacagtctcatgctcggtaccatcagcttgcaggggctgaagcatgggctgcccagaaccccaaccaccagttctatctttctctttctgtcaccttttttctcttttttccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcctgccttccctcctcaagcaggcacccaggctttagagaagtatagggggcttcttccctgctgggcttaccacactgctctcaggcctcaaaccctttcatacctttattcttttttttaaccaaaaaagtttttcttataaaataaattttgggcaaacatc

SEQ ID NO: 4631 - DNA, 1727 bp, Homo sapiens
cttgctcccgcccccgccggtcccgcggtcccacggcgcctggttgcccccagccccctccctcctcccaccttcactgtgtcccacccttcctagctttgtgcccggggtgctgagcccttccccgtcagccgggccgcgggaggagggagccgtcaccgaggagctgccgctcgctgccccgggcaggggcacagttgcaaccaaggcaatgtcttactacctcagctcagaaaaccacctggacccagggcccatctacatgcgagaaaatgggcagctgcacatggtcaatctggctctggatggtgtcaggagtagcctgcagaagccaaggcctttcagactgttccccaaaggcttttctgtggagctttgcatgaacagggaagacgacactgcacggaaagagaagactgatcatttcatcttcacatacacccgagaggggaatcttcggtactccgccaaatccctcttcagccttgtcctgggtttcatctccgacaatgtggatcacattgattcccttattggctttcctgagcagattgctgaaaagctgttctctgctgctgaagccagacagaaattcactgagccaggtgcagggctgagggctttacagaaattcactgaggcctatggaagtttggtgctttgctccctgtgtttgcgaaacaggtatctcgtgatttcagaaaagcttgaggagattaagtctttccgggagctgacctgcctggatctttcctgttgcaagcttggagatgagcatgaacttctagaacatctcaccaatgaagccctgtctagtgtaactcagctccacctgaaggataattgtttatctgatgctggggtgcggaagatgacagcaccagttcgagtgatgaaaagaggccttgagaatctaacattattagacttatcatgtaaccctgagatcacagatgcaggcattggatacctcttttcttttaggaaactaaactgcttagatatctctgggacagggctcaaggacatcaaaaccgtcaagcacaagctccagacccacataggccttgttcactccaaagtgcctttgaaggaatttgatcatagtaactgcaagacagagggctgggctgaccagatcgttctgcagtgggagcgtgtgactgcggaagctgtgaagccacgggagacctcggagcctagagcagcagctcagcgcttctatgggaagcggtctcgagcagaagccccactgaagtgtcccctggcagacacccacatgaactcttccgagaaactccagttctataaagagaaagccccagattgccatgggccagtgttgaaacacgaagctatctcaagccaggagtcaaagaagagcaagaagagaccttttgaggagtcagagacagaacagaataactcttcacaaccttcaaagcagaaatatgtatgtcttgctgtggaagactgggacttgttaaattcctattgattagtagatacaagttgacctttctctggcccccagctctagtgtttgagtaaaggagactgaggatgatttactttttgtttgaatttacctatggcattagcatagtaagcagatatttctacttttgtggtgtgggaggggaatgctatggaagtatgtaataatttctaatgtatattttcaatacatagtaattttttcaaataaacatttttgctgtccttaa

SEQ ID NO: 4632 - DNA, 838 bp, Homo sapiens
gcgggccaagatgcgaaaccactcctctttgtgcccggggtgctgagcccttccccgtcagccgggccgcgggaggagggagccgtcaccgaggagctgccgctcgctgccccgggcaggggcacaggttgatgtcatatttttagtcttgagaaacagcatcatgccaaggaaagagcttgagctttggagtaatgcggccctgagattgaattctggctctgccacttattagctctgttctagattgcaaccaaggcaatgtcttactacctcagctcagaaaaccacctggacccagggcccatctacatgcgagaaaatgggcagctgcacatggtcaatctggctctggatggtgtcaggagtagcctgcagaagccaaggcctttcagactgttccccaaaggcttttctgtggagctttgcatgaacagggaagacgacactgcacggaaagagaagactgatcatttcatcttcacatacacccgagaggggaatcttcggtactccgccaaatccctcttcagccttgtcctgggtttcatctccgacaatgtggatcacattgattcccttattggctttcctgagcagattgctgaaaagctgttctctgctgctgaagccagacagaaattcactgagccaggtgcagggctgagggctttacagaaattcactgaggcctatggaagtttggtgctttgctccctgtgtttgcgaaacaggtatctcgtgatttcagaaaagcttgaggagattaagtctttccgggagctgacctgcctggatctttcctgttgcaagcttggagatgagcatgaacttctag

SEQ ID NO: 4633 - DNA, 2037 bp, Homo sapiens
attacttcgcgggccaagatgcgaaaccactcctgtgcgcctttccccaggccagtcccggggcgcgcgctgcctaccctcccccagctcagctctatccccggggcccgcaggacccaggggacccaccctcccgcgagcacgcacgcgcagggcccacctctgcgagttccaaaccctcggccctcgggtcgcctgccctgggcctggccccgcctccaggtccggccccgccttcgtgccggggcccgcgcacgcgcgcctccccggcccagccttgctcccgcccccgccggtcccgcggtcccacggcgcctggttgcccccagccccctccctcctcccaccttcactgtgtcccacccttcctagctttgtgcccggggtgctgagcccttccccgtcagccgggccgcgggaggagggagccgtcaccgaggagctgccgctcgctgccccgggcaggggcacaggcttcatccagtgaatactagagggatcgaacagttgcaaccaaggcaatgtcttactacctcagctcagaaaaccacctggacccagggcccatctacatgcgagaaaatgggcagctgcacatggtcaatctggctctggatggtgtcaggagtagcctgcagaagccaaggcctttcagactgttccccaaaggcttttctgtggagctttgcatgaacagggaagacgacactgcacggaaagagaagactgatcatttcatcttcacatacacccgagaggggaatcttcggtactccgccaaatccctcttcagccttgtcctgggtttcatctccgacaatgtggatcacattgattcccttattggctttcctgagcagattgctgaaaagctgttctctgctgctgaagccagacagaaattcactgagccaggtgcagggctgagggctttacagaaattcactgaggcctatggaagtttggtgctttgctccctgtgtttgcgaaacaggtatctcgtgatttcagaaaagcttgaggagattaagtctttccgggagctgacctgcctggatctttcctgttgcaagcttggagatgagcatgaacttctagaacatctcaccaatgaagccctgtctagtgtaactcagctccacctgaaggataattgtttatctgatgctggggtgcggaagatgacagcaccagttcgagtgatgaaaagaggccttgagaatctaacattattagacttatcatgtaaccctgagatcacagatgcaggcattggatacctcttttcttttaggaaactaaactgcttagatatctctgggacagggctcaaggacatcaaaaccgtcaagcacaagctccagacccacataggccttgttcactccaaagtgcctttgaaggaatttgatcatagtaactgcaagacagagggctgggctgaccagatcgttctgcagtgggagcgtgtgactgcggaagctgtgaagccacgggagacctcggagcctagagcagcagctcagcgcttctatgggaagcggtctcgagcagaagccccactgaagtgtcccctggcagacacccacatgaactcttccgagaaactccagttctataaagagaaagccccagattgccatgggccagtgttgaaacacgaagctatctcaagccaggagtcaaagaagagcaagaagagaccttttgaggagtcagagacagaacagaataactcttcacaaccttcaaagcagaaatatgtatgtcttgctgtggaagactgggacttgttaaattcctattgattagtagatacaagttgacctttctctggcccccagctctagtgtttgagtaaaggagactgaggatgatttactttttgtttgaatttacctatggcattagcatagtaagcagatatttctacttttgtggtgtgggaggggaatgctatggaagtatgtaataatttctaatgtatattttcaatacatagtaattttttcaaataaacatttttgctgtccttaa

SEQ ID NO: 4634 - DNA, 1044 bp, Homo sapiens
tcccgcccccgccggtcccgcggtcccacggcgcctggttgcccccagccccctccctcctcccaccttcactgtgtcccacccttcctagctttgtgcccggggtgctgagcccttccccgtcagccgggccgcgggaggagggagccgtcaccgaggagctgccgctcgctgccccgggcaggggcacaggttgatgtcatatttttagtcttgagaaacagcatcatgccaaggaaagagcttgagctttggagtaatgcggccctgagattgaattctggctctgccacttattagctctgttctagattgcaaccaaggcaatgtcttactacctcagctcagaaaaccacctggacccagggcccatctacatgcgagaaaatgggcagctgcacatggtcaatctggctctggatggtgtcaggagtagcctgcagaagccaaggcctttcagactgttccccaaaggcttttctgtggagctttgcatgaacagggaagacgacactgcacggaaagagaagactgatcatttcatcttcacatacacccgagaggggaatcttcggtactccgccaaatccctcttcagccttgtcctgggtttcatctccgacaatgtggatcacattgattcccttattggctttcctgagcagattgctgaaaagctgttctctgctgctgaagccagacagaaattcactgagccaggtgcagggctgagggctttacagaaattcactgaggcctatggaagtttggtgctttgctccctgtgtttgcgaaacaggtatctcgtgatttcagaaaagcttgaggagattaagtctttccgggagctgacctgcctggatctttcctgttgcaagcttggagatgagcatgaacttctagaacatctcaccaatgaagccctgtctagtgtaactcagctccacctgaaggataattgtttatctgatgctggggtgcggaagatgacagcaccagttcgagtgatgaaaagaggccttgagaatctaacattattagact

SEQ ID NO: 4635 - DNA, 2192 bp, Homo sapiens
gttgccgggcaacgcggcccgggccatggaggcgtcgtacgagtccgagtccgagtccgagtctgaggccgggcctgggactcagcggcccgggaccgggaccgtgagcgcggccgtgcgcgagcacttgcggaagctgtgtctgcgcgagttcccgtgcggtgccggcagctggaataagtcgcgctttcttcctcaaacttggcgaacttggagggagcttgtccccagagaggaggatgtggtgagccccggagaggagacggtggaggccctgctgggcctggtccgcagccgccactccccctgggctctgctgaacaactcgaatgcagaagacagtttcctgagagaattggccatccggaacccgctgacgatcacagacaccttcttctactcctacttccggtccctgcgggtaatagacaagaaggtcaccctggtggataaagacctcctgaaatttctaaagctggaggagttggtactgagcgccaatcgaatcaaggaggtggatgccaccaatctgccccccacactcaaggtgctggagctctacggcaatgagatcagcagcatggagtgtctgtgtgcccacccacccgccggcctgcagcacttggggttaggccacaacaaacttctaggccccttggaaagtctctacgtcaccgctaatcactggggaagagtgaggctgggattgggagatgctgtgctgacagcggccgcttgtgtttttcttctgttctcagagccgagatcaatttgctttctagtttgtggcagcaggctgcttgccccctgctcacctggcttcttgacccccagacggtcctgctcaccttccaggcccaacctcgtctccctggacctgggcttcaacgacctgacagacctgcagagcatggtcaccagcctgaggaccctccggcacctgcgactcctggtgctgcagggaaacccactggccttggtgccctactaccgcggcctcaccatcgacagcctggcccagctctgcgtgctggacgacatcaccgtgtctcccaatgagaagcatctcttccgggggctcagcctcaatggcgatctcttggcacaggaggcgcagtttgtggtgaccatcggaaacatcagaggagtcctggacacctctgtcttagacccggaacccaggcccgaaggccctttcatcacttacaactattacgtgacctatgattttgtgaaagatgaagaaggcgaaatgaatgagtccgcgggcgtcctggccgagatcgtcaagccctctcccagcttagaattattagttgaggaatctcctgaagaggtcgtggaagacgtcatcgaagacattgttgaagaggttactgaagaggtcgaagggtctctggagtctgaggtggaggagtcaggagagtcggagctgtctgtcatctcggggccttcgaccatcttgcagatgccgagggcctctgcagaagagctggccaagttgaggctgcgtatagatccccggctctgcccgtccccagggactgtcctcttcagcactgcccacaagccctgggctgaggtcatcccctgcagttacgagatgcagcactctctcagggacctggtcccactgaaggccttcctgctggcggggaccaccgtgaccatcgtggaggagaagattctctcctggcctgtggtgctacctgctgttgacagtcccctgtctgccaagaaaggaaagggggagaaagacaagaaagggaaggagaaagacaggacggggaaaggagagaaagagccggccaaggagtggaaggtgctgaagaagaagaaagagccgcccaaggagctccggcaggacccccccatcctccaggtgctgggccggggcctggtgatcctggagcccctgctcgccggggagcccctggtgtccaccgtgtgcaacttcggcgtggtccgcacattgacatctgacaggctgacgttggccagggattcaaagaagattaagaaagttgccaaaaaagaaaagccgaaagccgtgattccgatctacgaaggcgattaccaccctgagcccctgaccgtagaggtgcagatccagctgaaccagtgccgctcggcggaggaggctctgcgcatgttcgccgtgtagggcgtgggcagtaaaggctgttcccagc

SEQ ID NO: 4636 - DNA, 2028 bp, Homo sapiens
gcggttgccgggcaacgcggcccgggccatggaggcgtcgtacgagtccgagtccgagtccgagtctgaggccgggcctgggactcagcggcccgggaccgggaccgtgagcgcggccgtgcgcgagcacttgcggaagctgtgtctgcgcgagttcccgtgcggtgccggcagctggaataagtcgcgctttcttcctcaaacttggcgaacttggagggagcttgtccccagagaggaggatgtggtgagccccggagaggagacggtggaggccctgctgggcctggtccgcagccgccactccccctgggctctgctgaacaactcgaatgcagaagacagtttcctgagagaattggccatccggaacccgctgacgatcacagacaccttcttctactcctacttccggtccctgcgggtaatagacaagaaggtcaccctggtggataaagacctcctgaaatttctaaagctggaggagttggtactgagcgccaatcgaatcaaggaggtggatgccaccaatctgccccccacactcaaggtgctggagctctacggcaatgagatcagcagcatggagtgtctgtgtgcccacccacccgccggcctgcagcacttggggttaggccacaacaaacttctaggccccttggaaagtctctacgtcaccgctaatcactggcccaacctcgtctccctggacctgggcttcaacgacctgacagacctgcagagcatggtcaccagcctgaggaccctccggcacctgcgactcctggtgctgcagggaaacccactggccttggtgccctactaccgcggcctcaccatcgacagcctggcccagctctgcgtgctggacgacatcaccgtgtctcccaatgagaagcatctcttccgggggctcagcctcaatggcgatctcttggcacaggaggcgcagtttgtggtgaccatcggaaacatcagaggagtcctggacacctctgtcttagacccggaacccaggcccgaaggccctttcatcacttacaactattacgtgacctatgattttgtgaaagatgaagaaggcgaaatgaatgagtccgcgggcgtcctggccgagatcgtcaagccctctcccagcttagaattattagttgaggaatctcctgaagaggtcgtggaagacgtcatcgaagacattgttgaagaggttactgaagaggtcgaagggtctctggagtctgaggtggaggagtcaggagagtcggagctgtctgtcatctcggggccttcgaccatcttgcagatgccgagggcctctgcagaagagctggccaagttgaggctgcgtatagatccccggctctgcccgtccccagggactgtcctcttcagcactgcccacaagccctgggctgaggtcatcccctgcagttacgagatgcagcactctctcagggacctggtcccactgaaggccttcctgctggcggggaccaccgtgaccatcgtggaggagaagattctctcctggcctgtggtgctacctgctgttgacagtcccctgtctgccaagaaaggaaagggggagaaagacaagaaagggaaggagaaagacaggacggggaaaggagagaaagagccggccaaggagtggaaggtgctgaagaagaagaaagagccgcccaaggagctccggcaggacccccccatcctccaggtgctgggccggggcctggtgatcctggagcccctgctcgccggggagcccctggtgtccaccgtgtgcaacttcggcgtggtccgcacattgacatctgacaggctgacgttggccagggattcaaagaagattaagaaagttgccaaaaaagaaaagccgaaagccgtgattccgatctacgaaggcgattaccaccctgagcccctgaccgtagaggtgcagatccagctgaaccagtgccgctcggcggaggaggctctgcgcatgttcgccgtgtagggcgtgggcagtaaaggctgttcccagca

SEQ ID NO: 4637 - DNA, 2024 bp, Homo sapiens
gttgccgggcaacgcggcccgggccatggaggcgtcgtacgagtccgagtccgagtccgagtctgaggccgggcctgggactcagcggcccgggaccgggaccgtgagcgcggccgtgcgcgagcacttgcggaagctgtgtctgcgcgagttcccgtgcggtgccggcagctggaataagtcgcgctttcttcctcaaacttggcgaacttggagggagcttgtccccagagaggaggatgtggtgagccccggagaggagacggtggaggccctgctgggcctggtccgcagccgccactccccctgggctctgctgaacaactcgaatgcagaagacagtttcctgagagaattggccatccggaacccgctgacgatcacagacaccttcttctactcctacttccggtccctgcgggtaatagacaagaaggtcaccctggtggataaagacctcctgaaatttctaaagctggaggagttggtactgagcgccaatcgaatcaaggaggtggatgccaccaatctgccccccacactcaaggtgctggagctctacggcaatgagatcagcagcatggagtgtctgtgtgcccacccacccgccggcctgcagcacttggggttaggccacaacaaacttctaggccccttggaaagtctctacgtcaccgctaatcactggcccaacctcgtctccctggacctgggcttcaacgacctgacagacctgcagagcatggtcaccagcctgaggaccctccggcacctgcgactcctggtgctgcagggaaacccactggccttggtgccctactaccgcggcctcaccatcgacagcctggcccagctctgcgtgctggacgacatcaccgtgtctcccaatgagaagcatctcttccgggggctcagcctcaatggcgatctcttggcacaggaggcgcagtttgtggtgaccatcggaaacatcagaggagtcctggacacctctgtcttagacccggaacccaggcccgaaggccctttcatcacttacaactattacgtgacctatgattttgtgaaagatgaagaaggcgaaatgaatgagtccgcgggcgtcctggccgagatcgtcaagccctctcccagcttagaattattagttgaggaatctcctgaagaggtcgtggaagacgtcatcgaagacattgttgaagaggttactgaagaggtcgaagggtctctggagtctgaggtggaggagtcaggagagtcggagctgtctgtcatctcggggccttcgaccatcttgcagatgccgagggcctctgcagaagagctggccaagttgaggctgcgtatagatccccggctctgcccgtccccagggactgtcctcttcagcactgcccacaagccctgggctgaggtcatcccctgcagttacgagatgcagcactctctcagggacctggtcccactgaaggccttcctgctggcggggaccaccgtgaccatcgtggaggagaagattctctcctggcctgtggtgctacctgctgttgacagtcccctgtctgccaagaaaggaaagggggagaaagacaagaaagggaaggagaaagacaggacggggaaaggagagaaagagccggccaaggagtggaaggtgctgaagaagaagaaagagccgcccaaggagctccggcaggacccccccatcctccaggtgctgggccggggcctggtgatcctggagcccctgctcgccggggagcccctggtgtccaccgtgtgcaacttcggcgtggtccgcacattgacatctgacaggctgacgttggccagggattcaaagaagattaagaaagttgccaaaaaagaaaagccgaaagccgtgattccgatctacgaaggcgattaccaccctgagcccctgaccgtagaggtgcagatccagctgaaccagtgccgctcggcggaggaggctctgcgcatgttcgccgtgtagggcgtgggcagtaaaggctgttcccagc

SEQ ID NO: 4638 - DNA, 1920 bp, Homo sapiens
gcatgcgctaggccgggccaacggagcccgcctttacctccccactcggcgtccagtctcttagcaacgactccggcttcctaggaactgctcctttctcaaccattcctgcccacaacaccccagcttgctgccagcaaagcccctccacacccctcaaactccagacccttcacatcaatttactgttttcttcgacctcaccccagcaattttctctgaatcaaccccctttcctcctctcctaagtctctgagtttctctctcctcctgccatcctgagttctgccatccttaggggccgccaagacctctcttttcgttcctctcccgcctcagaccagcagccttttattttagatcatgtctggagggaagtcagcccagggtccagaggaagggggcgtctgcatcactgaagcccttatcactaagcggaacttgactttccctgaagatggggaactgtcagagaagatgtttcacactcttgatgaactgcagactgtccgcctggaccgggaggggattactactatcaggaacttagaaggcctccagaatcttcacagtctctatctgcaagggaataagatccagcaaattgagaacctggcttgcatcccctccttgcgcttcctgtctctggcaggaaaccaaatcaggcaggtggaaaacctcctcgacctcccatgcctccagtttctggacctttctgagaacctgatagaaacattgaagctggatgagttcccccagagccttctcatcctcaacctgtctggaaacagctgcaccaaccaggatggctaccgcgagctggtgacagaagccctgccacttctcctggacctggacgggcagcctgtggtggagcgctggatttcggatgaggaggatgaagcctcaagcgatgaggagttcccagagctgagtggcccattctgctcagaacgaggcttcctcaaggagctggagcaggagctgagcaggcacagggagcaccggcaacagacggccctgacagagcacctgctgaggatggagatgcagcccaccctcaccgacctgcccctgctacctggggtgcccatggctggggacagcagcccttctgccactcctgcgcaaggggaggagacagtccctgaggccgtctcctcaccccaggcctcctctcccaccaagaaaccatgcagtctgattcccaggggccaccaaagctctttctggggaaggaagggggcacgagcagccacagcccccaaggcctctgtggctgaggcccccagcacaaccaaaactacggccaagagaagcaagaaatgattctctgtcaacctttctctactagtggagaggagtggggcctgcccctcttctcagacctctgacctgtgacagaagcccatccccagtaaagtgtctctaggccctgagtatgcttttcatgtcacttggggtatctcaggggaagaaaccagtgaaagctccaggaaacaaaatacagagctcagtgagccacctgattctaaagagcgagtctggaatctttcgggagctacccacagggcaggcatgcctcaggcccccgctggcttcctggctcccacttgggcaggaagcgggcaccacctcatggaagaggcatgccatctcactgccacccctagcgagtgcccttccccggtccaagccaaggaccaaggagctgtggtcctagtcatccccaacagcagccagctcctgtcccctccctgtcctcctgcccagtccccatcactcacccactcataggaatgagtacacaaccacaggccccgcagccagcccacagctgcctttgggcctcacttggctctcccacccccactggtcctgggataaagttcactgaagagaaaataaagcacatttatt

SEQ ID NO: 4639 - DNA, 2648 bp, Homo sapiens
gtgggtgcctgccagcagctgaggcgccatggcggcggcagcggtgtcagagtcttggccggagctggagctggctgagcgcgagcggcggcgggagctgctgctgacggggcccgggctggaggagcgagtgcgggcggcgggtgggcagctgccgccgcggcttttcaccctgccgctgctgcactacttggaagtgagcggctgcgggagcttgcgcgcgccggggcctggcctggcgcagggcctgccgcagctgcacagcctcgtgctgcggcgcaacgcgctggggcccggcctgagccccgagctcgggccgctgcctgcccttcgggtgctcgacctgtcgggcaacgcgctggaggcgctgccgccgggccaaggcctgggccccgccgagccgccgggccttccgcagctgcagagcctcaacctcagcggcaaccggctgcgcgagctgccagccgacctggcgcgctgcgccccgcgcctgcagagcctcaacctcaccggcaattgcctagactcctttcccgccgagctctttcgccccggcgcgctgcccctgctcagtgaactggcggctgctgacaactgcctccgagaactcagccccgacatcgcccacctggcctcgctcaagacgttggacctctcgaacaaccagctgagcgagatccctgcagagcttgcggactgccccaagctcaaggagatcaatttccgtgggaacaagctgagggacaagcgcctggagaagatggtcagcggctgccagaccagatccatcctggagtacctgcgcgtcggaggccgtggtggcgggaagggcaagggccgtgccgagggctcggagaaggaagagagccggaggaagaggagggagaggaagcagaggcgggaaggtggtgatggggaggagcaggacgtgggagatgccggccggctgctgctcagggtcctgcacgtctctgaaaaccccgtacctctgacagtcagagtgagccccgaggtccgggatgtgcggccctacattgtgggggccgtggtgcgaggcatggacctgcagccagggaatgcactcaagcgcttcctcacctcgcagaccaagctccacgaagatctctgtgagaagaggacggctgccacccttgccacccacgagctccgtgccgtcaaagggcccctgctgtactgcgcccggcccccacaggacctcaagattgtccccttggggcggaaagaagccaaggccaaggagctggtgcggcagctgcagctggaggccgaggagcagaggaagcagaagaagcggcagagtgtgtcgggcctgcacagataccttcacttgctggatggaaatgaaaattacccgtgtcttgtggatgcagacggtgatgtgatttccttcccaccaataaccaacagtgagaagacaaaggttaagaaaacgacttctgatttgtttttggaagtaacaagtgccaccagtctgcagatttgcaaggatgtcatggatgccctcattctgaaaatggcagaaatgaaaaagtacactttagaaaataaagaggaaggatcactctcagatactgaagccgatgcagtctctggacaacttccagatcccacaacgaatcccagtgctggaaaggacgggccctcccttctggtggtggagcaggtccgggtggtggatctggaagggagcctgaaggtggtgtacccgtccaaggccgacctggccactgcccctccccacgtgactgtcgtgcgctgacgccagggccgcctgtccgcgtttgtttggccggttttgcggaggtttctatgcggcaatgctgaattatccgttagattttcaccccagtttttttgttggtttttttttttgagatggagtctcgctctgtcgccaggctggagtgcagtggcgtgatctcgagtcactgcagcctgtgtctcctgggttcaagcgattctcctgcctcagcctcccaagtagctgggactacaggtgtgtgccactaagctcagctaatttttgtatttttagtagagacggggtttcaccattttgaccaggatggtcttgatctcttgacctcatgatctgtccacctctgcccctcaaagtgctgggattacgtgatccacccgcctcagcctcccaaagtgctgggattacaggcgtgagctgtgcctggcccaccccagcattttttaagatgtatgtattcgttgttctgtttttccagatgattctgtcgtaaagtgatgctatgttgtcgttacaacatcaaagtgattttacggtttttgatgggattattcaagtgtcagaattaactgttcaaaatgttctgaatcatgtagatacatggcaggtaactgtttatgggagaaaagtacagtgctgttacgtggcactgtacagtcatgtgccacgtaacagcgtctgggtcagtgacggacacttacctgacagcggatccacaatattctcgtgcagtgtgtttggaatcctggtctgggctctcgtcgttggccttgtagatcaagtaggggaagtgagtgatgttcagtcatgctgctgggacacttggttttccagatgaaaacacataaataaaactacatgcaccatc

SEQ ID NO: 4640 - DNA, 1627 bp, Homo sapiens
gatgctggacagttaactcagtaggtctcagattcatcatccaccttttaatgtagagattcacaaactacaagctgtgagacctttgggtggatggctggtactctttgccatcatgttgcggttggtggcagcttgccctgagtcatgtgtggtgtgcaccaaagatgtaaccctctgtcaccagctaacctatatagtagcagcccctatgaccacgagggttttaatcatcaccgatggatatctctcctctattgagagcacaaacctgtctctcttgtttaatcttgccctgctctccctaagcagaaatggtatcgaggatgttcaggaagatgccctgcatgggcttacgatgttgcggaccttgttgctggagcacaaccaaatatccagctcttcgctcactgatcacaccttcagcaagcttcacagcctgcaggtactggtgctgagcaataatgctctccgcaccctacgagggtcttggttccgaaacacaagcggcctgacccggctccagctggatgggaatcagattactaatctcacagacagttctttcggaggcacgaatctccacagtctcaggtatctggatttatccaacaattttatttcctacattgggaaagatgccttccggcccctgcctcaactacaggaagtggacctttcccgaaataggttagcccacatgccggatgtgtttactccactgaagcagttaatccttctgagcttagataagaaccagtggagctgcacttgtgatctccatccccttgctcggtttttaagaaactacattaagtcttctgctcacacgctcaggaatgccaaggacctaaattgccagccatctaccgcagctgtggcagctgcacagagtgtgctgaggctgtctgagaccaactgtgattccaaagctcccaacttcactctggttctaaaggacagaagtcccctcctcccaggaccagatgtggccctgctgactgtccttggcttcgcaggagctgttggtctcacttgcctaggtttagttgtatttaactggaaactccaccaaggcaaagcaaatgaacacacatcagaaaacctttgttgcagaaccttcgatgaacccctgtgtgctcatgaggcaagaaattaccacactaagggatactgcaactgccacttaactcaggaaaacgagataaaggtcatgtccactgtggggtccagaaaagaaatgccacttttacaggaaaatagccatcaagcaacatcggcctctgagtctgcaacccttgacggatcatttagaaacctgaaaaagaaagaccgtggggtaggcagcactttattttgccaggatggtagattgctgcattcggaatgttcagagcctcctggaaatatgagagcttttaatgaagcaggcttacttacaacatataatccaaggaaagttcaaaagctatggaatcttgagcctggagaagtccagcctcaaactctgcaacaccatataataagaacagaagatatcagcagtgacatatttagaagaagatatgcaacacccgcttcagccttggcaggagaaagtcttgagaagcgtttaacaaatgaatca

SEQ ID NO: 4641 - DNA, 1530 bp, Homo sapiens
atgttgcggttggtggcagcttgccctgagtcatgtgtggtgtgcaccaaagatgtaaccctctgtcaccagctaacctatatagtagcagcccctatgaccacgagggttttaatcatcaccgatggatatctctcctctattgagagcacaaacctgtctctcttgtttaatcttgccctgctctccctaagcagaaatggtatcgaggatgttcaggaagatgccctgcatgggcttacgatgttgcggaccttgttgctggagcacaaccaaatatccagctcttcgctcactgatcacaccttcagcaagcttcacagcctgcaggtactggtgctgagcaataatgctctccgcaccctacgagggtcttggttccgaaacacaagcggcctgacccggctccagctggatgggaatcagattactaatctcacagacagttctttcggaggcacgaatctccacagtctcaggtatctggatttatccaacaattttatttcctacattgggaaagatgccttccggcccctgcctcaactacaggaagtggacctttcccgaaataggttagcccacatgccggatgtgtttactccactgaagcagttaatccttctgagcttagataagaaccagtggagctgcacttgtgatctccatccccttgctcggtttttaagaaactacattaagtcttctgctcacacgctcaggaatgccaaggacctaaattgccagccatctaccgcagctgtggcagctgcacagagtgtgctgaggctgtctgagaccaactgtgattccaaagctcccaacttcactctggttctaaaggacagaagtcccctcctcccaggaccagatgtggccctgctgactgtccttggcttcgcaggagctgttggtctcacttgcctaggtttagttgtatttaactggaaactccaccaaggcaaagcaaatgaacacacatcagaaaacctttgttgcagaaccttcgatgaacccctgtgtgctcatgaggcaagaaattaccacactaagggatactgcaactgccacttaactcaggaaaacgagataaaggtcatgtccactgtggggtccagaaaagaaatgccacttttacaggaaaatagccatcaagcaacatcggcctctgagtctgcaacccttgacggatcatttagaaacctgaaaaagaaagaccgtggggtaggcagcactttattttgccaggatggtagattgctgcattcggaatgttcagagcctcctggaaatatgagagcttttaatgaagcaggcttacttacaacatataatccaaggaaagttcaaaagctatggaatcttgagcctggagaagtccagcctcaaactctgcaacaccatataataagaacagaagatatcagcagtgacatatttagaagaagatatgcaacacccgcttcagccttggcaggagaaagtcttgagaagcgtttaacaaatgaatcatggcagcctccaatagaa

SEQ ID NO: 4642 - DNA, 2769 bp, Homo sapiens
ggagtaggagacagcgcctggaggtggagggcgcccagggccgagctgccagggccggacacctaggctgagccctcagccggccaactcgcctggcacaggggcagctctagacgggatggagaggatgcatcttcagtgtccacacgtggtcaacagataaaagccatggccagaacgttctaagtggctacatgtgcatctgcctgttcacggattccttcgacaaatatttgagcatcccctcctgcgactgtggacagcagaggagcacgcaggccacgtgcaggccacgtgcagcccacagctctggggcgaggcaggccctcaaccgaacacgtatagagacagggtttcaccgtgttagccaggatggtctcaatctcctgacctcgtgatctgcccgccgcggcctcccaaagtgctgggattacaggcgtgagccactgcgccccgccagacgtctgcatctttaaggggcaacaccaggtgacatgtgaatggatctgggctgggacagatcccgtgggcctcggcggagcacctccagcgtccgggtgcgggagctgagctggcaaggcctgcacaacccctgcccacagagcaagggccctggcagtcagagggacagacttggagagcagctggtggaagagtacctgtcccctgcccggctgcaggccctggcccgggtggatgaccttcggctggtgaggacgctggagatgtgtgtggacactcgtgagggcagcctggggaactttggggtgcacctgcccaacctggaccaactgaagctgaacggcagccacctgggctccctgagggacttgggcacgtctctgggccacctgcaggtgctgtggctggctcgctgtggcctcgctgacctggatggcatcgcctctttgccagcacttaaggaactctacgcctcctacaacaacatctcggacctgagcccactgtgcctgctggaacaattggaggtgctggacctggagggcaacagcgtggaggacctggggcaggtgcgctacttgcagctgtgcccacgcctggccatgctcaccctggagggcaacctggtgtgcctacagccggcccctggccccaccaacaaggtgcccaggggctacaactacagggcagaggtgaggaagctcattccccagctgcaggtcctggacgaagtgccggccgcacacacaggcccaccggcccccccgcggctgagccaggactggcttgcggtgaaggaggccatcaagaagggcaacggccttcccccgctggactgtccccgtggagcccccatccggagacttgaccccgagctgtccctgcctgagacgcagtcccgggcctccaggccctggcccttctccctgctggtccgtgggggccccctgcctgaaggcctgctttctgaggacctggccccagaagataacaccagcagcctcacccatggtgctggccaagtcctctgtgggaaccccaccaagggcctgcgggagcgtaggcaccagtgccaggccagggagccccccgagcagctgccccaacacaggccaggagatccggccgccagcacttccaccccagagcctgaccctgcagacagctctgacttcctggccttggctgggctcagggcctggagggaacatggcgtgcgccccctcccctataggcacccggagtcccaacaggaaggggctgtagccccctggggcccacggagggtccctgaagagcaagtgcaccaggcagagcccaagactccctccagccccccaagcctggcctcagagccctccgggacctcgagccagcacctggtcccttcacctcccaagcacccaaggccacgagattctggcagcagctccccgcggtggtcgacagacctgcagtccagggggcgtcggctccgagtcctgggcagctgggggcctggcctgggtgatggggtggctgcagtgcctgtcctgagagccctggaggtggcctcacgcctgagccctcgagcccagggatgtcctggcccaaagccagcaccagatgcagcagctagacctcccagggcagctgaactctctcaccccagccccgtccccacttaatatagcccccactgccaggcttccctgtgctggggccacgacttgcccacatatgtggtcacagagcacagaatacctgggcgggtgtgttggggggtggaaggagtgcctggccctggggaggaccctcttggtggaggggagtgggggactgggaccagccagggaggcagcagaggctggaacccagtttaggcccccaactgggtttggcctggggagggagggtccggctccccagcccttccttagggccaggctttcccgcgggcacgggggtggggggtggtcacccgagcaggcctgtgagaggcctctcctgctagaattgggcatggccgaggggcaggggctggagctgcgagtccaccactcccttgccggccccagggtaagagccacctcctaggccgcagtggcccaaggtcccagctgctcgcctgaggccgccgggggtgcggtccaggcctcccgtctccgggggatctgtagggttcccgcactgcgatagggcggcccgttccctcctcttggcgcaggacgccccggaacccaaaccaacatttccagctctcaggtgtacagaaatgcggtttactttgtaggccacgttggttcaataaatgatgcagcggacaca

SEQ ID NO: 4643 - DNA, 2649 bp, Homo sapiens
gatgacgtcacagggcgttcccgcccgggactaagccggggagcgcatcccggctactgcgggtcctgggtcttcacctgcggagccttacggcagctgagcggtgggaggcgagtccggggctccctgatcttccgtaggctcccagaggcgcctggcctccgcagagctgcaaaggcggcagggcttggtggtcgggctgtgtgttcttccgtttcttccttgtcgctcttgggtcgggccccaggagccagggatcggcgggagttgagagctggggcaggagccccagccgggaggccgaccgggtggactgggcggtgacagcagcgcttccttcccgcagggacctgagccgcggcgctaggatgggaaacagtgcgctccgcgctcatgtggaaacggcgcagaaaactggtgtctttcagcttaaggaccgagggctgaccgagttccccgcagacttgcagaagctgacgagcaatctcaggaccatcgacttgtccaacaacaagatcgaaagcctaccgcctttgctgataggaaagttcactctgctgaagagcctctccctgaacaacaacaaactgactgttctgcctgatgagatatgcaatctgaaaaaactagagacgctaagcctaaacaacaatcaccttagagagctgccgtctacctttgggcaactctctgccctcaagaccctgagcctctctgggaaccaactgggagcattacctccccaactttgtagcctacggcacctggatgtgatggatctctctaagaaccagattcgaagtatacctgactcagtgggagagctgcaagtcatcgaactcaacctcaaccagaatcagatatctcagatctcagtgaagatatcttgctgtccacgccttaaaattcttcgcctggaagagaattgtcttgagctcagcatgcttccccagagcatcctcagtgattcccagatctgtctgcttgctgtggaaggcaatctttttgaaataaagaaacttcgagaactggaaggctatgataagtacatggagaggttcacagccaccaagaagaagtttgcgtgaagttctccaggactatggaaaccttacaggatactgacttagaacctctgttggaatgtggctgagtcaaagcctcctgttgttgttaggggtatctacagtaaggagatgatacttcaggagattatatttcactcaatgatcttttctcatttcagggctcttctcaaataagctaaaagaaaaaggatcaggagacaggaaaagtcttccgttttgagtcatgagtagggcaatagacaaggttctcttcaaaaccatcattagtttggctttaagaaaccagtagctagctgctatttatatggtgagggggtgctgcctggtaacagaatagctccacaccacagcttgagattttgtttagtttcactgtgtgagctttcataaagtctgttgccattccatctctgtgttaacacttcatatttttatgaaattcagataatttgtgagaggctggcatggatctaaggatttattatttttattctagtccatcagttcagtcgcagtttttatactaggactttaggatgtacataaatgtgtgactgtttgtcttgattaaaagtgcactttggcctgggcatggtggctcatgcctataatcccagcactttgggaggccaaggcgggtggctcacttgaggctaggagttcaagactagcgtggccaacatgaggaaaccctgtctctactaaaaatacaaaaattagctgggtgtgttggtgcatgcttataatcccagctacttgggaggctgaggcaggagaatcgcttgaacccaggaggtggaggttgcagtgagccgagattatgccactgtactccagcgtgggtgacagagtgagactctgtctcaaattaaaaaaataaaaaataattttttttttttaaagtacgctttgttggctgggcacggcgactcacgcctgtaatcccagcacattgggaggccaaggcaggcagatcacgaggttaggagttcgagaccagcctggccaacatggtgaaaccctgtctctactgaaaatacaaaaattagctgggcgtggtggtgggtacctgtaatcccagctacttgggaggctgaggcaggagaattgcttgaacccaggaggcagaggttgcagtgagccgagatcatgccattgcactccgactctgggcaacagagcaagactctgtctcgggggaaacaaaaaaaaagtgtgctttgtcaagagaagcaccagcagacctctaagaactgctctctaaggctgcggtagcaaattatctactattgcaggtgccttattggtagagggctctgaagagccaaaactgtatatgcaacacttgtaagataaaagggactttaataatcaagattttcttgaagatttgttagaaataatgtcttatttctggtaacctttccctttttgtatttataactctactaaccaaattacctatcaataaaccattactataatattttaaaacaacctatgtttatcaagcttactctctgagtgacagaatatactaaataaagaattttttaatgaa

SEQ ID NO: 4644 - DNA, 2413 bp, Homo sapiens
tcgatgacgtcacagggcgttcccgcccgggactaagccggggagcgcatcccggctactgcgggtcctgggtcttcacctgcggagccttacggcagctgagcggtgggagggacctgagccgcggcgctaggatgggaaacagtgcgctccgcgctcatgtggaaacggcgcagaaaactggtgtctttcagcttaaggaccgagggctgaccgagttccccgcagacttgcagaagctgacgagcaatctcaggaccatcgacttgtccaacaacaagatcgaaagcctaccgcctttgctgataggaaagttcactctgctgaagagcctctccctgaacaacaacaaactgactgttctgcctgatgagatatgcaatctgaaaaaactagagacgctaagcctaaacaacaatcaccttagagagctgccgtctacctttgggcaactctctgccctcaagaccctgagcctctctgggaaccaactgggagcattacctccccaactttgtagcctacggcacctggatgtgatggatctctctaagaaccagattcgaagtatacctgactcagtgggagagctgcaagtcatcgaactcaacctcaaccagaatcagatatctcagatctcagtgaagatatcttgctgtccacgccttaaaattcttcgcctggaagagaattgtcttgagctcagcatgcttccccagagcatcctcagtgattcccagatctgtctgcttgctgtggaaggcaatctttttgaaataaagaaacttcgagaactggaaggctatgataagtacatggagaggttcacagccaccaagaagaagtttgcgtgaagttctccaggactatggaaaccttacaggatactgacttagaacctctgttggaatgtggctgagtcaaagcctcctgttgttgttaggggtatctacagtaaggagatgatacttcaggagattatatttcactcaatgatcttttctcatttcagggctcttctcaaataagctaaaagaaaaaggatcaggagacaggaaaagtcttccgttttgagtcatgagtagggcaatagacaaggttctcttcaaaaccatcattagtttggctttaagaaaccagtagctagctgctatttatatggtgagggggtgctgcctggtaacagaatagctccacaccacagcttgagattttgtttagtttcactgtgtgagctttcataaagtctgttgccattccatctctgtgttaacacttcatatttttatgaaattcagataatttgtgagaggctggcatggatctaaggatttattatttttattctagtccatcagttcagtcgcagtttttatactaggactttaggatgtacataaatgtgtgactgtttgtcttgattaaaagtgcactttggcctgggcatggtggctcatgcctataatcccagcactttgggaggccaaggcgggtggctcacttgaggctaggagttcaagactagcgtggccaacatgaggaaaccctgtctctactaaaaatacaaaaattagctgggtgtgttggtgcatgcttataatcccagctacttgggaggctgaggcaggagaatcgcttgaacccaggaggtggaggttgcagtgagccgagattatgccactgtactccagcgtgggtgacagagtgagactctgtctcaaattaaaaaaataaaaaataattttttttttttaaagtacgctttgttggctgggcacggcgactcacgcctgtaatcccagcacattgggaggccaaggcaggcagatcacgaggttaggagttcgagaccagcctggccaacatggtgaaaccctgtctctactgaaaatacaaaaattagctgggcgtggtggtgggtacctgtaatcccagctacttgggaggctgaggcaggagaattgcttgaacccaggaggcagaggttgcagtgagccgagatcatgccattgcactccgactctgggcaacagagcaagactctgtctcgggggaaacaaaaaaaaagtgtgctttgtcaagagaagcaccagcagacctctaagaactgctctctaaggctgcggtagcaaattatctactattgcaggtgccttattggtagagggctctgaagagccaaaactgtatatgcaacacttgtaagataaaagggactttaataatcaagattttcttgaagatttgttagaaataatgtcttatttctggtaacctttccctttttgtatttataactctactaaccaaattacctatcaataaaccattactataatattttaaaacaacctatgtttatcaagcttactctctgagtgacagaatatactaaataaagaattttttaatg

SEQ ID NO: 4645 - DNA, 7903 bp, Homo sapiens
ctcggttcaggttccggggcgccgcagagctcccggcctctggaccgcgcgcggcgctctggggaatccggcgccacgcgccgtgcggtggccaggatggaggaggccggagcagcggtggtcacggccggggaggccgaactgaactggtcccgcctcagcgtgtccaccgagacgctggagtctgagctggaggcgcggggggaggagcggcgcggggcgcgggaggcgctgctgcggctgctgctgcctcacaaccgtctggtgtcgctgccacgggcgctgggcagcggcttcccgcacctccagctgctggacgtgagcggcaacgcgttgaccgcgctcgggccggagctgctcgctctgcgcggcctgcgcacgctgctggccaagaacaaccggctcggcgggcccagtgcgctgcccaagggcctggcccagtcgccgctctgccgcagcctccaggtgctcaacctcagcggcaactgtttccaggaggtgcctgcctcgctcttagagctgcgcgcgctgcagaccctgagcctgggcggcaaccaactgcagagcatcccggctgagatcgagaacttgcagagtttagagtgtttatatcttggaggaaatttcattaaagaaatcccaccagaattaggaaatctgccttctctgaattatttggtattatgtgacaacaaaatccaaagcatacctcctcaactttcacagttacattcacttcgttccctaagtcttcacaataacttgctgacatatctgcctcgagagatcctcaaccttattcatttggaagagttgagtttacgaggaaatccattggttgttcgttttgttagagatttaacctatgatcctccaactctcctggaattagctgcacggaccattaagattcgaaatatttcctacactccctatgatcttcctggaaatcttcttagatacttgggttcagccagcaattgcccaaacccaaagtgtggaggagtctactttgactgctgtgtcagacaaattaaatttgtggacttctgtgggaagtatcgcctcccactgatgcactacttgtgttcaccagaatgttcttccccttgcagttctgcctctcacagctccacttcccagagtgaatctgactcagaagatgaagctagtgttgctgcacgcagaatgcagaaagttcttcttggttgaacaggagtgcacagtgttgtgaaatacttaaaaaactgagcaaaatggttagacaagaaaatagagcttgaagttcactagaaatcttatcttcatcttaagtgttcatcaaagagtctgggatgatataaaacattttgtgtttcatctacccattcagcaagaatgagtccagtcccatgtttagattattttaacataatttgtgaatgatagtttcacatttggctgatggtttgcagttttcactcaagttttgcatgaatcacaaagcagaatggtaccttttgaagagcagttctgcaataagtcatgagtagtataacttttggacattgagatggagaaagtgagaaattatcaaagctataattgccagagttgcccttgggtttaggtagaacactgtataccatatatactatataccatatatactatatataccatatatattatatgccataaacaggattaaccctcccttttctaattgcctgtatgtctagattacagaactattcaaagaagctcacagatggttacatgggacaaacctttctgacaaactaactggtaaagtaaggcatataacatttacatgagatattaaaactttttcattattatcctttgttctatatgattgctattaaccttatgtaatctagcaatgactgttatagtgccttaatccagcaaggatataaaaatgtattcaagaagtaatgccagagcaacctataacctgacataccatgcagaacattgtaaaatattctttaacagaactaggtaaataactgtgtatctaatatccgatctcatggccctcttaacatttttttgtttaaatgtgcactcatcccttataagcacattacttttacacttaatggtaggccacaatcttcatcaatctgttcatcataagacagagtaagaatttttaacagaaaattctaaaagagatagaagctaggaaagcttctttatatcttgcattaaatgggtagggaaaaaatatgactctcacccatgtcatgtactggaccatctttctctactttttaaagaaaaactaatacaactagaaaaacatcacaacaagccaaataaaaatggagaaaaggagtcattgtccttatacctaatggaacagtttccagaactactttaactatggaagcatttttgaaaataaagtattaataaaatagaaaaaaattattaaatatattgtatccttaatgtatagcaggaaaatagtttcacaaattaattgctattagaaattaccaaatttttattaagtactttaatatgcaatacaaattgaataatagtacaactataagttgatataaagtaagtgcttactggtaatcattaaataactaataacatgacttgttggttaatgttaaacctacagtaagaaatgttatacagatcagataggcattagaacatcaggtgtaccttttctgatttctggcattcatggcacaccatttcttaaaagcagattgttgtataataacatatacatgtattagggtttttttcatatatattttttattttagaagaaactagcataattcagggtttatgtgtttatttgtatattaattcatgaaacatgagagtttcatgaactgcagatgtgaaacgctgctatagaatgaatcccttcacctttaccttgttataatgtagtaagattttgttttccttttgactcagaaattttctatgtctatagaggtaatctaatatgttcctactgcctagaagagtaatacataggtgattatatcataaaatagaggtataaagtctttgcttacttctccatgtgggccacagcaagctgcagactgtacagttatgaaaggtaaagatgacttaggctgtgcctaagtgacaaatgtaaaatgttttgtaaataagtgacttacctaagatacataagatattttcatagaaaataatgtattcatagtaaaatactcaaattgataggaccaattttttctggcctaaatgcttatgcctacttcctaatcaattaccagcttgacttaagtaactgcttgagtagtcttctaagagttagtcttcgtaaaataaatggataggtatgtaaatatataatcttacataccctttccagcttcctagaaaggtctactgcttcatcttttacagatgtaaataggtccaaccagagacagtttctggcctttgcatataagaatatagatgtataccacagtattatttcaacaaaatgttatggttctatgtatagttgaaaactctatgatcagcatacaactgtcttttggtaatttttaatgaagtctacatttagccgtcggttttatctttcttaaatctttgacctaaacttttgtaagagcagctaataatttctaagattttccctgtttctttttcctacctttccttttctcataactgattggagaaattaatcagaagtcaaatacaagggacttcataatctagaaaccagataatcagctcccaagtcatgtagctaactatgcatttaaaataagtctgtctctttagttcttaagtcatatatttgtttgttaattacagtaaatgaactttaattggggtttttaaaagacagaattagcgaagtctaatttttataatgaaataagtttttgatattgctctacttggacgattttagtgaccaaaactatggataaaactgcctaagcataacattaatatatttagaatggcattcttcagtgctagtatttgaaattggaattagtacattgtgcattcttagtagtctttatccctagaatcaattctctcagcatcaccaaactgaattggtgaaatagtgctaagattctgggcaataggaagattagtgaatatgatacattgattccagggtgccagggattggctgacattaaggaccagctggctatggtcctcaggctacggtcctcagtattctagtatttgagtagtggaggtaaatccaaaggcgactggttatattttacttctaaatgtgtgctgaagtgtctcttgttcaaaaattcttgatatttagagcttcaagttaccacatttaaaagtaaagacttggcacggtggcacacacctataatcttagcactttgggaggccgaagtggatggatcatatgcagtcaggaatttgagaccagcctggccaacatggtgaaacctcatctttactaaaaatacaaaaattagccgggcgttgtgacgcacacccatagtcccagctaactccggaggctaagacaagagaatcacttgaacttgggagacagaggttgcagtaatctgagatcactccgctgcactccagcctgagtgagagtgagactgtgtctcaaacaaacaaacaaaaaacaaacaaaaaaatttgcattgtaaattgtacctcaaatttgagcagtttttgtgtttgtgtaaattaaagtaaaaagcagtccacaataatgttttgtaatactgcacaccagttctaccagattttgtaactatcagatttaaatgaaaaaagagaaggaagaggctgattgctggagtgttaaagaaatcttggccgggcgtggtggctcacgcttgtaatcccagcactttgggaggccgaggcgggtggatcacgaggtcaggagatcgagaccatcctggctaacacggtgaaaccccgtctctactaaaaatacaaaaaaaaattagccgggcgtgatggcgggcgcctgtagtcccagctactcgggaggctgaggcaagagaatggcgtgaacccgggaggcggagcttgcagtgagccgagattgcgccactgcactcccgcctgggccacagagcgagactccgtctcaaaaaaaaaaaaaaaaaaaaaagaaatctttagaagccacagggctagaagagaagtcaccaaacacctagggacagtcctaggcctagaaagccctttaaagtaatagtgaattgttttaaaattaagttattgagtggcctactgactaccatccaaaaacctttatcaccaaatttgttcagtgtttgctattgggagattgtccatatccctccgtaattaagggccagcaagtaatacgatcttcttacagccaaccttgctcttcccaaagggagaaagtaatacatcattaacctggaatttgtgatataacaggtagccttggttaatgtttaccttttcactatgtaaaaaagaaaaaacacacagcaaatagtgcaaataaaatttggtcttttaaagcattttagcagtagctatgtaaaaaaagttaatggttattattcctaaattttcataagacccttggtagacaaaactatcggttatattatgtatatatgaggttagttaagctgcatttagttaggaacatttaatttttacctaaatgatccttttttcatccagaggtagagattttattgtcattatgaatgttactccccatttagtccaaaatagtgagcttttaagttgtgccaggtacttaacaatagtaaaagctattgtatagatttttattcaatgtgacctataatacatttctgattccttctgtattgaatgtcccagtttccatattaagtgctatgccctgtataacattaatgaatttaatagtgtacaattttgggccaggcatggtggctcacgccagtaatcctggcactttgggaggcagaggcaggcagatcacctgaggtcaggggttcgagatcagcctggccaacatggcaaaatcacatctctactaaaaatacaaaaattagccaggcgtggtggtgcatgcctgtagtcccagctactcaggaggctgaggcaggagaatcgcttgaacccaggaggcggaggttgcagtgagccgagatcatgccattgcactccagcctgggagacagagcaagactctatctcaaaaataaaaataaaaaaaaaattgcgtgcaattttgtattttcatagtcgtatctttttaaaggtatcatgatttcagttgtggtcaggaagtatgtgccttaaatcctctactctagacccaaagtttggagagctatattatttaataagttgtttgtgacagccttgttacctttttcatttgatttgagggagaaagactgtgatcctgacagattccttctcataaaatggcctaatgtgtatcagtctaggacttctggggagggaacctctaccatgcattctgtcccaggatgtcaaagtcataagaatcagggtcccctgaaataaaatcactgaaaagatatgttctgttatatattatttaaaaaatttatctggtgccaccaaagaatgacagcagtttctaaccaacttcatatttatagcatcttatgaagatattgtaaggcttagcatattttgccactggttttctttgtaatataggttgaaagtgagacatgtttgaatacttttgtatgtaaatatctcccattctttttctatctcttcttggtctatatttactaagaattgatatttaaaaaacagttcactaatgaactctacatattattgaacactcacagggcaatattgatttgggtgctactagacttttacctaacattagtctttctcaatagttgttgtaaaggatagtattcaatccagtaaatattaaagtgtattagtttaatgaaggttatttatatactgtcataccacaaacctatggtggaaagaacatctgcattcaccagaatgtacttgttcctttggctgtgaataaattggataagacttttttattgtaagttccagctgttggaagatacggggataagattgacattgctgttgcagtattgcaaaaacatgactaaattggttaattatgtctaccgcttatgtttaagagaatcctttcactaacttaaattgttaacattgttgtgatattgagaaagaatattaacctaaacagtcactttacaacaatcatgtaaagacgtgtgcctgcagttgaggttttttgcatttctgagcctgctttgtattcatgagaaacaaaaacataatgggagaaaagttttagataagcagcattgtaagtttttgtaaagtttgggatgtcaaagtattaacgaagggtactgaaaacatacttttacttgggtcaaattactttttatgatctgatttcttaattttctgtatttgaaatcttgcaaattaggaatatctacatctatagataaataagtaaaacttaatggtagaaataagtgtaattcagcaacatgattcaacaatttttatatttaggataagttattgtttattatattaatatcaaatttatatattgccttgtaatgctaaatgctcttaaaagaatatatgggctacttcaattctaccaccttcttccccctcccccaggacgtacaaaagatcttatattaaccaatcctctgtgaattttgccatatcaaacattgtgccttattttaataaaactgttttgttggaatccagttctatattaaagtctctataatgttgatatttgcctgattacttgttacatcattgaatacatacattaaatatgtactaacattga

SEQ ID NO: 4646 - DNA, 1684 bp, Homo sapiens
gcaggctgcgcttccggaagtaacccctggcgcatcccggaatccagagcgcccactacggcctttggccaggccccctgggcgcgttccgggagctcaggcctgcggcgctgggagaagcacgctggccaacaagttgggtggtgggcacgcggcccaggggtcaggggccgccaggcggcgggcggcggggctgcggctcttacctgccgaggaggcgccggctctgcggtgcggagttgcgccggacttcccagcttggccagtggctccgcaggctgccggctccacccctcagggactggctggcttcgagcagggcatcggaaccaggcctcctggcactggcctgggtagagccagggcgagcaccagctgacccccagtggaaccctgtgacagtcctgccagggcccaggccatcccaaccgacttccatctcatggaccctccagcggagaagccgggagaggctggcggactgcagatcacaccccagctgctgaagtcacgcacaggcgagttctccctggagtccatcctgctactgaagctgcgtggcttgggactggctgacctgggctgcctgggagagtgcctgggcctggagtggctggacctatcaggcaacgcgctcacccacctgggcccgctggcctccttgcgccagctagctgtgctcaatgtctccaacaatcggctgacgggcctggagccactggccacctgtgagaacttgcagagtctcaatgccgcaggcaacctactggccaccccgggccagctgcagtgtctggctgggctaccgtgcctggagtacctgcggctccgagaccctttggcccggctcagcaacccgctctgtgccaacccctcctactgggctgcagtccgggagctgctgcctggcctgaaagtcatcgacggtgagcgtgtgattgggcgtggtagtgagttctaccagctgtgccgagacctggacagctccttgcgtcccagctccagtccaggccccagagccaccgaggcccagccctgggtggagccaggctactgggagtcctggcccagccggagcagctccatcctggaggaggcctgccggcagttccaggacacactgcaggagtgctgggacctggaccgccaggccagcgacagcctggcccaggcggagcaggtactcagctctgcgggccccacctcttccttcgtcttctgaacgtggcctatggcccaggacagcctggcaggtggcctcgctgcccccagttcccctctctgcccccacactcgtcttagttgcttcacactggtcactggccctgcacactgggctattgctttatccctatcctgagagcagcccctccccaccatccctccacatgctgcaaggacagactgaagggctgtgagcaggtgtaagggctcccacatccgtgagcctgtgtccgcagctgctgccactctgggctgctccagcctgcaacttagtggaaggaattacttcctcctgaggctacaggcgagaaaggtagggatgggccagcctcccgtctcagctgttgggagacagtaggcaggctgagtggcccagagcactcctggaagtgggactcccctgccttgcaaatgtgcctctccagactgctcctgcacttaccccctccccgcagcacct

SEQ ID NO: 4647 - DNA, 1877 bp, Homo sapiens
ccctggcgcatcccggaatccagagcgcccactacggcctttggccaggccccctgggcgcgttccgggagctcaggcctgcggcgctgggagaagcacgctggccaacaagttgggtggtgggcacgcggcccaggggtcaggggccgccaggcggcgggcggcggggctgcggctcttacctgccgaggaggcgccggctctgcggtgcggagttgcgccggacttcccagcttggccagtggctccgcaggctgccggctccacccctcagattcatttggattcaaggttggctctcaacagtgccagctgcactgtcatcctaaagtacttctgtggaagagaacatggtggtgtcactgttgtaccagtgatgacacaaaatcccagatctacctgacgggcctgcgagggttgaagattgtgaagcaatagcctaagggactggctggcttcgagcagggcatcggaaccaggcctcctggcactggcctgggtagagccagggcgagcaccagctgacccccagtggaaccctgtgacagtcctgccagggcccaggccatcccaaccgacttccatctcatggaccctccagcggagaagccgggagaggctggcggactgcagatcacaccccagctgctgaagtcacgcacaggcgagttctccctggagtccatcctgctactgaagctgcgtggcttgggactggctgacctgggctgcctgggagagtgcctgggcctggagtggctggacctatcaggcaacgcgctcacccacctgggcccgctggcctccttgcgccagctagctgtgctcaatgtctccaacaatcggctgacgggcctggagccactggccacctgtgagaacttgcagagtctcaatgccgcaggcaacctactggccaccccgggccagctgcagtgtctggctgggctaccgtgcctggagtacctgcggctccgagaccctttggcccggctcagcaacccgctctgtgccaacccctcctactgggctgcagtccgggagctgctgcctggcctgaaagtcatcgacggtgagcgtgtgattgggcgtggtagtgagttctaccagctgtgccgagacctggacagctccttgcgtcccagctccagtccaggccccagagccaccgaggcccagccctgggtggagccaggctactgggagtcctggcccagccggagcagctccatcctggaggaggcctgccggcagttccaggacacactgcaggagtgctgggacctggaccgccaggccagcgacagcctggcccaggcggagcaggtactcagctctgcgggccccacctcttccttcgtcttctgaacgtggcctatggcccaggacagcctggcaggtggcctcgctgcccccagttcccctctctgcccccacactcgtcttagttgcttcacactggtcactggccctgcacactgggctattgctttatccctatcctgagagcagcccctccccaccatccctccacatgctgcaaggacagactgaagggctgtgagcaggtgtaagggctcccacatccgtgagcctgtgtccgcagctgctgccactctgggctgctccagcctgcaacttagtggaaggaattacttcctcctgaggctacaggcgagaaaggtagggatgggccagcctcccgtctcagctgttgggagacagtaggcaggctgagtggcccagagcactcctggaagtgggactcccctgccttgcaaatgtgcctctccagactgctcctgcacttaccccctccccgcagcaccttctctgcccgttcttgtccacacatctattaaatgcttctgttttca

SEQ ID NO: 4648 - DNA, 1456 bp, Homo sapiens
ggcgcatcccggaatccagagcgcccactacggcctttggccaggccccctgggcgcgttccgggagctcaggcctgcggcgctgggagaagcacgctggccaacaagttgggtggtgggcacgcggcccaggggtcaggggccgccaggcggcgggcggcggggctgcggctcttacctgccgaggaggcgccggctctgcggtgcggagttgcgccggacttcccagcttggccagtggctccgcaggctgccggctccacccctcaggcacaagagaagtagaagagtggccgctttccttctgggcacgcacttgggaaaaggcttgattcatttggattcaaggttggctctcaacagtgccagctgcactgtcatcctaaagtacttctgtggaagagaacatggtggtgtcactgttgtaccagtgatgacacaaaatcccagatctacctgacgggcctgcgagggttgaagattgtgaagcaatagcctaagggactggctggcttcgagcagggcatcggaaccaggcctcctggcactggcctgggtagagccagggcgagcaccagctgacccccagtggaaccctgtgacagtcctgccagggcccaggccatcccaaccgacttccatctcatggaccctccagcggagaagccgggagaggctggcggactgcagatcacaccccagctgctgaagtcacgcacaggcgagttctccctggagtccatcctgctactgaagctgcgtggcttgggactggctgacctgggctgcctgggagagtgcctgggcctggagtggctggacctatcaggcaacgcgctcacccacctgggcccgctggcctccttgcgccagctagctgtgctcaatgtctccaacaatcggctgacgggcctggagccactggccacctgtgagaacttgcagagtctcaatgccgcaggcaacctactggccaccccgggccagctgcagtgtctggctgggctaccgtgcctggagtacctgcggctccgagaccctttggcccggctcagcaacccgctctgtgccaacccctcctactgggctgcagtccgggagctgctgcctggcctgaaagtcatcgacggtgagcgtgtgattgggcgtggtagtgagttctaccagctgtgccgagacctggacagctccttgcgtcccagctccagtccaggccccagagccaccgaggcccagccctgggtggagccaggctactgggagtcctggcccagccggagcagctccatcctggaggaggcctgccggcagttccaggacacactgcaggagtgctgggacctggaccgccaggccagcgacagcctggcccaggcggagcaggtactcagctctgcgggccccacctcttccttcgtcttctgaacgtggcctatggcccaggacagcctggcag

SEQ ID NO: 4649 - DNA, 2091 bp, Homo sapiens
ggaccccggttgctagggtgtgtctccttggcctcctagagggtggggatccgtggtgcttcttcgggaacagcctcctgcaggaagaccctcgctggacctttacctcgctgcctagattccgaggaaaaggagataggagacgaaaagccagttggtttggaaagcggccgattatcctaaagggtagtgtgggagtccagcacttccatgcccctctttgggtactacggaagggagatttccagcatcgtgtggaacatatgaccagggagtacaccttgagcgcttgtgtgcagttatcttttggcggattatgaaaaacagcacttattattcattaaaatgcaaaagcccccactgcttcttcgaagacccttacctccaaaattcactaagctgtctttacatgagaaaaaaacccatacagctaaaactggtaaaattgagtcactacatgtagcattcactgaagatgaaaccacttccattaaaatggatagaactcgttttcctgatgttttaagaaatcaatcactaacacctatcaatatccaaaatatctttcttgatcactgtgtacaagaaagagtgactgcaatttcatcaccccagaaatctactaagcatgtccgtgagcagattccagatactgctactggttccatattttttccacattgtaattcagcttctactcgaatttttgggaaacaaacaaacaaaatggaaagttcaagaaagtttaaaactatgaaagatgtttatactgaaaaaaggctagaaaacattttaattctttcttccaagttttccaaacctaaaagtactcctggctcagttatcgctcaaaaacttgagaaaatgcaccctaagcatcaacctttaccagagagtccaggctatacttatcagcacatctcgagagacttaagtgcaacagtgccaagccctccacctatgactgtatctatgaaaccagaaggacagtggcctgaacattttaaatcaactgctacattgacactaagagttactgaatttccaggttttgtttccttgccaacaccagttttaccaagaaaacctcacaggcagtctgtgatagaaactcttgtaacagaaaatggaaatatagaaagtgtcccaaagcaaatcccaccaagaccacctgaaggtctcaccaaaactgaaaaaatagaatcagagatacacgttgtacgtggtgaaggttttaagactgttgcagcaacacgatatgaaacaataacagccatgaccaacctggccatagtaaactgtcaagtatatgggagaaatgcacttaatctgaagggcttttttatcctaaattgtccagacttaacacctttggctttccagttgatatatcttaatttatcatttaatgatcttcattactttcccacagaaatattatgtcttaaaaatttacaaatactgaaattgagaaataatcctatcaaagaaattccttctgaaattcaacaacttgagttccttagaattttcaccattgcttttaatttaattactgttcttccaattgggttattttccttgtcttatcttgaagaacttgatgtttcctataatgaacttacttttattccaaatgaaattcagaaactcagatcacttgaaaaactgactgttgatgggaatgaactgagttttttcccccatggaattttgaagcttaacctgacaaaaattcagtttgagaataatttcactcatccttgtttttggagagataattatttgaataatccacaacaacttactcaaattatttctttgttcattgtccaaaataaactacataaattttatgataagatcccagtagaagttcagaagttactaaaatggtggggggcacagtttctaacagaacttgcacctctctccatctattcttcaagaaaagccatcactgaaggctacattgcagttgagttacccaaatttgaagaaagtaaaaacataacagaagggttactgacacaaaaacggtatgaagaagtcatggtgaaatgcattaatgccacaacagtgacgtcatga

SEQ ID NO: 4650 - DNA, 720 bp, Homo sapiens
acttcttttccaagatcatgactgagagattgttaataaaagcattgagtggtggtaaaaatacgaagatcattactttgaatgggaagaagatgacaaagatgccctcagcattaggaaaactgcctggcctgaagactctagtccttcagaataacctaatccccaaagtgtgtccagagttatgcaacttgacccagtttcaggatctgaagctgagggaattctactgtgagggaaacccactgttcctgcagcagccagtgatttctacacagcaggagaacgtctggagtctacaggaaataacatcaagatttgtaatgaatcagctagcagaaaataaccctttcctaatggatgacatagaacggtacccacaagtcaggagcatgatctctcagggaaaaacatgtgcaatatgtggacagtactttataaccgtatggctggaatgtgttcgatttgttcctccaccaaaggactggaagataagcaagaatctgaagctggtgcctctccaagtattaatttgttcttacaaatgttttactcaacgtgaccctaacctctttggaattgctcaggtgtagaacaggtgaggtgctcattcatagcctcactccacttgccctgtcagctctgcatacacagattatgccctacttaagataccatgcctgttctctttgtcaacacattaaataaaggaagaaaaat

SEQ ID NO: 4651 - DNA, 571 bp, Homo sapiens
tcagatttaatttttggacaggaacatttcataggtggtgctgctgtgtactttttaattcattacttcataaggcttataatgtgattgtctcaattttattgatgctaaaatgattagtgggttattaacctgatcacttgattataaagttcctcatcaacctttcatctaatactttcagtctccaattatgatttttgcatagctccattattttattagaatttgcaaaaattgtgattattctagttattttgtctttctcatttattagtttcaattcttgtgaataagaactttattaactattaagttatatttaagtgcagtttgtactggaaaagcagaataaatgcttatattttttcctttatcaattttcagactgagttggtgcgctagtaattcccaggatcatgactgagagattgttaataaaagcattgagtggtggtaaaaatacgaagatcattactttgaatgggaagaagatgacaaagatgccctcagcattaggaaaactgcctggcctgaagactctagtccttcagaataacctaatccccaa

SEQ ID NO: 4652 - DNA, 1044 bp, Homo sapiens
atgactgagagattgttaataaaagcattgagtggtggtaaaaatacgaagatcattactttgaatgggaagaagatgacaaagatgccctcagcattaggaaaactgcctggcctgaagactctagtccttcagaataacctaatccccaaagtgtgtccagagttatgcaacttgacccagttgacaacactaaatctgggaaacaaccttttagaagaagttccggaagagatgaaatatcttacatctctgaagaatctccatttatctggaaataggatctgtagatttgcacctggagcctgtgatggcttacaaaatttaatcctgcttaatctgaacaacaatcatcttacgcagcttcctcaagaagtcagcagattaaaaagtcttacttatatgagtataaattataaccaactagccagcattcctagagaactttgttttcttgagaatcttgttgaacttcaacttaactacaatcagctgatatgcatacctgaagagattaaattcttgaagaagcttcagaagcttttgctagccagaaacaacattggagttttgccggaggaactttgtgatcttaaaaaactaagaatcctagacatagctggaaatattattcagatatttccatcaggatttcaggatctgaagctgagggaattctactgtgagggaaacccactgttcctgcagcagccagtgatttctacacagcaggagaacgtctggagtctacaggaaataacatcaagatttgtaatgaatcagctagcagaaaataaccctttcctaatggatgacatagaacggtacccacaagtcaggagcatgatctctcagggaaaaacatgtgcaatatgtggacagtactttataaccgtatggctggaatgtgttcgatttgttcctccaccaaaggactggaagataagcaagaatctgaagctggtgcctctccaagtattaatttgttcttacaaatgttttactcaacgtgaccctaacctctttggaattgctcaggtgtag

SEQ ID NO: 4653 - DNA, 1959 bp, Homo sapiens
gcgtaggctacgccaccgcggacgggtcggatccggtccctggacgcggaacagagatcccctgattcagccacccccagactgagccccgtagagtgcgttcttaccttcctgccccgacgaaggtcccagagacgctgcggacaacaccagcatgtcgagcgagcagagcgcgccgggggcctcacccagggccccgcgtccggggacccagaagtcttctggcgcggtgaccaaaaagggagagcgcgcggccaaagagaagccagcgaccgttctgcctcccgtgggggaggaggagcccaaaagccctgaggagtaccagtgctccggggtcctcgagaccgacttcgccgagctctgcacgcggtggggctacacggacttccccaaagttgtcaaccggccccgcccccacccgcccttcgtcccctccgcctctttgtcggaaaaggccaccttagacgatccgcggctgtcggggtcctgcagcctcaatagcctggagagcaaatacgtgttcttccggcccaccatccaggtggagctggagcaggaggacagcaagtcagtgaaggaaatctacatccgcggttggaaggttgaggaacggattctgggtgtcttctctaaatgtctgcccccgcttacccagctacaggccatcaacttgtggaaggtggggctgaccgataagaccctgaccaccttcatcgagctcctgcctctctgttcatccacgctcaggaaggtgtctctggaggggaacccactgccggagcagtcctatcacaagctcatggccttggacagcacgattgcgcacttgtctctgcggaacaataacatcgacgaccgcggggcgcaactcctgggccaggcgctgtccacgctgcacagctgcaaccggaccctcgtctcgctcaacctgggtttcaaccacatcggtgacgagggcgcaggctacatcgcggacggcctccggctgaaccgttccctgctctggctgtccctggcccacaaccgcatccaggacaagggcgccctgaagctggctgaggtcctgcgcgccttcgagctgacacacaccgaagtggtggagcgccgacgcctcctgctggaaaaagggacacaggagcgctcgcgatcgccctcctcctctcgacacggggactccaaaacggaccgtgagaagagtcagatggtagggatcagcaatagtgcattggtggacaagacagacaagacgcagacaatgaaaacccctaagggcctgggcaagaaaaaggagaaatcatgggaattggccaagaaagaggagaagttggggtctgggcagtcacccacacaaggaacccctaagaaggaagatgccacaaaggcaggcaaggggaaggtaaccatccctgaacagaagccaagcagggcaaaagggatcaagatcgggagcagagagaagcgcagcatcctcctggagtccgagctggttgttgaggctactgaggtggtcaaccctctcctggagcctgtggagcaccgagatgggaaagttttcatgcctgggaacaaggtccttttgcacctcaacctcatccggaaccgcatcacagaggtggggctggagggcttcctcgccacggtgcagtatcagatgcagttctccaaggccaagagtgcatccaagggtccagtggggctgctgtggctgtccctggctaaaaattgcttcgccccacaatgtcctgcgtacgccataatccaggagctgatgttgccaagggatcccatcaaggccaaactcagggaggatgaggccatggcattcttcccctagccccctcccacctgcttgcctctaagactcggggctacagaagcacctcctgtccctgtgtggggtgacctccctgggggagatctcagaccaataacaaagtctgttgctatacttttccttga

SEQ ID NO: 4654 - DNA, 1000 bp, Homo sapiens
gccaccggcgggcgaggccggattaatcaccgctgcttcggccgcccatgtgtcctgatgtcctgggacccgaaccccgtgccccgtaccttgcgatgctggcgcctacggagggcatccgaaactgccctacagagcagtcgccgggcagttgaagatcagctaaagatatgtggccacaggagggatgctgatgtctttgagctgttcctttctaaaaaggaactgacagaggtcattgatctttctaggtttaaaaaattaaaatacttatggcttcatcataacaagctccatggaataacatttctaactagaaactattgtctgacagaactatatctaaacaacaatgcaatatttgagatagaaggtctgcattatttgccttcattgcatatactcctgctacaccacaatgagctaaccaacattgatgcaacagtgaaggaattaaagggaatgctaaatctgaagatcctaagtctataccaaaatcctttgtgccaatataacctgtatcgtttatatatcatctaccaccttccaggagtggagctgcttgaccgaaatcaagttacagaaaaagaaagaagatcaatgattaccatttttaaccataaaaaggctcatatcgttcaatcaatagcattcggaggaaaagtggatgcttcatgggatcctaaatcaccatttaagcaaaaaccagcccagagagtaccttcagattttgcatttgcaaataatgtagacaaaactgtgcttgatgacccagaagatgctgtttttgtgaggtccatgaagagatcagtgatgactttgacctctatgaactgggacacagttccaacacgagaggaaaggtaccttgaagaggaaggcacagaaacagctcaaatgctcacagttacactgagataagccctggtatttctagatatcttagtggttttcagttgtatattaaacttccctgtgacttagcatattacatacttac

SEQ ID NO: 4655 - DNA, 2121 bp, Homo sapiens
gagggaacagtgccctggattccggcgggggtatggaccttaggaacggggaaggatggaagaatgggcagaagcagcagtaaccgtgcccaacgccatctccacggggcgtgcctccattccgctccccgtcagccctacccactcagccctgccgcctgccgcctgccagttggctgaccccactcccaagggaagagcggcctatcgctcccagctccttgccccgaaccacccagtgtacgcgaacctcgcgggccggcgtggccttggccgggcagggggcggggcgagcgccggtgacgcggccgttgccatgggaactcgccgcccgctcgctctctggagctggagccggagctgccgccagccgcccgcctcaggctctctctgccagccgtgcggccaggcccgcggggtggtcggggggagccgggcggcagagaaggagggagcgggtacggcctcctagccgagaccggtaagccgaagcccttgagccgctcgctgccgctgccgccgccgccgccgcgaccgcgagggacaaggacaagcgccgagcagcgcctgcccaacccccggaacgcgcacccgccccaacgcccagacacggaccgtgcgggccgcccccgccccagcgccgccccacttcagcccggcccgcgccctggacgcctccgcacctctggccggctccggctcagtcccggtagctcttctccgcccccgccgcagcctccgccgcagccgcagcctccgccacagccgccgcctccacccccggccccactccgcccgcgacccctgccggggccccgaccccggccctatccccggccccgcccgcggccccaccaacctccgttccggccccgtacccggaggcccagccgtgggcacgatgctgcccagctccatccagatttcgggggagccgctgtccggcgccgaggtgcgggacatctgccgcggccttcgcgacaacgccgtgcgcctgctctcactgcgcggctgccgcctctgcgaccgcgactttggccgcatctgccgggccctggccggggccacgtccctggcgcagctcaaccttaacctgggcgtcgtgtccagccccagccgcatcaagcagctggctgaggctctgcggaccaaccgctccatccagtccctcttcctgcatgggagccccctgacagatgcggggctggccttgctgaacccagccctggccctccaccctgccctcgtggctctggacctgggggactgcatgctgggtgatgaagccatcaacctcatctgtggcctcctgcccccagatggggccaaatctggcttgaaggagctaacgctgagtgccaaccctggcatcacccctaagggctggagccgccttgccattgccgtggcccacagctcccaggtccgcgtcctcaatctggattacaaccccctgggtgaccatgtggcaggaatgctggctgtagctgtggcctctagtcgtaccctagaggtcctagacttggagggcacagggctcaccaaccagtcagctcagaccctgctggacatggtagaaaattaccccacagctttgcggagcctggtgttggctgagaacagcattagcccagagctgcagcaacagatctgtgacctcctctctgagggagaggaggaggaggaagtggcaggaggggctggcgacacccaggaatgggagagagggcgggagcctgctgcccaccagagaggcagcagctcctggatgtgccccagcgatcccagctctcagatggtgctaatgacgtcaggactaggggacagtctgttggctgagaccgagatgtgactctccactgggcctctgcacaccatttcacttatctatgtcccgagcaccttgccccagatatcagggtcaggccctgggacttgggagggaactggggtcaggggctgcatgggggctctggcagctcctggcagtgtggtgggaaggaagctctggaagctgtgactgagcaacagccttggggggcacttgaacccacggcaatgcctttgaacttggcagctctggctgcaacccgctggctcggaaaagattttatgaactcc

SEQ ID NO: 4656 - DNA, 1745 bp, Homo sapiens
aaccaccgctgccagctgcgcgctcgggggaaaagacgttgcgcccccgccgactgccggtttcccgggcgcgagcccggatccaggtggtcagtcccggtacgcaaccacggcgagaacccggccctgctaagggagaagggaagccgtttcccgcgggcttcatacagacacggtgctaagacagcccgagtcgcggaccagtccaacaggcaggcagatcagtgggcagcccgcgtgcgcgaggaccccgatggcggcgccgggtggcgggaaggaggaagtttcaaagccagcttgacgtggttgtggccgttgggcgagatgaagctacactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaaggccatttccagcagtttaaaaggtttcctttcagctatgagactggctcatagaggctgtaatgttgatacaccagtttcaacgctcacaccagtgaagacttcagaatttgaaaactttaaaactaaaatggttatcacatccaaaaaagactatcctctaagtaagaattttccatattccttggaacatcttcagacttcttactgtgggcttgtccgagttgatatgcgtatgctttgcttaaaaagccttaggaaattagacttgagtcacaaccatataaaaaagcttccagctacaattggagacctcatacaccttcaagaacttaacctgaatgacaatcacttggagtcatttagtgtagccttgtgtcattctacactccagaagtcacttcggagtttggacctcagcaagaacaaaatcaaggcactccctgtgcagttttgccagctccaggaacttaagaatttaaaacttgacgataatgaattgattcaatttccttgcaagataggacaactaataaaccttcgctttttgtcagcagctcgaaataagcttccatttttgcctagtgaatttagaaatttatcccttgaatacttggatctttttggaaatacttttgaacaaccaaaagtccttccagtaataaagctgcaagcaccattaactttattggaatcttctgcacgaaccatattacataataggattccatatggctctcatatcattccattccatctctgccaagatttggataccgcaaaaatttgtgtttgtggaagattctgtctgaactctttcattcaaggaactactaccatgaatctgcattctgttgcccacactgtggtcttagtagataatttgggtggtactgaagcacctattatctcttatttctgttctctaggctgttatgttaattcctctgatatgttaaagtaatgggtgagaccagaaaaagaaatttcaataacagatcagtttggggtgcatgtatgattttgcagcgtcaaattggagtaagggaagatttctgtatacttgctggagaggaggaatgtgtatagttactcatttagatgactccaaaacttttattaaaaccaattttagtttta

SEQ ID NO: 4657 - DNA, 957 bp, Homo sapiens
ccgggcgcgagcccggatccaggtggtcagtcccggtacgcaaccacggcgagaacccggccctgctaagggagaagggaagccgtttcccgcgggcttcatacagacacggtgctaagacagcccgagtcgcggaccagtccaacaggcaggcagatcagtgggcagcccgcgtgcgcgaggaccccgatggcggcgccgggtggcgggaaggaggaagtttcaaagccagcttgacgtggttgtggccgttgggcgagatgaagctacactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaaggattccatatggctctcatatcattccattccatctctgccaagatttggataccgcaaaaatttgtgtttgtggaagattctgtctgaactctttcattcaaggaactactaccatgaatctgcattctgttgcccacactgtggtcttagtagataatttgggtggtactgaagcacctattatctcttatttctgttctctaggctgttatgttaattcctctgatatgttaaagtaatgggtgagaccagaaaaagaaatttcaataacagatcagtttggggtgcatgtatgattttgcagcgtcaaattggagtaagggaagatttctgtatacttgctggagaggaggaatgtgtatagttactcatttagatgactccaaaacttttattaaaaccaattttagttt

SEQ ID NO: 4658 - DNA, 1590 bp, Homo sapiens
aaccaccgctgccagctgcgcgctcgggggaaaagacgttgcgcccccgccgactgccggtttcccgggcgcgagcccggatccaggtggtcagtcccggtacgcaaccacggcgagaacccggccctgctaagggagaagggaagccgtttcccgcgggcttcatacagacacggtgctaagacagcccgagtcgcggaccagtccaacaggcaggcagatcagtgggcagcccgcgtgcgcgaggaccccgatggcggcgccgggtggcgggaaggaggaagtttcaaagccagcttgacgtggttgtggccgttgggcgagatgaagctacactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaagatggagtctcattctgtcacccaggttggagtgcagtgggaagagcttggttcactgcaacccacaggccatttccagcagtttaaaaggtttcctttcagctatgagactggccatagaggctgtaatgttgatacaccagtttcaacgctcacaccagtgaagacttcagaatttgaaaactttaaaactaaaatggttatcacatccaaaaaagactatcctctaagtaagaattttccatattccttggaacatcttcagacttcttactgtgggcttgtccgagttgatatgcgtatgctttgcttaaaaagccttaggaaattagacttgagtcacaaccatataaaaaagcttccagctacaattggagacctcatacaccttcaagaacttaacctgaatgacaatcacttggagtcatttagtgtagccttgtgtcattctacactccagaagtcacttcggagtttggacctcagcaagaacaaaatcaaggcactccctgtgcagttttgccagctccaggaacttaagaatttaaaacttgacgataatgaattgattcaatttccttgcaagataggacaactaataaaccttcgctttttgtcagcagctcgaaataagcttccatttttgcctagtgaatttagaaatttatcccttgaatacttggatctttttggaaatacttttgaacaaccaaaagtccttccagtaataaagctgcaagcaccattaactttattggaatcttctgcacgaaccatattacataatagaaccatctatccgaaagagattaatgtaaacatgtgggagacactccctggcagaatcagtttggggtgcatgtatgattttgcagcgtcaaattggagtaagggaagatttctgtatacttgctggagaggaggaatgtgtatagttactcatttagatgactccaaaacttttattaaaaccaattttagtttt

SEQ ID NO: 4659 - DNA, 672 bp, Homo sapiens
actgcacacggttttcagcctcatgcctccgtggaacctgcctgtcaggcgggcacctggaatctcaagcaactttctcaagaagggccaaggcgttatcgtcggccacgcacaagatttctctccaaacaactcacagcattgagagaattgcttgaaaagaccatgcacccaagtttggctacaatggggaaactggcttcaaagctacaacttgatctatccgtagtaaagatctggttcaagaaccagcgtgccaaatggaagaggcagcagcggcagcaaatgcagacacggccatcactagggccagcaaaccagacaacttcagtgaagaaggaggagactccctcagccataactactgcaaacattcgtccagtaagtcctggaatctctgatgcaaatgaccatgatctacgtgagccttctggtatcaagaatcctggaggagccagcgcctctgcgagggtttcatcctgggattctcagtcatatgacattgaacagatatgtctgggggcttcaaatcctccttgggcctccactctctttgaaatagatgaatttgtaaagatctatgacttgccaggggaagatgacaccagcagcctaaatcaatatctttttccagtatgccttgagtatgaccagctccaatcttcagtgtaa

SEQ ID NO: 4660 - DNA, 544 bp, Homo sapiens
ctgcacacggttttcagcctcatgcctccgtggaacctgcctgtcaggcgggcacctggaatctcaagcaactttctcaagaagggccaaggcgttatcgtcggccacgcacaagatttctctccaaacaactcacagcattgagagaattgcttgaaaagaccatgcacccaagtttggctacaatggggaaactggcttcaaagctacaacttgatctatccgtagtaaagatctggttcaagaaccagcgtgccaaatggaagaggcagcagcggcagcaaatgcagacacggccatcactagggccagcaaaccagacaacttcagtgaagaaggaggagactccctcagccataactactgcaaacattcgtccagtaagtcctggaatctctgatgcaaatgaccatgatctacgtgagccttctggtatcaagaatcctggaggagccagcgcctctgcgagggtttcatcctgggattctcagtcatatgacattgaacagatatgtctgggggcttcaaatcctccttgggcctc

SEQ ID NO: 4661 - DNA, 945 bp, Homo sapiens
agtgcgtgcgtccagcggaagtgctcccccggcgcggtccgccaggccagtgccctcagcatctccaccccgaggtggtttgaactttgagccttttgtagtcctgatgaataatttcattttcctcaagtttatgacactcggaacgtcaagaactggaggtttgtgcaatttgagaccggtcggcactgtgcagagatcagagtactaagagacagagattaaaatggcttccagaggaaagacagagacaagcaaattaaagcagaatttagaagaacagttggatagactcatgcaacaattacaagatctggaggaatgcagagaggaacttgatacagatgaatatgaagaaaccaaaaaggaaactctggagcaactaagtgaatttaatgattcactaaagaaaattatgtctggaaatatgactttggtagatgaactaagtggaatgcagctggctattcaggcagctatcagccaggcctttaaaaccccagaggtcatcagattgtttgcaaagaaacaaccaggtcagcttcggacaaggttagcagagatggatagagatctgatggtaggaaagctggaaagagacctgtacactcaacagaaagtggagatactaacagctcttaggaaacttggagagaagctgactgcagatgatgaggccttcttgtcagcaaatgcaggtgctatactcagccagtttgagaaagtctctacagaccttggctctggagacaaaattcttgctctggcaagttttgaggttgaaaaaacaaaaaaatgacatggtgcagaagcttgtaacattgatcacattcttaatgtaaatggtgtctttcttctggggttttcagttattgcaaagaaatgaagagattctggaaatgcatcaataacctaagaaaaagcgacataaaaatatacttatgg

SEQ ID NO: 4662 - DNA, 2281 bp, Homo sapiens
ctaaactctgggactggcgggcggtcaggcggcacagggggaatcccgggggcctaaggaggttgtcccagtttttgtcagcatctccaccccgaggtggtttgaactttgagccttttgtagtcctgatgaataatttcattttcctcaagtttatgacactcggaacgtcaagaactggaggtttgtgcaatttgagaccggtcggcactgtgcagagatcagagtactaagagacagagattaaaatggcttccagaggaaagacagagacaagcaaattaaagcagaatttagaagaacagttggatagactcatgcaacaattacaagatctggaggaatgcagagaggaacttgatacagatgaatatgaagaaaccaaaaaggaaactctggagcaactaagtgaatttaatgattcactaaagaaaattatgtctggaaatatgactttggtagatgaactaagtggaatgcagctggctattcaggcagctatcagccaggcctttaaaaccccagaggtcatcagattgtttgcaaagaaacaaccaggtcagcttcggacaaggttagcagagatggatagagatctgatggtaggaaagctggaaagagacctgtacactcaacagaaagtggagatactaacagctcttaggaaacttggagagaagctgactgcagatgatgaggccttcttgtcagcaaatgcaggtgctatactcagccagtttgagaaagtctctacagaccttggctctggagacaaaattcttgctctggcaagttttgaggttgaaaaaacaaaaaaatgacatggtgcagaagcttgtaacattgatcacattcttaatgtaaatggtgtctttcttctggggttttcagttattgcaaagaaatgaagagattctggaaatgcatcaataacctaagaaaaagcgacataaaaatatacttatggcttgtgtttatgctcttcatcattgtgcgttgtgtgcggttacctgcttgagtgatcctgaacttgttgcgacagagggactcactggactctgttcgttatgatttgtctgtttaagagagaaaacaaagtggacttgatttttattaaggctgtttgtttttaagtgttgatagtgaacgaaaagatgtgaagtaatgatatttttctgcttacaacttatccccactcattggagtgaacagtgacgcaagctcaatagacttcataagtgttcatagaattttacaattctgagtgatcttagaaatcatttctgtttttacaaacaaggaaactgaggtccagaaagagcaagcgactttgcttaaagtcgcatcagagagctgagggtaagactcaggtgtcctgactcccagtttagtatcttttgaattttatttctgtaccatttaaaaaaaataattaacactatttgtgcaagtcagtgtttttgaaaattcagtgtcccaataaaaagtggactgcacactaagggaccatcccccagcctgtaagctgtctgtattaatggggcccgttgtatctcggaattttgaggttggaacaatgggagccctgttgagcgtttcctaaagtgacttagccgcctgcgttgtttgaccagggaagcaacaggaaatggcagctagaggccctccctgtgcgtgacctcttgtcacactcagaggggggtaactgtcagctgttatctactcttcaggttttggagaaacacaaaataagttatgaggaaaagcaaatttctctcctgagtatttacatgtctctgtatgctcaaatatgcagatgtgtccctatgcgtgtatattagcttattttttaggctctagccattttatattctttcatgtgcttctcaatattctttttctttgcactttatacaaattaaaagcatttttaaagcttcttctgtactgtaaactactaggtgctttgccaaccagacagattagaggacctccgctacactgatgccttatttggaacttaaaagaggtgaaattcatatatcataaaattcaccattttaaagtgtaccattcgttggcagaacatttacagtggtgtgcaaccatcactactctctagttgcagaacattcttatcacccccaaaggaggccctatacctattaagcagttagtccccattcccttctcctccgactgctaacaatagccactaatctgcaccctgtctctgtggatttacctattctggatatttcatataaatggaatcatatga

SEQ ID NO: 4663 - DNA, 1405 bp, Homo sapiens
ggtggtttgaactttgagccttttgtagtcctgatgaataatttcattttcctcaagtttatgacactcggaacgtcaagaactggaggtttgtgcaatttgagaccggtcggcactgtgcagagatcagagtactaagagacagagattaaaatggcttccagaggaaagacagagacaagcaaattaaagcagaatttagaagaacagttggatagactcatgcaacaattacaagatctggaggaatgcagagaggaacttgatacagatgaatatgaagaaaccaaaaaggaaactctggagcaactaagtgaatttaatgattcactaaagaaaattatgtctggaaatatgactttggtagatgaactaagtggaatgcagctggctattcaggcagctatcagccaggcctttaaaaccccagaggtcatcagattgtttgcaaagaaacaaccaggtcagcttcggacaaggttagcagagatggatagagatctgatggtaggaaagctggaaagagacctgtacactcaacagaaagtggagatactaacagctcttaggaaacttggagagaagctgactgcagatgatgaggccttcttgtcagcaaatgcaggtgctatactcagccagtttgagaaagtctctacagaccttggctctggagacaaaattcttgctctggcaagttttgaggttgaaaaaacaaaaaaatgacatggtgcagaagcttgtaacattgatcacattcttaatgtaaatggtgtctttcttctggggttttcagttattgcaaagaaatgaagagattctggaaatgcatcaataacctaagaaaaagcgacataaaaatatacttatggcttgtgtttatgctcttcatcattgtgcgttgtgtgcggttacctgcttgagtgatcctgaacttgttgcgacagagggactcactggactctgttcgttatgatttgtctgtttaagagagaaaacaaagtggacttgatttttattaaggctgtttgtttttaagtgttgatagtgaacgaaaagatgtgaagtaatgatatttttctgcttacaacttatccccactcattggagtgaacagtgacgcaagctcaatagacttcataagtgttcatagaattttacaattctgagtgatcttagaaatcatttctgtttttacaaacaaggaaactgaggtccagaaagagcaagcgactttgcttaaagtcgcatcagagagctgagggtaagactcaggtgtcctgactcccagtttagtatcttttgaattttatttctgtaccatttaaaaaaaataattaacactatttgtgcaagtcagtgtttttgaaaattcagtgtcccaataaaaagtggactgcacact

SEQ ID NO: 4664 - DNA, 961 bp, Homo sapiens
aggccagtgccctcagcatctccaccccgaggtggtttgaactttgagccttttgtagtcctgatgaataatttcattttcctcaagtttatgacactcggaacgtcaagaactggagagattaaaatggcttccagaggaaagacagagacaagcaaattaaagcagaatttagaagaacagttggatagactcatgcaacaattacaagatctggaggaatgcagagaggaacttgatacagatgaatatgaagaaaccaaaaaggaaactctggagcaactaagtgaatttaatgattcactaaagaaaattatgtctggaaatatgactttggtagatgaactaagtggaatgcagctggctattcaggcagctatcagccaggcctttaaaaccccagaggtcatcagattgtttgcaaagaaacaaccaggtcagcttcggacaaggttagcagagatggatagagatctgatggtaggaaagctggaaagagacctgtacactcaacagaaagtggagatactaacagctcttaggaaacttggagagaagctgactgcagatgatgaggccttcttgtcagcaaatgcaggtgctatactcagccagtttgagaaagtctctacagaccttggctctggagacaaaattcttgctctggcaagttttgaggttgaaaaaacaaaaaaatgacatggtgcagaagcttgtaacattgatcacattcttaatgtaaatggtgtctttcttctggggttttcagttattgcaaagaaatgaagagattctggaaatgcatcaataacctaagaaaaagcgacataaaaatatacttatggcttgtgtttatgctcttcatcattgtgcgttgtgtgcggttacctgcttgagtgatcctgaacttgttgcgacagagggactcactggactctgttcgttatgatttgtctgttta

SEQ ID NO: 4665 - DNA, 5495 bp, Homo sapiens
acaaaggccgcgcggtgacccgccctctgccgcgaccccggccccgcccctgccccggccccggcctggcccggtccctgcacctgccggaggccgcccgccgccatcgccagcgccgtcgcttggctgcgctgaccgggaagcagttctcggcggtccgcgcggtgattcatcggcctggccgcgtcccccgcgcgggccatcttggtcacggccggcggcggacagagccgcggaggaaccgcgagaccccagggcccagagcaggtccagccacccgtctggctccgtagtccgcgaagtctgcagtaaaggagccgcgtgggaccggggccgaagtccctagggcctggcaccgcgtgcccctctctcgggccctcggcttgggggtctcgcagcgccctgccgtcgtgcaccccacactgcccccatttctacaggggcccacctggtcaccacaccctcttggtccacccgcggatctcagcgtgtggctgacctctggccagcatggtgcagccgcagacgtccaaagctgaaagcccagccttggcagcgtctccgaatgcccagatggatgacgttattgacaccctgacctccctgcgcctcaccaactcggcgctgaggcgggaggcttccaccctgcgggcggagaaggccaatctcaccaacatgctggagagcgtgatggcagagctgaccttgttacgcaccagggcgcggatcccgggggctctgcagatcaccccgcccatctcctcaattacttcaaacgggactcgacccatgaccacacctccaacctctctgcccgagcccttttccggggacccaggccggttggcggggttcctgatgcagatggacagattcatgatcttccaggcctcccgcttcccgggtgaggccgagcgtgtggccttccttgtgtctcgactgactggggaggcggagaagtgggctatcccccacatgcaacctgacagccccttgcgcaacaactatcaggggttcctggcagagttgcggagaacctacaagtctccgctccggcatgcgcggcgcgcccaaatcaggaagacttctgcctctaatagggctgtgcgagagaggcagatgctctgccgccagctggcctctgcgggcacggggccttgcccagtgcatccagcttccaacgggactagtccagcgccagccctgcctgcccgagcacggaatctttaagaatccgccagcacttggtagcgtctgcagccacccaggtagcatacgctctttgctgtgtagaagaaatgcccatacgacagctttgcccctgtttgaagacctcccttcttgcctctccagacgtgttccccgaggagatcttccttccgtccttcctggcgccctggttgcccaccttgccgtgcttcctcttacgtgctagctttgtacctatcgctcactgcatgctcgcctccctcttgctggcatcccggcctgtttcaatgactaccgctctgctacttaggcacagggactccgccgcacgctgacggaccacgagggctgaccccttccagcctgacttggttcatggaggctcctactctgccctctccaagctcccctggcggctccccacctggttgcccagttcctattgatgagctctggacagaaagatgcccgtttggccaggctggtggcttgatgggtgtacctggagagggggtctggcttcctgcccaagatgcctcccagccctgccagggcccggtgcagcgggcagggcctcatctgtgctgtagtggtcgagtggttgctgcaaggagcgtagttctgccatgtctgggggccaggttccactctgcacatgaatatgcagtctgggaggccccactgctctcactgggaaggaccaatgttgcacctctgttaatgcctgacttcagctgctggtgttctgatggagccagaggcttggggaatctggaacttgcctgctaaataaggtcgtggtggactctcagccattgggcaggtctatcaggctgcaggttcctacacacccacgcctgagggtcatagcaggctaagggtggataccagcgactccctttgctgcccaggatctccatgggcagtgccacagcggctgatgctcagtcactcctgcttctaccccctgtcactgatggcgagccttgcccagcttgagacctgttcccatctctattcaggtgccatgtggccttcactgcagccctgcagccacccacgcaccatctgtgggtctccaaaggcaccttgtagcatgtactccccgtgcctgggcaatcagatgggctgcctttgtccaagggaaaacagactcccttcgggaaacatccttaagcacttaaggccggggggggtgtctgcctctggcaacccagccagggtcttggtggcatttgtaaaagcaaagagctgtggactgccgtggtcctagtgtggtgacaatgcagcactggcatgcatgtcctccttctgaaggacctcatccttcctcacagggggatgaccaagaaatcattttgtggctgagtttggccacgccctttggactgtgctgttccgccatatttcaatgccaaatgaaccacattgacatgacctggaccatagggcttcctatcctgggctcagctgcccctgtctgaagggtcttggcttgattgcagaaggacaacctccgcacccacctaaagacatgtatatgtcttgggatcccagagattgggtccttgggcctggcttcttaagagttttgatgatgctgggaaaagtgactgcgattctgaagaaccgctgccttgcaaggtcaaggacattcagtggttgctggggtccgcagactactgccacccactcaccatcaactctgttagcccaattgccctgctgaacaactgcctgaatacaggctttaggttcccctggactccagccaaggctgttcaggtgggaccatggtgctctttaagcgtgatcggagggaagacacacagcagggccaccattccatgaatgggaggtgtacagatcactttctctttgtgctcagttctgttctgtctccagcagctatattggtaagactagtacctgccagggagaggtgcccccaagtgaaggggtacagtggcacctgggaaaaggcacctggaaggtttccatgtggcccagcccagcatggaagcagggtgggaactctgctgtgtcgccagcgctcactctactcgagtggctttttgaaagccctaccatgtctgtgtcaggcctgtgctgcttcacatcctacagctgcctaggaaaggccggccacgctccctgtccacacactccctgtccacacactccctgtccacacactccctgtccacaactgcagccgggccctctgcctatgggcacccaatccaagcagctgctccacctttgtttggcatggtgatttgtgttttttctcttggtgcttatgtgtgtgggcttgggacgagtgctggtatgcacttaggaccttcttgatagctccctgcactttggaacacggagcagatgagagagggtcggggcttgccctccaccttggacttggaagaagcccacattggagaggtgaggaccccatggtggctctagtggaagatacgttagtctccagctaaggaggatgaggcgcagccccagagggagacctcagtgataggggatcaggctaagaaagtgggggaagggagatgctttgtacatattttggggttataatttctctaaattttaggagaacgggtattgattgataaaagggacaggcagtagtgttcaacagtgcatgtgaaggaaagttctgttttccatggttttgacattctttggactgtattgtgactgctgtctggtccacatggtacccctttggtaagtaggcttcagtgcataccagggtatcactggagatgggagttagtgaaggggtgactccctggcctagtatagtgtgaccctgggactaacttaatgtcctaaagcattttggtgacttctagggaatagcaaagacctatttcattgtccccaggtaagtatgtgatgagcaatgaggaggagtggaaaacaaaacccagaaagtgcggcaggaccagcctgacgcacacgctcctgttgtcatggcagacagccgccttgggtgggcaccaccctggcagttccagcctgtaggggagtgaagggacatggctgagctgggcatgtgctgaggttgacttagggaacaagccctgggattggacaaaagggcccatgctgcagccactgactgggggcagagctctgggtggaagagggaagagatcctaatggaggcgcctccatctgcaaccacagttgtaaggctcatggcacctctgcttggaaagcactggtttagggacttagagaggtaggcacaaggtgggtctcctgggtaagggaagcaagagcagactgttgggccaacaggagaagctccccagagtaggggagaaggttggggtgtagggccttccacgtggaacagacagcccctgtgtctctgtctcttggggacctgagtttgggtggggtggcagttggcacagcgcagatgcggtagagatgggaggaaacccagctcctcacttccgtgtgcctcatgcctttgcatacacaagcaccaaacctactaggtcttctcattacccatgtaaaccacatgttagataaatttttgcaagtagaggaaagaaggaaataaaacatcacattttggtgtctctcaggctttcccccccaactatggtttctttgctttttgttttaacatagttttgttgctgtcttctgtaatgatacagttttgtgcagctgttttcacttagcatatcgtgggcatctccccttatgattactaaatattttattttggagtggctgtgtactctcccattgactagatggaccattgtgccagttgccaatcactaatgctgttactaacttttcagttataaattgatgaatatctttgtgcacaggctgtttcccaatgtcaagttattagggtagactccaggaggtgggattcttcaactaaagaatatgaaaacctttgaggcttttactacatattgacaaaatggtttccggaaatatttgtatccccttacactgccaccagcaaggataaacatgtccatcttgcccgtattgggaattatcatctggctaaatatttgctaatttgataatgaaaaaatagcatcgtgtttcagttggcatttcactgacttctagcacggttgaacatctttcatgtggagcgattgtatttcctcctttgtggattgtcagtgtcctttgctctatcttctggggtcagataaatttgtatgagctcggtatatattaaagatattaacctggtgtgtgtcatatttgctaca

SEQ ID NO: 4666 - DNA, 2572 bp, Homo sapiens
agccgactggcggcgcggtcgcccgggagaccgggaaagccgtttcacacccgtcctagtcgaagtcgagatttcctttggcttcaaagctctctcaccatattttgggaagttatggatcatcacattcccatgcatgcgttgcctgaagaaatccaaaagatgttgcctgaagaaaaagtttgtaagtactgtggagtcagctatctaattcttcatgaatttaaggctatggaagaaaaagtgaaagcaatggaaaaagagatgaaattttatcaaggaagtgtagatcgtgaaaagagacttcaagaaaagctgcattctcttagccaagaacttgaacagtacaaaattgacaacaaatccaaaacagaaagaatttacgatgtaggcatgcagttaaaaagtcaacaaaatgaatttcagaaagtaaagaaacaactgagtcatttgcaagatgagctaaaaattaaatatagacaatcatacatcttcagtcaaagattgtcagagtacaaatatttctggaataagactctttcattacttacttttactaaaagggaactaaccagtattaaaaatgaagtatatgataattaccaaaactggacttcattgaaaggagcagtttttctacaaattaaatctataagtgaaacagccttgacagaaatagacatactgaataaaagtttgacagtatcccagagaaataaagtatgccttgaaaaggaaatgaaaaatctgaaattgttgtcagatgcagccatattgagatctcagcagattcggacatctagacaacaggaagtaaacttgcaaaccagatgctatgatttgcaaaaagaagtactagatttacaatgtctagtagaggcacttggattaaaacttcagaaggcggtgacagagatggacaactataaagaaatgcttatgaataaatctaatgaagctgatgactgtcaaagagaacttaaaaaactgaagtttgaatccattatttctgagtcacagcatactatgctgcttaaggaaaaagaagactctttaatgacttgtcaacagatatataaagcattacaggaagagctgactgtgaaagaaaagcaagaagaagacataaagagaagaattaaccttgcagaaaatgaactggagataaccaaaactcttctgaatcagacaagggaagaggttttaacactgaaaaatgaaagggaattgatgctgatttcacatcagaaaagcatcgagcagctgcaagaaacccttagacagaagctgctgagtgatgataactggaaggagaagattgaagcagaacttgccaaggaaagggcccaacacttggttgaatttgaagagcaagctcttctctttaaggaagaaacaaaattgcaacttgatattgaaaaagaaaaacaccaagatgtaatccaaaagtataagaaagaacaagaggaactacaaatgaagatatctgacttaatcacaggcgctacaagagatctaaggcaggaagtgaccactcttaaagaaaaacttcacaaatcccatattcggtacactgaagaatctaattcaaaggaaaaagaaattgaaaatcttaaaaatttggttgcagaatttgaatctcgcttgaagaaggaaattgacagtaatgattcagtttcagaaaacttgaggaaggaaatggaacagaagtcggatgaactgaaaagagtaatgctggctcaaacacaactgatagagcaatttaaccagtcccaggaagagaatacttttcttcaggagacagtgcgtagagaatgtgaagaacgctttgaactgacagaggctttgagtcaagccagagaacagctcctggagctcagtaagcttcgtggaagtttaccattctcaccgtgttccctcagcaagggcagcctaacctcccctgctgcagcagtcagtaatcatggagagagaagccttgcaagactgaactctgaaaaaggaatccaaattcccaacctgcgcggggtgtcaaaacccaccactttcccaacctcagataagccgaagagggttagatcaggcgtgcccattctcccccagccacatcctcccaggggtggagcatcttcagcaaatgagactagacagagactggctgccattcttaggagaaggcggagtcagcaatgatccaaaatgaggagcaggaagctccctacagcgtgcacgctctttcagagagtgccaggaattcactgtaactgagaatgacaatgataaaattattttcacagatcaggaaggcatacctatagatgtatttaacaaaagactgtaaaaagctggaaaattgtgaagccttatttttcaagagggttttgatagagtaacagatcattaagttgttggtattccagaggtccgatttctatgtttatgttggaatgtgctctatgaatatagccttttagagatcacaggtaaaatttttcacccataacatcttttcaatttcttgcgccactacaagcagatatatttccacaaaaaaatagattgtttgagattt

SEQ ID NO: 4667 - DNA, 2881 bp, Homo sapiens
agccgactggcggcgcggtcgcccgggagaccgggaaagccgtttcacacccgtcctagtcgaagtcgagatttcctttggcttcaaagctctctcaccatattttgggaagttatggatcatcacattcccatgcatgcgttgcctgaagaaatccaaaagatgttgcctgaagaaaaagtttgtaagtactgtggagtcagctatctaattcttcatgaatttaaggctatggaagaaaaagtgaaagcaatggaaaaagagatgaaattttatcaaggaagtgtagatcgtgaaaagagacttcaagaaaagctgcattctcttagccaagaacttgaacagtacaaaattgacaacaaatccaaaacagaaagaatttacgatgtaggcatgcagttaaaaagtcaacaaaatgaatttcagaaagtaaagaaacaactgagtcatttgcaagatgagctaaaaattaaatatagacaatcatacatcttcagtcaaagattgtcagagtacaaatatttctggaataagactctttcattacttacttttactaaaagggaactaaccagtattaaaaatgaagtatatgataattaccaaaactggacttcattgaaaggagcagtttttctacaaattaaatctataagtgaaacagccttgacagaaatagacatactgaataaaagtttgacagtatcccagagaaataaagtatgccttgaaaaggaaatgaaaaatctgaaattgttgtcagatgcagccatattgagatctcagcagattcggacatctagacaacaggaagtaaacttgcaaaccagatgctatgatttgcaaaaagaagtactagatttacaatgtctagtagaggcacttggattaaaacttcagaaggcggtgacagagatggacaactataaagaaatgcttatgtaagatggagaatattaaacaacttataacagtgctctgtagatgtgttacaaaatggcaagaattaggaagaaatgacaagaattataaagaccctgcctgggcaacacggagaaactttgtctccacaaaaaaatacaaaaattatccatgcgtgttggcacactcctgtagtcccagctactcgggaggctgaactgggaagatcacctaagcctagaaagttgaagctacagtgaaccatgatcatgccactacactccagcctgggcgacagagtgagaccctgtctcaaaatgaataaataagaataaatctaatgaagctgatgactgtcaaagagaacttaaaaaactgaagtttgaatccattatttctgagtcacagcatactatgctgcttaaggaaaaagaagactctttaatgacttgtcaacagatatataaagcattacaggaagagctgactgtgaaagaaaagcaagaagaagacataaagagaagaattaaccttgcagaaaatgaactggagataaccaaaactcttctgaatcagacaagggaagaggttttaacactgaaaaatgaaagggaattgatgctgatttcacatcagaaaagcatcgagcagctgcaagaaacccttagacagaagctgctgagtgatgataactggaaggagaagattgaagcagaacttgccaaggaaagggcccaacacttggttgaatttgaagagcaagctcttctctttaaggaagaaacaaaattgcaacttgatattgaaaaagaaaaacaccaagatgtaatccaaaagtataagaaagaacaagaggaactacaaatgaagatatctgacttaatcacaggcgctacaagagatctaaggcaggaagtgaccactcttaaagaaaaacttcacaaatcccatattcggtacactgaagaatctaattcaaaggaaaaagaaattgaaaatcttaaaaatttggttgcagaatttgaatctcgcttgaagaaggaaattgacagtaatgattcagtttcagaaaacttgaggaaggaaatggaacagaagtcggatgaactgaaaagagtaatgctggctcaaacacaactgatagagcaatttaaccagtcccaggaagagaatacttttcttcaggagacagtgcgtagagaatgtgaagaacgctttgaactgacagaggctttgagtcaagccagagaacagctcctggagctcagtaagcttcgtggaagtttaccattctcaccgtgttccctcagcaagggcagcctaacctcccctgctgcagcagtcagtaatcatggagagagaagccttgcaagactgaactctgaaaaaggaatccaaattcccaacctgcgcggggtgtcaaaacccaccactttcccaacctcagataagccgaagagggttagatcaggcgtgcccattctcccccagccacatcctcccaggggtggagcatcttcagcaaatgagactagacagagactggctgccattcttaggagaaggcggagtcagcaatgatccaaaatgaggagcaggaagctccctacagcgtgcacgctctttcagagagtgccaggaattcactgtaactgagaatgacaatgataaaattattttcacagatcaggaaggcatacctatagatgtatttaacaaaagactgtaaaaagctggaaaattgtgaagccttatttttcaagagggttttgatagagtaacagatcattaagttgttggtattccagaggtccgatttctatgtttatgttggaatgtgctctatgaatatagccttttagagatcacaggtaaaatttttcacccataacatcttttcaatttcttgcgccactacaagcagatatatttccacaaaaaaatagattgtttgagattt

SEQ ID NO: 4668 - DNA, 3008 bp, Homo sapiens
agaaatatggcttcagtttttcattacttcctgttagttctggtctttctggatacacacgcagctcagcctttctgtctgccaggatgcacttgctcagaggagagttttggcaggactctgcagtgcacatctgtctccttgggaaagatccctgggaacctttctgaagagttcaagcaagtgagaattgaaaattcacccttatttgagatgccccaagggtctttcatcaacatgagcaccttggaatacctctggctcaattttaacaatatcagtgtgatccacctaggagccctggaacacctgccagaactgagggagctgagactggaggggaacaagctctgctcagtaccatggacagcgttccgtgccacccctctcctgagggtcttggatctcaaacgcaacaagattgatgcactccctgagctggctcttcaattcttggtcagcctgacctaccttgacctatcctccaataggcttacagttgtatccaagagtgtcttcctgaactggccagcctaccagaaatgccggcagcctgactgtggggctgagattctctccagcctggtggtggccctgcatgacaacccctgggtatgtgactgtcgcctaagggggcttgtccagtttgtcaagtccattaccctcccagtcatcctggtgaattcctacctgatatgtcagggccctctgtccaaggcagggcagctttttcatgaaactgagcttagtgcttgcatgaagccacagatctcaacccccagtgccaatatcaccatccgggcaggacagaatgtgaccctgcgatgcttggcacaggccagcccctcaccatccattgcatggacttatcccctgagtatgtggagagaatttgatgtgttgacatcttctactggagaagacactgctctgtcagagctggccatacctgctgcccacctggtagacagtggtaattacacctgcatggcctccaactccattggcaagagcaaccttgtaatctctctccatgtccagcctgcccaggccctacatgcacctgattctctttccatcccctcggagggcaatgcctacattgacctgcgggttgtcaagcagacagtgcatgggattttgctggagtggcttgcagtggctgacacctctaaggaggagtggttcaccctctacattgcatcggatgaagccttcaggaaggaggtggttcacattggccccggaatcaatacttatgctgtggatgacctccttcctggcacaaaatatgaggcctgcctcagcctagagggccagcctccacaccagggccagtgtgtagcttttgtaacaggcagagatgctggtgggctagaggcacgtgagcacctcctgcatgtcacagtggtcctgtgtgtggtgctgcttgcagtgcctgtgggcgcctatgcctgggcagcccagggcccctgcagctgcagcaagtgggtcctgcgcggctgtcttcatcgcaggaaagcccccagctgcacccctgcagccccgcagtccaaggatggctcctttagagaacatccagctgtctgtgatgacggtgaagggcacatagacactgagggggacaaggagaaaggaggaacggaagacaacagctgaacaacccaggccatggggtggaaacggcttgggcttcaagcctctgaaaccaaccctctgcagcagctccatccatttatccagcaagtatatattgagcacccactgtgttccaagcactgaacttgacacagggggttcaagagtaaaaagggaaacagagtctttatcttcatgataaaggggacatagtcattatcttcgtaaagttaaagtcaatgaagatttgtccatcaaattaatcattttattatacatggtgattagaaatcactaaatattactctttgcatatacttagcctataacatttacatgcttatacgtaatgtctacgtataatattttacatatattatcctgtaaacgaaggtagacttctacccactttttataggtgaaaaactgcagcctggacagttcaatgatacacccagagtccacatctggcaggaggcagaagccccattcaaaagaggttccagttccatcgtttccttgaatgcctgttttgcggtattcttgtgtctttcattgtttataaagtgtgaccctctctcttcatgacaaactcctaatgagatcacataaatgtgatgttccaaagagctgcccatcagggtgatgagagctgttgggtaatgtgagtctctttttgtaggtgtctgttcccctgtgagcacagcccttggtgctgctgggcaggctggagccatcagcaccaaggaagagtaggggattggctgcagccctgggtctggcagagagcagactctgcagggccatacccagaaggaagagcacccatacgtccgctgctttcccctagtcaatgtctaaagccctcctatgaaatccatgagaggtggtcatttcctcttagccggacccatgtggaatggaggggccccaagaatcccaacatcagctcatcatcccactgaacagcccttctaggggagaccattcccaggatttaattcacatctgtctccctgccgtttccctcactggccacatgcaaacctttctaagagtgtaaacatgaactagactcattgtgacatctccacacgtttcctccttcccaccttttttacccattcctaatcatccttttaggcctctctcaagtgtgtacattacgtcttccacagagctttccttgacttcacacctctggggaaaaggacagtatgcacattgtgtccattggttgtgagacatttgcaggcaaagactgaccttcctcacggtggccactgcactcgtctaatacctggattgtgttcataatcaatgttagttaacaataaattttaaaaaattgaagatggctctcattttca

SEQ ID NO: 4669 - DNA, 2380 bp, Homo sapiens
aggatttgccactcggaagctggggcgatacttattcaaaactcacaacgtattttcttacagagaaatatggcttcagtttttcattacttcctgttagttctggtctttctggatacacacgcagctcagcctttctgtctgccaggatgcacttgctcagaggagagttttggcaggactctgcagtgcacatctgtctccttgggaaagatccctgggaacctttctgaagagttcaagcaagtgagaattgaaaattcacccttatttgagatgccccaagggtctttcatcaacatgagcaccttggaatacctctggctcaattttaacaatatcagtgtgatccacctaggagccctggaacacctgccagaactgagggagctgagactggaggggaacaagctctgctcagtaccatggacagcgttccgtgccacccctctcctgagggtcttggatctcaaacgcaacaagattgatgcactccctgagctggctcttcaattcttggtcagcctgacctaccttgacctatcctccaataggcttacagttgtatccaagagtgtcttcctgaactggccagcctaccagaaatgccggcagcctgactgtggggctgagattctctccagcctggtggtggccctgcatgacaacccctgggtatgtgactgtcgcctaagggggcttgtccagtttgtcaagtccattaccctcccagtcatcctggtgaattcctacctgatatgtcagggccctctgtccaaggcagggcagctttttcatgaaactgagcttagtgcttgcatgaagccacagatctcaacccccagtgccaatatcaccatccgggcaggacagaatgtgaccctgcgatgcttggcacaggccagcccctcaccatccattgcatggacttatcccctgagtatgtggagagaatttgatggattgctgggaggcaaacacctgacaccagtgttgacatcttctactggagaagacactgctctgtcagagctggccatacctgctgcccacctggtagacagtggtaattacacctgcatggcctccaactccattggcaagagcaaccttgtaatctctctccatgtccagcctgcccaggccctacatgcacctgattctctttccatcccctcggagggcaatgcctacattgacctgcgggttgtcaagcagacagtgcatgggattttgctggagtggcttgcagtggctgacacctctaaggaggagtggttcaccctctacattgcatcggatgaagccttcaggaaggaggtggttcacattggccccggaatcaatacttatgctgtggatgacctccttcctggcacaaaatatgaggcctgcctcagcctagagggccagcctccacaccagggccagtgtgtagcttttgtaacaggcagagatgctggtgggctagaggcacgtgagcacctcctgcatgtcacagtggtcctgtgtgtggtgctgcttgcagtgcctgtgggcgcctatgcctgggcagcccagggcccctgcagctgcagcaagtgggtcctgcgcggctgtcttcatcgcaggaaagcccccagctgcacccctgcagccccgcagtccaaggatggctcctttagagaacatccagctgtctgtgatgacggtgaagggcacatagacactgagggggacaaggagaaaggaggaacggaagacaacagctgaacaacccaggccatggggtggaaacggcttgggcttcaagcctctgaaaccaaccctctgcagcagctccatccatttatccagcaagtatatattgagcacccactgtgttccaagcactgaacttgacacagggggttcaagagtaaaaagggaaacagagtctttatcttcatgataaaggggacatagtcattatcttcgtaaagttaaagtcaatgaagatttgtccatcaaattaatcattttattatacatggtgattagaaatcactaaatattactctttgcatatacttagcctataacatttacatgcttatacgtaatgtctacgtataatattttacatatattatcctgtaaacgaaggtagacttctacccactttttataggtgaaaaactgcagcctggacagttcaatgatacacccagagtccacatctggcaggaggcagaagccccattcaaaagaggttccagttccatcgtttccttgaatgcctgttttgcggtattcttgtgtctttcattgtttataaagtgtgaccctctctcttcatgacaaactcctaatgagatcacataaatgtgatgttccaaagagctgcccatcagggtgatga

SEQ ID NO: 4670 - DNA, 3693 bp, Homo sapiens
gtctgagactgcgagagggtcgtaaccatgaggggttcctgtgagaggtctggggaggatgaagagcagaaagaagaggctatggtggcctgtgggcgtctttcaggggtccccgaggccgagcagggtcccgaggccaattgggactccgacctggagacggaaggcaccgatgggcttggagaactggtcagggacacactgtacctgaggtcttgccgggcccatagtgttgtgcccatctcctgctttctgcgccaagggagcgcccaagagctgaacctccggcaccgtggcctggggccccagggcgcccgggctctggcttcctcattgagctccaatccatatgtcaagcggctggaccttcgagacaatgggctctgtggggcaggtgcagaggccctggcaggtgccctgagcaaaagcagcagcatccatgatgtggacctgtcggagaaccagctgggagtggcaggagcccaggccctctgtgccgccctcacagtgaaccaggccatgcggaagatgcagctgtcagggaatggcctggaggagcaggcggcccagcaccttgccgaactcctgctggcccacacagacctgaagtccctggacctgagctacaaccagctgaatgaccaagcaggggagacacttggaccagccctggcagaaaacacaggactcaccgagcttaacgtgagctggaatcacctccggggcccaggagctgtggcatttgccaggggactggaggcaaacatcttccttaaagttctagacatctcatacaatggctttggggatcctggagcctctgcggtgggtgaggctctgaaggccaacaacgtgttggaggaactcaacatgagtaacaaccgcatctctgcgatgggagccctgagcctgggcctgggcctccgggtcaaccagacgctgaggattcttgtgtccaggaatcccatgcgaagtgaaggctgctttggtctcctcaagtctgtccaggacaatccagcctctgccctggaactgctggatttctcagatatccaggtgaacgcagagtttgatggccttgctagctcagtgaggggaattcttccagaactctgcataaagactggcgcttgcagagtggagtataaaaaggagttgctgccagtcttcagatcagccctgccagcgtctgtccctaagtgaccttggagtgtggcttcctcatctccaatcagctgctttgacctccagggtatatacttgaaagaaatgaagacatatgtccccacaagaactcgtgcatgaatatccatagcaacattatttataatattctaagagtgaaaatgcccaccagtggataaatgcaatgtggtatatccatacagtggaatattatttggcaataaaaaggaatttgaggtgataccaatgttctaaaatgtattgtggtgatggctacgtaactgtgcatattctaaaggcaattgaattacagatgctttacatgaatgaaccgtatggtatgtgaacggcatctcaataaaactgtttcgaaaagaaggaaaaggacggacacatgctgaaaacgggtgaaactagaaaacatggcgctaagtgaaagaagccagccacaagatcacgtgtcgcatgaccgcatttatgtgaaacatccggagtatgcaaatctatacagacagaaagtagattatacattgcctaggtgcagagaaatggaagtattggaggttgacggctaaaggatgtggatttctttggggggtgataaaagtgttctaaaattgattgtggtgatgtgcgactctatgaatacgctaaaaaccgctcgattgtacattttaaatgggtgatttatgcggtatgtgaaatacatctcaagaaagctgctgcaaaaaatatcatacgggttgagcctagtggtattaaaaaagtataaatatggccaggcgcggtggctcacgcccataatcccagcactttgggaggccgaggcgggcggatcacgaggtcaggagatcgagaccatcctggctaacatggtgaaaccccgtctctaccaaaaatacaaaaattagccgggtgtggtggtgggcggctataatcccagccactcgggaggctgaggcaagagagttacttgaacacagaaggtggaggttgcagtgagccaagctcacttcactgcactccagtctgggtgacagagcaagactcggtctcaaaaaaaaaaaaaaaaaaaaaaaggaagaatcaggctcagcgcactggcacatgcttataatcccagaaatttgggaggccaagatgggaggatcacttgaagccaggagttccagaccagcctgggcagcatcgtgagacccccgtttctacaaaaaacatttaaaaattagctgggcatggtggcatgtgcctgtcgttccagctacctgggatgctgaggtgggaggatcactcaaacctgggagtttgaagctgcagtgagccatgattgcaccactgcactccagtctggttgagagagtgggaacctgtctcgaaaaaaaaaaaaaaagaatggaaggatcaaactgggcatggtgatgcatgcttgcctgtaggcccagcctacaagggacgctgaggcaggaggatcatttgagcctgggaatttgagcccagcttgagcaacatagtgaaatcctgtctaaaaaagaaaaaaaggaagaatcaaataattgttccaaagtctttcaaaaggagtattgagtcccaactcggcactttcctgagcagggatatgtctcctctccttctcactaaggagccagaaactcaccccttctcactaaaaaagtgagaaaaataaaaatagctcagagaactttgagctatgtgaggcacgcagaatttatcaggtccggagacatgaatatgggacttcaggcagggcatgatggctcacgcctgtagactcaggaggccaaggtgagcccaaggtgggaggatcactttagtccaggagttttgagaccagcctgggcaacatcaggagatccttgtctcctcaaaaacttaaaaaaaaaaaaagctgggcatggtggcacacacctgtggtcctgagtcaggaggttgaggctgcagtgagctatgaccataccagtgcattccagcctgggtacacagcgagaccctgtctcaaaataataataacaataatatgctgggtgcagaggctcattcctgtaatcccagctctttgggaggctgaagtgggtgaatcacttgaggtcaggagttcgagactagcctggccaacatggtaaaaccctatcttttctaaaaatacaaaaattagccaggtatggtggtgcatgcctgtaatcccagctacttgggaggctgaggcaggagaatcgctggagcccgagaggtggaggttgcagtgagccgagatcatgccactgcactccagcctggatgacagagcaagactctgtctcaaaacaaaacaaaacaaaacaaaaaaataataattataataatgaaaagaaaaagaaatgaatatgggacttcagtaacatatttcttatccatgcccgggggcaattgtttaaaggcattttgttcctgactagcttaacccattatcttcctgtttctggaatttatgatacaaagaataatgtatag

SEQ ID NO: 4671 - DNA, 3226 bp, Homo sapiens
gtaaccatgaggggttcctgtgagaggtctggggaggatgaagagcagaaagaagaggctatggtggcctgtgggcgtctttcaggggtccccgaggccgagcagggtcccgaggccaattgggactccgacctggagacggaaggcaccgatgggcttggagaactggtcagggacacactgtacctgaggtcttgccgggcccatagtgttgtgcccatctcctgctttctgcgccaagggagcgcccaagagctgaacctccggcaccgtggcctggggccccagggcgcccgggctctggcttcctcattgagctccaatccatatgtcaagcggctggaccttcgagacaatgggctctgtggggcaggtgcagaggccctggcaggtgccctgagcaaaagcagcagcatccatggtaggtgctgggtctggggcaggtgggcaggcgtgtcctccttttcctcagggatgtgcctccatcgttgaaagctgggccgtgtcacctggggcctgctggtgttgctggtggatagaagaggggcctcatcacaggagggggcatgtggggtggagttagaccctctgctgtgcagccgatgcctgatagaagtcctttcctcacccaccccacaccatcactcccctcccttgctggccagcatccccctcttcacctagcacatgggagactcccagtacctgaatgcaggatgggagagtccttccacacagagaggtgggagttgggcattgtaagaagcaggtaggcaatgtgggagtttgatggggctggatccaaatgccagttctgccactgaagagctggatacctgggcaagcagcttaacctctctgagcttcagtttctgatctgtgaaatggcccccaaaataccttatgggcttggggctgtggtgagcatgaagtgaaatgcactcctgaagtggtcagaagagtgtgtgacccatgtacgtgctccatgcatggccacttgggctattattgccaatcctggcaacggggctgtgagggcttctgaagtgggtggtgatatcactgccagatgcagccatcgacggtatagctgccccccaccacagcagtctctacagtaccaggaggtaggcggttttaaccacttgacacagaagctggtgggcacacagggagggggaggtcaggggcagaggggacccagccattgggagccagagccaccatgcaaccccaggacagttaacctgtaagtccccttcctcagcctcagacctggaggtttgggggatggcagaagtaggggagtgcctggctttgcatcccactggccgaggagtggttctgtcccccagatgtggacctgtcggagaaccagctgggagtggcaggagcccaggccctctgtgccgccctcacagtgaaccaggccatgcggaagatgcagctgtcagggaatggcctggaggagcaggcggcccagcaccttgccgaactcctgctggcccacacagacctgaagtccctggacctgagctacaaccagctgaatgaccaagcagccacacggaactcttcattccttccacaaatatctcattgcgcgctgctgtatgtgctgggcactgacttagccaccagggatccaccttgaacaaaaccaagttcctgacctcaagggacaatgttaacaacatcattctgagggagacacttggaccagccctggcagaaaacacaggactcaccgagcttaacgtgagctggaatcacctccggggcccaggagctgtggcatttgccaggggactggaggcaaacatcttccttaaagttctagacatctcatacaatggctttggggatcctggagcctctgcggtgggtgaggctctgaaggccaacaacgtgttggaggaactcaacatgagagacagtctcctgctggccttgaactcttgggctgaagcagtcttcctgcctcagcctcccaaagtgctggaattacagtcatggggagttcatcgttgttacatagagacctgtgattcctatagcacaggcggatggctgcgaattgcacacggtgtataaagcatctccggcagagcctggtgcatgtaacaaccgcatctctgcgatgggagccctgagcctgggcctgggcctccgggtcaaccagacgctgaggattcttgtacagcctcaccagagcattctgtctgactatctgatggagacaccttctgagccgaaacagtgtggccatagtggctgtgtcctcagagatgaggagcccctccttccctttcacattgctctctggccttcccggacctggcttctcgcagctttgtgtgcgtgtttctcaggtgtccaggaatcccatgcgaagtgaaggctgctttggtctcctcaagtctgtccaggacaatccagcctctgccctggaactgctggatttctcagatatccaggtgaacgcagagtttgatggccttgctagctcagtgaggggaattcttccagaactctgcataaagactggcgcttgcagagtggagtataaaaaggagttgctgccagtcttcagatcagccctgccagcgtctgtccctaagtgaccttggagtgtggcttcctcatctccaatcagctgctttgacctccagggtatatacttgaaagaaatgaagacatatgtccccacaagaactcgtgcatgaatatccatagcaacattatttataatattctaagagtgaaaatgcccaccagtggataaatgcaatgtggtatatccatacagtggaatattatttggcaataaaaaggaatttgaggtgataccaatgttctaaaatgtattgtggtgatggctacgtaactgtgcatattctaaaggcaattgaattacagatgctttacatgaatgaaccgtatggtatgtgaacggcatctcaataaaactgtttcgaaaagaaggaaaaggacggacacatgctgaaaacgggtgaaactagaaaacatggcgctaagtgaaagaagccagccacaagatcacgtgtcgcatgaccgcatttatgtgaaacatccggagtatgcaaatctatacagacagaaagtagattatacattgcctaggtgcagagaaatggaagtattggaggttgacggctaaaggatgtggatttctttggggggtgataaaagtgttctaaaattg

SEQ ID NO: 4672 - DNA, 4923 bp, Homo sapiens
attgtcgggggctattctctctcccaggaacatggcggcgagtcagggaggaggcggtaacagtgggggcggcggttgtggtggaggtggaagtagcggtggctgtggcacggctggagggggaggtggcggggctggagggggaggcggcggcggcggcgggaccctggtggtccccatcccggtaccgactcttttcggtcagccgttccccaacgggccgccgtggaacccggggagcctgcagcctcagcacaccgtgaggagcctggaccgggccctggaagaggcgggcagctccggcatcctgagcctcagtggtcggaaactccgagacttcccgggcagcggctacgacctgacggacaccacccaagcagatctttccagaaatcgttttacagaaattccttctgatgtctggttatttgcaccccttgaaacattaaatttatatcataattgcatcaaaaccattcctgaagccattaaaaatctgcagatgttaacataccttaacattagccgaaatcttttatcaacattgccaaaatacctatttgatcttccccttaaagttttggtcgtcagtaataataaactggtatccattccagaagaaattgggaagttaaaagatttaatggaattggatattagctgcaatgagattcaagtccttccccaacaaatgggaaaattacattcacttagagagctaaatataagaagaaataatcttcatgttttgccagatgaattaggagaccttcccttagtcaagctggatttctcttgtaataaagtgaccgaaattccagtttgttacagaaagctgcatcatttacaagtaataattttggataacaatccattgcaagtaccaccagcacagatatgtttaaagggtaaggtgcacatatttaagtacttaaatattcaagcatgttgcagaatggataagaaaccagattccctggatcttccatcattgagtaaacgaatgccctcacagcctctcacagacagtatggaagatttttatccaaataaaaatcatggccctgactctggaattggaagtgataatggagagaaacgattatccacaacagaaccatcagatgatgacacagtcagccttcattctcaagtctcagaatcaaatagagagcagacatcaagaaatgacagtcacataataggaagtaagactgattctcagaaagaccaggaggtatatgattttgttgaccccaacacagaagatgtagcagttcctgaacagggaaatgcacatattggatcatttgtatcattctttaagggaaaagaaaaatgttctgaaaaatctcggaaaaatgaagaattaggagatgaaaaaagacttgagaaagaacagttactggcagaggaagaggatgatgatttgaaggaagtaactgatttgaggaaaatagctgctcagttattgcagcaagaacagaagaacaggattcttaatcattcaacttctgtgatgagaaacaagccaaaacaaactgtggaatgtgaaaagagtgtctcagcagatgaagttaattcaccattatcacccctcacctggcagcccttagaaaatcagaaggatcaaatagatgaacaaccgtggccagaatctcaccctataatctggcagagtgaagaaaggaggcggagcaaacagattagaaaagaatatttcaagtataaatcaatgaggaagagttcaagtggcaatgaaaatgatgagcaagacagtgataatgctaatatgtcaacacaatctccagtatcatctgaggaatatgacagaactgatggtttttcacacagtccctttggcttgaagcctagatcagcttttagccgctcatctcgccaagaatatggggcagcagatccaggatttacaatgagaagaaagatggaacatttacgggaagagcgagagcaaatacgacaacttcgcaacaatcttgaatccaggttaaaagtaattttgcctgatgacattggagctgcactgatggatggggttgttctttgccatttagccaatcatataaggccacgttctgttgctagtattcatgtaccatcaccagcagtgcccaaactgagcatggcaaaatgtcgaagaaatgtagaaaattttcttgatgcttgtaaaaagttgggtgtctcacaggaaagactttgtttgcctcatcatattttggaagaacgaggacttgtgaaagttggtgtcacagttcaggcgctccttgaattaccaacaaccaaggcatctcagctttctgtggcttaatataacattttaaaattctaagtgtatagtttcatttatttgaagtgatttcaaatatttcaaattcatgaataagaatattccgtcaaaaatagtttgccttaggtcacgccttaggattttaaaaaaattacattgaaacatcaaacttaaacattgaattgcccgaacttctttgggggaaaactggattaacttaataagagtatttgataaactcaaattctctttttactaagtcagttgataatcttgattatttttcagaaagcagactgatactaaatttaaaatgtagtttcaatttaataatcacattaggtttaatttttttacatcatagcatattagtaaacatctggataaaggtaattttttttagcaatttagagcaattctatatttgagttatttaatacacttctaattctagtttatacacaatttcttcaatctttggtcttagttttctagaaaaaaggagtagaaaaaacaattctggctttatattaaattcttttagtattataggttggtgccaaaatattttcagttgtactgtagattgtttacatgtgaagtgcctgtgtaattgatgactcttacatagtcttaagcatttttgcaattttttaaatgtattaatagagtcaatggaactttaaaatattttagtagattttgtaaagtcagtaatatgtgaggatttaaatgagcctcacattgtgacatttgtggttttttagttagtccattgcagtttcccttaaattggttatttcatgttgtcaaaaataccaatgttaatatgattaatttatgctatttaattttgtgaaacttaatcatcttttaaaatgtattatttgaagagtattttatttctgtattgaaaatgttacacaaagcagtaaagtttttgagaactagtgaagtactaattatcaaggacattttgataaaactgccaaagtttgggtttatatcttccctttgagcagcattctatcagtgctgcctttagctatactcagagagcagcagttgaggaataggtttttactcaaaatctggccatttgtgaatcctgtaaaccttgtgatcttcaattactttgatgttaaattaaacacagactcttctataaatattttcatgagatactgtgttacacaaagtccttgttttaacttaggtatgggtaaatttacattggtggtattgcaggaatttttcaaaaacattactgtaatgaataactgagtttcctatagaagaacctgaataattacttttgtagtaaccaagcaagcatcatatcttaagtatgtgatcatttgcacttgttacctcttaatatggatgcaacttattaaaaatgttggcctgggtatttcaaagggtatatataaaaggtaaaaaactagtgtgccaaatggtataggaacaactgtactttttttgatcagttggcatgaagccatagaattaaattttggctttagaatacagatgtgttcattacattccccaagggtcaaattggagcttttaaagaattaaagcttctatgagtatatggtttaagaattaaattattagtaatttattattttaaatatttgacctcattagttgttaattttttagttggataaaaaaaaaactcgctgacataatctccctagtgaaaacttgggtaatatatgtaagaaatggcaaataaataccttagttaatgactttttatgtagaaatttgacagcattacaaattaagtgaccattaaaaacacagcaatcattcatactgctttcataggtgttatgatagtctctgattaatcaatctagtatgaattattttacaagtgttgtcctgtttcatatctttgaagtagtagtgaaattgtaggccattttcttataacatttcagttacttttcagttaattattcctttaaaaagaaaatacagcagaacctcactgtagcattctttactgcagagcaaaattcaatttaagatgggcttctctgaggtccacatcatggcagttcatttactcttgtgccaaatggcaacaccacgtctaaagcagtttcacagcatggtcccctacaatgttataccaaggctctgatgtatttcttttagtagtttctaagtgtaaaatttattctaaatgtttttatggctattatctatttcatcagttattgaattaagaatgattttcattacttgagtgggatttgtgatttaatgacagttgaataatcaaaaatattttattaggcccccaaaatttaatagatatctatttctgttacattttattactgtatggcacaagaaagaagtgacattgggtatgttagaaatgaaataaggagtaaaaatgcattaccatttgtttaataattatctttacagaatgctagtttaatgacttttttaactgaattttttgaataaatcagaaatgtttgtattggtcacagatctatcataattgcttttctgatgcatttaaaaataaatggaacacttaaatgtatattaccgatgcaaactgtggataaagttgaaag

SEQ ID NO: 4673 - DNA, 3325 bp, Homo sapiens
gggctattctctctcccaggaacatggcggcgagtcagggaggaggcggtaacagtgggggaatctcaccctataatctggcagagtgaagaaaggaggcggagcaaacagattagaaaagaatatttcaagtataaatcaatgaggaagagttcaagtggcaatgaaaatgatgagcaagacagtgataatgctaatatgtcaacacaatctccagtatcatctgaggaatatgacagaactgatggtttttcacacagtccctttggcttgaagcctagatcagcttttagccgctcatctcgccaagaatatggggcagcagatccaggatttacaatgagaagaaagatggaacatttacgggaagagcgagagcaaatacgacaacttcgcaacaatcttgaatccaggttaaaagtaattttgcctgatgacattggagctgcactgatggatggggttgttctttgccatttagccaatcatataaggccacgttctgttgctagtattcatgtaccatcaccagcagtgcccaaactgagcatggcaaaatgtcgaagaaatgtagaaaattttcttgatgcttgtaaaaagttgggtgtctcacaggaaagactttgtttgcctcatcatattttggaagaacgaggacttgtgaaagttggtgtcacagttcaggcgctccttgaattaccaacaaccaaggcatctcagctttctgtggcttaatataacattttaaaattctaagtgtatagtttcatttatttgaagtgatttcaaatatttcaaattcatgaataagaatattccgtcaaaaatagtttgccttaggtcacgccttaggattttaaaaaaattacattgaaacatcaaacttaaacattgaattgcccgaacttctttgggggaaaactggattaacttaataagagtatttgataaactcaaattctctttttactaagtcagttgataatcttgattatttttcagaaagcagactgatactaaatttaaaatgtagtttcaatttaataatcacattaggtttaatttttttacatcatagcatattagtaaacatctggataaaggtaattttttttagcaatttagagcaattctatatttgagttatttaatacacttctaattctagtttatacacaatttcttcaatctttggtcttagttttctagaaaaaaggagtagaaaaaacaattctggctttatattaaattcttttagtattataggttggtgccaaaatattttcagttgtactgtagattgtttacatgtgaagtgcctgtgtaattgatgactcttacatagtcttaagcatttttgcaattttttaaatgtattaatagagtcaatggaactttaaaatattttagtagattttgtaaagtcagtaatatgtgaggatttaaatgagcctcacattgtgacatttgtggttttttagttagtccattgcagtttcccttaaattggttatttcatgttgtcaaaaataccaatgttaatatgattaatttatgctatttaattttgtgaaacttaatcatcttttaaaatgtattatttgaagagtattttatttctgtattgaaaatgttacacaaagcagtaaagtttttgagaactagtgaagtactaattatcaaggacattttgataaaactgccaaagtttgggtttatatcttccctttgagcagcattctatcagtgctgcctttagctatactcagagagcagcagttgaggaataggtttttactcaaaatctggccatttgtgaatcctgtaaaccttgtgatcttcaattactttgatgttaaattaaacacagactcttctataaatattttcatgagatactgtgttacacaaagtccttgttttaacttaggtatgggtaaatttacattggtggtattgcaggaatttttcaaaaacattactgtaatgaataactgagtttcctatagaagaacctgaataattacttttgtagtaaccaagcaagcatcatatcttaagtatgtgatcatttgcacttgttacctcttaatatggatgcaacttattaaaaatgttggcctgggtatttcaaagggtatatataaaaggtaaaaaactagtgtgccaaatggtataggaacaactgtactttttttgatcagttggcatgaagccatagaattaaattttggctttagaatacagatgtgttcattacattccccaagggtcaaattggagcttttaaagaattaaagcttctatgagtatatggtttaagaattaaattattagtaatttattattttaaatatttgacctcattagttgttaattttttagttggataaaaaaaaaactcgctgacataatctccctagtgaaaacttgggtaatatatgtaagaaatggcaaataaataccttagttaatgactttttatgtagaaatttgacagcattacaaattaagtgaccattaaaaacacagcaatcattcatactgctttcataggtgttatgatagtctctgattaatcaatctagtatgaattattttacaagtgttgtcctgtttcatatctttgaagtagtagtgaaattgtaggccattttcttataacatttcagttacttttcagttaattattcctttaaaaagaaaatacagcagaacctcactgtagcattctttactgcagagcaaaattcaatttaagatgggcttctctgaggtccacatcatggcagttcatttactcttgtgccaaatggcaacaccacgtctaaagcagtttcacagcatggtcccctacaatgttataccaaggctctgatgtatttcttttagtagtttctaagtgtaaaatttattctaaatgtttttatggctattatctatttcatcagttattgaattaagaatgattttcattacttgagtgggatttgtgatttaatgacagttgaataatcaaaaatattttattaggcccccaaaatttaatagatatctatttctgttacattttattactgtatggcacaagaaagaagtgacattgggtatgttagaaatgaaataaggagtaaaaatgcattaccatttgtttaataattatctttacagaatgctagtttaatgacttttttaactgaattttttgaataaatcagaaatgtttgtattggtcacagatctatcataattgcttttctgatgcatttaaaaataaatggaacacttaaatgtatattaccgatgcaaactgtggataaagttg

SEQ ID NO: 4674 - DNA, 4364 bp, Homo sapiens
ggggctattctctctcccaggaacatggcggcgagtcagggaggaggcggtaacagtgggggcggcggttgtggtggaggtggaagtagcggtggctgtggcacggctggagggggaggtggcggggctggagggggaggcggcggcggcggcgggaccctggtggtccccatcccggtaccgactcttttcggtcagccgttccccaacgggccgccgtggaacccggggagcctgcagcctcagcacaccgtgaggagcctggaccgggccctggaagaggcgggcagctccggcatcctgagcctcagtggtcggaaactccgagacttcccgggcagcggctacgacctgacggacaccacccaagcagatctttccagaaatcgttttacagaaattccttctgatgtctggttatttgcaccccttgaaacattaaatttatatcataattgcatcaaaaccattcctgaagccattaaaaatctgcagatgttaacataccttaacattagccgaaatcttttatcaacattgccaaaatacctatttgatcttccccttaaagttttggtcgtcagtaataataaactggtatccattccagaagaaattgggaagttaaaagatttaatggaattggatattagctgcaatgagattcaagtccttccccaacaaatgggaaaattacattcacttagagagctaaatataagaagaaataatcttcatgttttgccagatgaattaggagaccttcccttagtcaagctggatttctcttgtaataaagtgaccgaaattccagtttgttacagaaagctgcatcatttacaagtaataattttggataacaatccattgcaagtaccaccagcacagatatgtttaaagggtaaggtgcacatatttaagtacttaaatattcaagcatgttgcagaatggataagaaaccagattccctggatcttccatcattgagtaaacgaatgccctcacagcctctcacagacagtatggaagatttttatccaaataaaaatcatggccctgactctggaattggaagtgataatggagagaaacgattatccacaacagaaccatcagatgatgacacagtcagccttcattctcaagtctcagaatcaaatagagagcagacatcaagaaatgacagtcacataataggaagtaagactgattctcagaaagaccaggaggtatatgattttgttgaccccaacacagaagatgtagcagttcctgaacagggaaatgcacatattggatcatttgtatcattctttaagggaaaagaaaaatgttctgaaaaatctcggaaaaatgaagaattaggagatgaaaaaagacttgagaaagaacagttactggcagaggaagaggatgatgatttgaaggaagtaactgatttgaggaaaatagctgctcagttattgcagcaagaacagaagaacaggattcttaatcattcaacttctgtgatgagaaacaagccaaaacaaactgtggaatgtgaaaagagtgtctcagcagatgaagttaattcaccattatcacccctcacctggcagcccttagaaaatcagaaggatcaaatagatgaacaaccgtggccagaatctcaccctataatctggcagagtgaagaaaggaggcggagcaaacagattagaaaagaatatttcaagtataaatcaatgaggaagagttcaagtggcaatgaaaatgatgaggaatatgacagaactgatggtttttcacacagtccctttggcttgaagcctagatcagcttttagccgctcatctcgccaagaatatggggcagcagatccaggatttacaatgagaagaaagatggaacatttacgggaagagcgagagcaaatacgacaacttcgcaacaatcttgaatccaggttaaaagtaattttgcctgatgacattggagctgcactgatggatggggttgttctttgccatttagccaatcatataaggccacgttctgttgctagtattcatgtaccatcaccagcagtgcccaaactgagcatggcaaaatgtcgaagaaatgtagaaaattttcttgatgcttgtaaaaagttgggtgtctcacaggaaagactttgtttgcctcatcatattttggaagaacgaggacttgtgaaagttggtgtcacagttcaggcgctccttgaattaccaacaaccaaggcatctcagctttctgtggcttaatataacattttaaaattctaagtgtatagtttcatttatttgaagtgatttcaaatatttcaaattcatgaataagaatattccgtcaaaaatagtttgccttaggtcacgccttaggattttaaaaaaattacattgaaacatcaaacttaaacattgaattgcccgaacttctttgggggaaaactggattaacttaataagagtatttgataaactcaaattctctttttactaagtcagttgataatcttgattatttttcagaaagcagactgatactaaatttaaaatgtagtttcaatttaataatcacattaggtttaatttttttacatcatagcatattagtaaacatctggataaaggtaattttttttagcaatttagagcaattctatatttgagttatttaatacacttctaattctagtttatacacaatttcttcaatctttggtcttagttttctagaaaaaaggagtagaaaaaacaattctggctttatattaaattcttttagtattataggttggtgccaaaatattttcagttgtactgtagattgtttacatgtgaagtgcctgtgtaattgatgactcttacatagtcttaagcatttttgcaattttttaaatgtattaatagagtcaatggaactttaaaatattttagtagattttgtaaagtcagtaatatgtgaggatttaaatgagcctcacattgtgacatttgtggttttttagttagtccattgcagtttcccttaaattggttatttcatgttgtcaaaaataccaatgttaatatgattaatttatgctatttaattttgtgaaacttaatcatcttttaaaatgtattatttgaagagtattttatttctgtattgaaaatgttacacaaagcagtaaagtttttgagaactagtgaagtactaattatcaaggacattttgataaaactgccaaagtttgggtttatatcttccctttgagcagcattctatcagtgctgcctttagctatactcagagagcagcagttgaggaataggtttttactcaaaatctggccatttgtgaatcctgtaaaccttgtgatcttcaattactttgatgttaaattaaacacagactcttctataaatattttcatgagatactgtgttacacaaagtccttgttttaacttaggtatgggtaaatttacattggtggtattgcaggaatttttcaaaaacattactgtaatgaataactgagtttcctatagaagaacctgaataattacttttgtagtaaccaagcaagcatcatatcttaagtatgtgatcatttgcacttgttacctcttaatatggatgcaacttattaaaaatgttggcctgggtatttcaaagggtatatataaaaggtaaaaaactagtgtgccaaatggtataggaacaactgtactttttttgatcagttggcatgaagccatagaattaaattttggctttagaatacagatgtgttcattacattccccaagggtcaaattggagcttttaaagaattaaagcttctatgagtatatggtttaagaattaaattattagtaatttattattttaaatatttgacctcattagttgttaattttttagttggataaaaaaaaaactcgctgacataatctccctagtgaaaacttgggtaatatatgtaagaaatggcaaataaataccttagttaatgactttttatgtagaaatttgacagcattacaaattaagtgaccattaaaaacacagcaatcattcatactgctttcataggtgttatgatagtctctgattaatcaatctagtatgaattattttacaagtgttgtcctgtttcatatctttgaagtagtagtgaaattgtaggccattttcttataacatttcagttacttttcagttaattattcctttaaaaagaaaatacagcagaacctcactgtagcattctttactgcagagcaaaattcaatttaagatgggcttctctgaggtccacatcatggcagttcatttactcttgtgccaaatggcaacaccacgtc

SEQ ID NO: 4675 - DNA, 4364 bp, Homo sapiens; identical to SEQ ID NO: 4674

SEQ ID NO: 4676 - DNA, 2073 bp, Homo sapiens
ggagggcctcggagcaagacaatcccaccaagatggactcgggttgattaacgtgagtgaacctctgaggaccagaatccagactagtaattctccatcccggctgctcgttagatgcccggaccgacccccccagaccaattcaatcagaacattcggaggggcttgtaaaatctcccggggagattccggtacgaaagccaaagactcagacgcccgttctccacccgcctgcagcggccagcgcgggtccctcttagggaattgaatgcaggccccaggcctcctcctcgagtatcccagtgtgaccgatggccagctcacaaacgcgcagtgggtgcggccgcgccagggcgcagcggagcagagggcccggccgctttcggcctgggaaagaggagccacggcccggagaggcgtcagtgctgggctgcgcctgcggaggtcctcgcaattgctggactcaaccgcgcgcgccccctaccggtcctgcgaaggagccgcagccgccgcgggaggccacagctaacaagacttccaggagagctatctaatatgactcaacttaaagaacttgatatctcaaataatgcaatcagagagattccaagaaatataggagaattgagaaatttggttagtttacatgcatacaataatcaaataagttatcttccaccatctttgctatctttaaatgatctgcagcaactaaacctgagtggaaataatctgacagctctacctagtgctatctacaatattttttcactgaaggagataaattttgatgacaaccctttgctgagacctccagtggaaatctgtaaaggaaaacagttgtatactattgcacgctatctacagagggcagatgaaagagatggtctgcagcttcactcttgaagccagcaagaccaggaacccaccgggagaaaggaacaactccagacgcgccgccttaagagctgtaacactcactgcgaaggtctgcagcttcactcctgagccagcgagaccacgatcccaccagaaggaagaaactccgaacacatccgaacatcagaaggaacaaactccagaggcgccatcttaagagctgtaacactgaccgtgagggtcggcttcatacttgaagtcagtgagacgaagaacccaccaattccggacacaatttgacttaagccaggccattaacagtttcttttggatctttttgcagagctactatggaagatgcactctttctgcgggtaggttatgagtcttttagtcttggtatatcatgcacagtgtgtagtagtctgccgagagctggatgccaagagagagacagaaccttgtttatgttgtctgatcctcaatccccatacttctgcactttttacttttcacccacttaaggagtgtgacctgggtttccataactttgaatggaaagagacctaatacaagtggttaagaatattgtggagcccgggcagggtggctcatgcctgtaatcccagcactttgggaggctgagacgggcagatcacgaggtcaggagatcgagaccatcctggctaacacagtgaaaccctgtctctactaaaaatacaaaaaaatagctgggcatggtggcgggcgcctgtagttccagctactcgggaggctgaggcaggagaatggcgtgaactcaggaggcagagcttgcagtgagctaaggtggcaccactgcactccatcctgggcaacagagcgagactctgtctcaaaaaaaaaaaaatattgtggacatagtgcagtttttgttaccttaaaaaataattttctatgtgagaccatattaaataaatttattttgcaggttaaaatttaaagtgtatattttgttgccattttggaagtgcaacataacattggtttaacaactatacagcctgtgtctctaatccttccctattttaaaacttcttgcagtagggatgagaacctgtgggtttatattggcttaatgatggttgttgttaatgttttccactggaggcaaggtacttccatagaacattaaagtgtgaaggaccttggaaa

SEQ ID NO: 4677 - DNA, 2661 bp, Homo sapiens
attcaaaggaaaaaacatgaaaattaaaatcaagttacaattttgtattggcataaaacatatcagcaaataagatgtctgaaaaggagggtatgtcagaagtgctagaggatactattagtcaatttaggaaagaatctagatcacagtcaatgaaggagcctggctttattaaagaaacatcaaatttgataaacgaagcttctgattacctggaagggaaatcttctaaccagatttatgaaacacatcctagacagaatacattagagtcaacatcttcctctggaaggaagtctaagagaaatgaagaacaaaagaaaaatcttcaattttctgaaacaagcactagaacaggaacttcacagagtttatcatcactaactgggaggactgcagaatatcaggctttggttaacttcctatctcatgaaacagtaggagaagttagtccacaagtctctgaagaaaatcagaaacaacttggcctaggggcagataactttacagttaaccttgaggccaagggtttacaggaatttcctaaggacattttaaaaatcaaatatgtaaaatatctatatttagacaagaatcaaatcaaaacatttcaaggggcagactcaggtgatctgttaggacttgaaattctatccctgcaagaaaatggattatcatcacttccatctgaaattcagttacttcataatttaaggatattaaatgtcagtcataaccacatatcacatatacctaaagaaatatctcagcttgggaatatcagacaactctttttttataacaattacattgaaaattttccttctgacttagaatgtcttggaaacttggaaattttaagtttgggtaaaaataagttaagacatataccagatactctgcctagtttaaaaaccttgagggttctcaatttggaatataatcagttaacaacatttcctaaagctctctgcttccttccaaagttaatttcactagaccttactggaaacctaataagcagtttgccaaaagaaattagagagcttaaaaatttagaaacacttttaatggatcacaataagcttacctttctggctgtagaaatttttcagttactcaaaataaaagaactccaactggccgacaataaattggaagttatttcacacaaaattgagaatttcagggaacttaggattcttatacttgataaaaatttattgaaaaatataccagagaaaatatcttgctgtgcaatgttggaatgccttagtcttagtgataataaattaacagaactccctaagtacatccataagcttaacaatttaagaaaactccatgtaaacagaaataatatggtaaaaataactgactgtatctcacatcttaataacatatgcagtctagaattttcaggaaacataatcacagatgttcccattgaaataaaaaactgccaaaaaataattaaaattgaattgagttataacaaaataatgtattttccattgggactgtgtgctttagattctctttattatttgagtgttaatggaaattatatttcagaaatacctgtggatatatctttcagtaaacaactgcttcatttagaattgagtgaaaacaaactcctcatattttctgagcacttttgttctcttattaatcttaaatacctggatcttggtaaaaaccaaataaagaaaattccagcatcaatttctaatatgatatcactccacgtacttattttatgctgtaataaatttgaaactttccctagagaattgtgtactttagaaaatttgcaagtacttgatctttcggaaaaccaattacagaaaatctcttcagacatctgtaatttaaaaggaatccagaaattaaacttctcaagcaatcaatttatacattttcctattgaactgtgccaacttcaatcactggaacagctgaatataagtcagataaaagggagaaagctaacaagacttccaggagagctatctaatatgactcaacttaaagaacttgatatctcaaataatgcaatcagagagattccaagaaatataggagaattgagaaatttggttagtttacatgcatacaataatcaaataagttatcttccaccatctttgctatctttaaatgatctgcagcaactaaacctgagtggaaataatctgacagctctacctagtgctatctacaatattttttcactgaaggagataaattttgatgacaaccctttgctgagacctccagtggaaatctgtaaaggaaaacagttgtatactattgcacgctatctacagagggcagatgaaagagatgagaaaattttagagaagatattcaagatagttgccaacaacatcactgaaaccaattttgaatttttatgtcaaaaactaaacctggcaaactcagaaactgatatgcctacaaagagcactgtttcattaagtgagagagcccaccaagcacttgttatatggaaaacacaaagtaacaagttatcactaactgctgctgctttaagagatcaactaattcgagcactaactatgataggagcatatgaaattatggacaaaataacagctttaaatctttttacgcgtgcaattaaattctaaccag

SEQ ID NO: 4678 - DNA, 407 bp, Homo sapiens
cggcccggagaggcgtcagtgctgggctgcgcctgcggaggtcctcgcaattgctggactcaaccgcgcgcgccccctaccggtcctgcgaaggagccgcagccgccgcgggaggccacaggtgaagcgaagggtgtgtcttacttcagcagccctattcaaaggaaaaaacatgaaaattaaaatcaagttacaattttgtattggcataaaacatatcagcaaataagatgtctgaaaaggagggtatgtcagaagtgctagaggatactattagtcaatttaggaaagaatctagatcacagtcaatgaaggagcctggctttattaaagaaacatcaaatttgataaacgaagcttctgattacctggaagggaaatcttctaaccagatttatgaaacacat

SEQ ID NO: 4679 - DNA, 2375 bp, Homo sapiens
attcaaaggaaaaaacatgaaaattaaaatcaagttacaattttgtattggcataaaacatatcagcaaataagatgtctgaaaaggagggtatgtcagaagtgctagaggatactattagtcaatttaggaaagaatctagatcacagtcaatgaaggagcctggctttattaaagaaacatcaaatttgataaacgaagcttctgattacctggaagggaaatcttctaaccagatttatgaaacacatcctagacagaatacattagagtcaacatcttcctctggaaggaagtctaagagaaatgaagaacaaaagaaaaatcttcaattttctgaaacaagcactagaacaggaacttcacagagtttatcatcactaactgggaggactgcagaatatcaggctttggttaacttcctatctcatgaaacagtaggagaagttagtccacaagtctctgaagaaaatcagaaacaacttggcctaggggcagataactttacagttaaccttgaggccaagggtttacaggaatttcctaaggacattttaaaaatcaaatatgtaaaatatctatatttagacaagaatcaaatcaaaacatttcaaggggcagactcaggtgatctgttaggacttgaaattctatccctgcaagaaaatggattatcatcacttccatctgaaattcagttacttcataatttaaggatattaaatgtcagtcataaccacatatcacatatacctaaagaaatatctcagcttgggaatatcagacaactctttttttataacaattacattgaaaattttccttctgacttagaatgtcttggaaacttggaaattttaagtttgggtaaaaataagttaagacatataccagatactctgcctagtttaaaaaccttgagggttctcaatttggaatataatcagttaacaacatttcctaaagctctctgcttccttccaaagttaatttcactagaccttactggaaacctaataagcagtttgccaaaagaaattagagagcttaaaaatttagaaacacttttaatggatcacaataagcttacctttctggctgtagaaatttttcagttactcaaaataaaagaactccaactggccgacaataaattggaagttatttcacacaaaattgagaatttcagggaacttaggattcttatacttgataaaaatttattgaaaaatataccagagaaaatatcttgctgtgcaatgttggaatgccttagtcttagtgataataaattaacagaactccctaagtacatccataagcttaacaatttaagaaaactccatgtaaacagaaataatatggtaaaaataactgactgtatctcacatcttaataacatatgcagtctagaattttcaggaaacataatcacagatgttcccattgaaataaaaaactgccaaaaaataattaaaattgaattgagttataacaaaataatgtattttccattgggactgtgtgctttagattctctttattatttgagtgttaatggaaattatatttcagaaatacctgtggatatatctttcagtaaacaactgcttcatttagaattgagtgaaaacaaactcctcatattttctgagcacttttgttctcttattaatcttaaatacctggatcttggtaaaaaccaaataaagaaaattccagcatcaatttctaatatgatatcactccacgtacttattttatgctgtaataaatttgaaactttccctagagaattgtgtactttagaaaatttgcaagtacttgatctttcggaaaaccaattacagaaaatctcttcagacatctgtaatttaaaaggaatccagaaattaaacttctcaagcaatcaatttatacattttcctattgaactgtgccaacttcaatcactggaacagctgaatataagtcagataaaagggagaaagctaacaagacttccaggagagctatctaatatgactcaacttaaagaacttgatatctcaaataatgcaatcagagagattccaagaaatataggagaattgagaaatttggttagtttacatgcatacaataatcaaataagttatcttccaccatctttgctatctttaaatgatctgcagcaactaaacctgagtggaaataatctgacagctctacctagtgctatctacaatattttttcactgaaggagataaattttgatgacaaccctttgctgagacctccagtggaaatctgtaaaggaaaacagttgtatactattgcacgctatctacagagggcagatgaaagagatggtagactcaaaatccacacataa

SEQ ID NO: 4680 - DNA, 2830 bp, Homo sapiens
gagccacggcccggagaggcgtcagtgctgggctgcgcctgcggaggtcctcgcaattgctggactcaaccgcgcgcgccccctaccggtcctgcgaaggagccgcagccgccgcgggaggccacagattcaaaggaaaaaacatgaaaattaaaatcaagttacaattttgtattggcataaaacatatcagcaaataagatgtctgaaaaggagggtatgtcagaagtgctagaggatactattagtcaatttaggaaagaatctagatcacagtcaatgaaggagcctggctttattaaagaaacatcaaatttgataaacgaagcttctgattacctggaagggaaatcttctaaccagatttatgaaacacatcctagacagaatacattagagtcaacatcttcctctggaaggaagtctaagagaaatgaagaacaaaagaaaaatcttcaattttctgaaacaagcactagaacaggaacttcacagagtttatcatcactaactgggaggactgcagaatatcaggctttggttaacttcctatctcatgaaacagtaggagaagttagtccacaagtctctgaagaaaatcagaaacaacttggcctaggggcagataactttacagttaaccttgaggccaagggtttacaggaatttcctaaggacattttaaaaatcaaatatgtaaaatatctatatttagacaagaatcaaatcaaaacatttcaaggggcagactcaggtgatctgttaggacttgaaattctatccctgcaagaaaatggattatcatcacttccatctgaaattcagttacttcataatttaaggatattaaatgtcagtcataaccacatatcacatatacctaaagaaatatctcagcttgggaatatcagacaactctttttttataacaattacattgaaaattttccttctgacttagaatgtcttggaaacttggaaattttaagtttgggtaaaaataagttaagacatataccagatactctgcctagtttaaaaaccttgagggttctcaatttggaatataatcagttaacaacatttcctaaagctctctgcttccttccaaagttaatttcactagaccttactggaaacctaataagcagtttgccaaaagaaattagagagcttaaaaatttagaaacacttttaatggatcacaataagcttacctttctggctgtagaaatttttcagttactcaaaataaaagaactccaactggccgacaataaattggaagttatttcacacaaaattgagaatttcagggaacttaggattcttatacttgataaaaatttattgaaaaatataccagagaaaatatcttgctgtgcaatgttggaatgccttagtcttagtgataataaattaacagaactccctaagtacatccataagcttaacaatttaagaaaactccatgtaaacagaaataatatggtaaaaataactgactgtatctcacatcttaataacatatgcagtctagaattttcaggaaacataatcacagatgttcccattgaaataaaaaactgccaaaaaataattaaaattgaattgagttataacaaaataatgtattttccattgggactgtgtgctttagattctctttattatttgagtgttaatggaaattatatttcagaaatacctgtggatatatctttcagtaaacaactgcttcatttagaattgagtgaaaacaaactcctcatattttctgagcacttttgttctcttattaatcttaaatacctggatcttggtaaaaaccaaataaagaaaattccagcatcaatttctaatatgatatcactccacgtacttattttatgctgtaataaatttgaaactttccctagagaattgtgtactttagaaaatttgcaagtacttgatctttcggaaaaccaattacagaaaatctcttcagacatctgtaatttaaaaggaatccagaaattaaacttctcaagcaatcaatttatacattttcctattgaactgtgccaacttcaatcactggaacagctgaatataagtcagataaaagggagaaagctaacaagacttccaggagagctatctaatatgactcaacttaaagaacttgatatctcaaataatgcaatcagagagattccaagaaatataggagaattgagaaatttggttagtttacatgcatacaataatcaaataagttatcttccaccatctttgctatctttaaatgatctgcagcaactaaacctgagtggaaataatctgacagctctacctagtgctatctacaatattttttcactgaaggagataaattttgatgacaaccctttgctgagacctccagtggaaatctgtaaaggaaaacagttgtatactattgcacgctatctacagagggcagatgaaagagatgagaaaattttagagaagatattcaagatagttgccaacaacatcactgaaaccaattttgaatttttatgtcaaaaactaaacctggcaaactcagaaactgatatgcctacaaagagcactgtttcattaagtgagagagcccaccaagcacttgttatatggaaaacacaaagtaacaagttatcactaactgctgctgctttaagagatcaactaattcgagcactaactatgataggagcatatgaaattatggacaaaataacagctttaaatctttttacgcgtgcaattaaattctaaccagtggatcaataataaaaactgaaaacttttgatgcacttataa

SEQ ID NO: 4681 - DNA, 3163 bp, Homo sapiens
acaggccccagaatcctccgcggttccccttgcctggggtcagtctcctaggcaaccccgctaaacaagatggcgacctccgagagggctctcctgaggaccagagctgcctctctcctgagaggcttgggcagatcccgaactggagcccgatcgttacagtttcgcgcagaaaaagagcgtcagccttgctggtcttttcccatggggcagaagacgaaaggcagctctaacatagcctcctcctacctgctccagcagctcatgcaccgctatcaggagctggactcggacggagatgaggaccagggcgagggcgaggcgggatccgaggagtcctcagagtccgaaatgctgaatttggaggaggaatttgatggggtcctgagagaggaggctgtggccaaagcactccatcacttggggcgctcaggctctgggactgagcaagtctacctcaatctaactttatcaggttgtaatttaattgatgttagcattctctgtggatatgttcatctacagaagttggatctttcagcgaataaaattgaagatttatcttgtgtgagttgtatgccttatctcctagaacttaatgcttctcaaaataatttgactacgttcttcaatttcaagccacccaaaaacctcaagaaggcggatttttcccacaaccaaatttctgaaatttgtgatttgtcagcgtatcatgctctcactaaactaattttggatggcaatgagatagaagaaatcagtggactagagatgtgcaacaacctaattcaccttagtttggccaacaataagatcacgacaattaatggcttaaacaagttaccaatcaaaatactttgtctgagcaataaccagattgagatgatcacaggtttggaggatctgaaagccctgcagaacctggatctgtcccacaatcagataagcagcctccaaggcttagagaatcatgacctcctggaagtgatcaacctggaggataataagattgctgagctgagagaaatagaatacattaaaaatttacccatccttcgagttctcaatcttctagaaaatccaattcaggaaaagtctgaatattggttcttcgtaatttttatgcttctgcgattaacagaattagatcagaagaagattaaagtggaagaaaaggtttcagcagtgaataaatatgatcctccccctgaagtggttgcagctcaagaccacctgacccatgttgtcaacagcgtgatgcagccgcagaggatctttgacagcactcttcccagcctggatgccccttatcccatgctgatactagctggtcctgaagcttgtgggaaacgagagcttgcccatcgcctctgcagacagtttagcacttacttcagatatggggcctgtcataccacaagaccaccttactttggagaaggggatcgagttgattatcattttatctctcaagacgtttttgatgaaatggtgaacatggggaaattcattctaacatttagttatggtaatcacaagtatggattaaatagggacaccgtagaaggtatcgcaagagatggtttggcaagctgtattcatatggaaatagaaggtgtaagaagtttgaaatattcctattttgagcctcgttatatcctggtggtgcccatgaacaaggaaaaatatgagggatatttgcggagaaaaggattattcagtcgtgcagaaattgaatttgctgtctccagagtggacctttatattaaaattaatcagaattttccgggatattttgatgaggtaatcaatgcagatgatctggatgttgcctaccaaaaactgagtcagctcattagagaataccttggattgactgaggaacctgccaagagtttggctacaactgcagatgttaagacatcccacctgaaacctgaagcgcatcctacaaagtatatttcttcgaatatgggtgatttcctgcattctacagacagaaactacctcattaaattttgggccaaactttcagccaaaaaaacaccagcggaaagagattctatacacagacagcacgaggcagcccggcaagctctaatgggaaggatacgccctgatcacacactcctatttcaaaggggtccagtaccagcacctctcaccagtggtctacactattatacaactttagaagaactctggaaaagttttgatctttgtgaagactattttaaacctccatttggaccatatcctgaaaagagtgggaaggattccttggtttccatgaaatgttcattgtttcggttctgtccgtggtcaaaagaattgcctttccagcctccggaggggagcatttcttcacacctaggatcaggagccagtgacagtgagaccgaagagacccggaaagcactacctatacaatcattttcacatgaaaaagagtctcaccaacacagacaacactcggtcccagtcatcagtcgcccaggttccaacgtcaaacccaccctccctccaatccctcagggccgcaggtagactagcacttgatgtctgatcctaacatggaaaacctgctctgctgatgtcgaattccttgccttacctggccatgggtccagctgtttctcactcaacccattacccacggaagaatgttctacctgccttaattctatcagccagtttctcttgtgattctttggctggtgtcttttagttttttaattaaaaaattgtttcttaaatgatttttaaagatgtgagtttttttaatgtgagttattcttagcttttaaaaatgtcatttcatttttttttctatagctataaataattttttccacctgctccctgctcggaaatatcagatggaaaaatctcccaagatctctgcaccgtgatatgcagagtggctttctgatatatccaactgggattgtgctcttaaaatttcaatatgtccatttacaacattcctgtatgctctagaggattgatttattttgctctgattatgaaaggattgcagagttccatttaacttgtcgccaacatgatatcgactgcatctctcaaaaggaattaatgtaattttggggggttcttgacttactttagcaacacgaaagaataaagagcaacagttgattct

SEQ ID NO: 4682 - DNA, 5367 bp, Homo sapiens
tgtgattggctgttgccatggatacgctttgtgtagcggctatgggcgctgtcttacaacaaagccaaggaatctcgctgctgagggttctgtgctttattatgaagaataatggacgatgatgatgcaaagctcaaagcagaaatagaagctgaattggataaactcagcatttcctccttggaaaaagaagacattgagagtgatgcaaaatcagaaacccagagtgatgatagtgatacagattcagttgaattaccagaatcagttcttcactgtattaacatcataaagaacaggagtaaagctgttgaagagctcattcttcaggacctggaagatactgatattttaagctgtagttatggagcagtttctaataatcatatgcatttaagaacaggactatcaactgaatatgaagaaagttcagagcaattaattaagatattatctgaaatagaaaaagaagaatttatgagaagtaaaaccgattgtgccactcctgattttgttcctgagcctagtcctcatgacttgcctatggatgaacatgttttaccagatgatgctgatataaattttggatactgtgaagtggaagaaaaatgtagacagtcttttgaggcttggcaagagaaacagaaggaattagaagataaagagaaacaaactctcaaagctcagagggatagagaagaaaaacaatttcaagaagaagaagaaaagcgacattgctggatgaaacaatttaaagttgaaaagaagaaattagagaacattcagaaggagtatattagaaacttgcatttacaaatggaagaagaaagaacaagatttaaagaccaacaagaaaaagaaaaaaattctttgttaaaacagcagaataatgcagctgttaaaattcaagctaaatataaagcatttgttgcctatcaaaaatatggcccaattattaaagagcaaattgaaagtaagaaaaggaaagcacaagagtggaaggaaaaggaagcaaaaatacgacaaaaggaggaagaaaatcgaaaaagattagaggaggaacaaaggataaaagaagagagaaaaaagcaaaaggaagaggaaaggaaaaggagagaaaaagaatatgaagaaaaaaagaatattgtgaaacaggaaagagagcaactaataagcaaggaaaaaataatattaagagaagatgcaagccaacagctaataataagtagtgcattaaagaagagcggatataataacaaacatttaagtcttgaagatatttcaaatgataagggtgatatagccaaaaatctagtggatgaaaattcaaagaagcaggaagatgttctcctttggctagttgaggaatcaaatatgaaagaaaatgtagatagacagactatattaaaagaatcaatacaagtaaagttaaaagaatctatatcaagccaaacaattctggcagattttaaaatggaagaaaaaaatgaaaacctagcaaaaaaacgatgttcagaagaattggtcaagcaagaaagaaaatatgaaaatacagataacaaaactgaattgggaaactctgatctaaaaggaaatctgaaagaacagtttccattgcaagaattaaagtctgatgcacaaaaagaagaaaaaatcatgaaacatgtcataaatgagaatacaggacaaaaaacccagataatattaggacataaccaagaaatcagtgaggtgaaaaccaatgaagagcagaaaataatcaaagataatcagcagaaaaagatacaaaaagtagaaaaagaagagatacaagaacagaatggattattatataaagataaggatactttagttatttcagtgaaacaaagatcactctcactaacatcagaaaattccaaagatgtaagagaaaacgtaatattacaagaaaaagaaatttattcaaaatccaaagaaattgaggagaacccaaaagacaatgcttggaatagtggcattgtgatttttaacacaactgataccatgataaatatagaaggcaaaagaaatgaccaagattatgtgttaggtagacatgctccttgtgagggcttgagtaactataatgcagaaagctccatggtatctaaagaagtcaactctcttaaatctgagattagaaatatttcagaaaaatgccatgaaaatgcacctgaacctgatagcatgacctgctgtgtatcagagtcaacccttctatattctattgaagaaaggagactagcctggataaaatcatttaaaccttggcttgaaattttcaagcaaaatcaacaaaagaaaattgttagaagaaagagacctgtgaaatgcccagccaacatgacacccgctttggataaactggaaattcttcgatgtggcccttgggatactttacagcaggttacaacagttacatttcaagatttgccaggctgtgttctctccacactggcagagtgtacaaatcttcagtttctatcccttcgacgctgtggattaacttctttgcacagcctgagtaattgtaaaaaacttaagtacattgatgcacaggaaaaccatattgaggctattgagtgtgaaaatttggaaaatctctgtgttgttcttcttaataaaaatcaactgacttctcttcatggtttggatggctgtactaatattcagtgtcttgaactttcatataataaaattactcgaattggatattccttctttctggaagaaaaacttgttgacaatgcagggttctgccatcacttgggcacctccacttcttacttatccctggcacaagtctggattccaactggattatgttggtcctggatacctattacctcacttacaaaaaattcagattgtaatttccttatctcccacttatactggaattgtggtttagaatctttgaaaaatcttcaacaactaattttggaccacaatcagttaattaatacaaaaggtctttgtgatacacctaccattgtatacctagattgctcccataatcatcttactgatgtagagggcgttgaaaattgtggattgctccaaatattgaagttacagggaaattatctgagtgagcttccatccttggagaatcttgttttactaagagaattgcacttggatgataacagcatttcaactgtggaagcattttcttcatactggctgcctttactacaaaatattactatctctcaaaacagcttgactaaaatcgtaccactttttcattttgtttcattggaaaagctagatgtcagccacaattgtctttctgatcttaaaagtgccataaaatggtttgatgcatgctattctctccatgaattgtctcttactggaaacccacttcttcaagaaacaaactggagggattctctacttaaagtgttgcctgctctgagaatcctcaatggcaatatactaaactctaattcagaaagccgcactgaagaacacaatcaactgggatcagcaggtttcctggcactttgtcagtctcagattcgagaattcaacttgctaattgaaaattatataactggaaaaggagatgtatttaccttggatactgcagaaaatctctgtcattattttaagaaattgatgatacttagtactgaataccgacatgcacacgaacgaggggatgtaactatcaccaagaaagatgaatcagaagcccagaaaaatcatttggcccctacaaacagtgacagcactctgcaaaatggagtcttctactcttgtgcacgtgaaggtgagccagactcaccagatattcctgagaaatggatggactctgtctccagccactccccattaagcaaatccgccacatgtgaaaatatggaaggaagacatcaggaaatattagtatgtcagaagagagaagacagcaaggcaagcagtattcccaccataagaatcccatttaaggaagtagtaatgacaaattctttgctgaggaatcaccaaaatattgagcctagtgaaaaaattatggcagctgtggtaatccagtcatactggcgtggttacctcatgcgcagacagactcatttctccacaaggctacatactgctgcaacagaaggcctgccaaattcttccatcaagaatcagactattttaaagaaaggaaaaagagaaaatattgtgaatatccgaaaacagagggagaaggctgctattcttattcaggcagtttggaagggctttattttgcgaaagaaactgacaacagctctagaggctattaagaatgaagaatccgatgaagaatacagagaaatagatttagaggattttatatttgatgaagctgccttagaagaagaatggctagcattagattccacccgcttcccttcacaaacactgcttctttcaaaccagctgcattggccaaagattcctggaaacttaaaatgggatgatacttcatttaatttaccaagtaatccagctcaagcatggttatgtaatgacaaagaaaatttgtcttcttcagaacacacacaatttaatagcagatcagaaaataaaacttcttcctggacacctgaatcaaagaccagtagaaagagtttgctaaaatctgaaaaagaaaaaaaaatttcagaagaatggggctttaaggatatttctactgctcagcaaatgttgaagagggcacagaaaatgaaatcgaagaaactaaagaaaaaaatagattccactgtgcgtctagccttattcaaaaacaatgaaaataaagtgtctcttccaaaatcaccaaagatggtacagcccagaagagatggttactttgaaggtatagaagaagaccctatccacaaagataccactgcaaatgaaaaattagaacggaatagagaatatacataccaatggcttcacacacaggttggggttcatgaaacgactagttccagaaatatgaaatgcaatcactttttgcctgagttagatccagatgtacttaatggtggaagagttcagcttgtggcaagacttgtaagcagagaagacacggatttagaccttttttccatgaccaatggaagtgctttgtctgtgaacagagaaaaaaaaaatcaggcacacagacactcagcaggatcttcaagtaagttgtggtttccttcaaaattaatttagaaatcacaaacgaattgatggaacctaatgccaacaagcattctttttcagatagggggtaggatgccagcaacctgaactgcccaaaaatgtgtatttaaattttttctttctttaaatatcctcttttgatataaacaaaattaaattatttctaaaatt

SEQ ID NO: 4683 - DNA, 555 bp, Homo sapiens
gtgtagcggctatgggcgctgtcttacaacaaagccaaggaatctcgctgctgagggaataatggacgatgatgatgcaaagctcaaagcagaaatagaagctgaattggataaactcagcatttcctccttggaaaaagaagacattgagagtgatgcaaaatcagaaacccagagtgatgatagtgatacagattcagttgaattaccagaatcagttcttcactgtattaacatcataaagaacaggagtaaagctgttgaagagctcattcttcaggacctggaagatactgatattttaagctgtagttatggagcagtttctaataatcatatgcatttaagaacaggactatcaactgaatatgaagaaagttcagagcaattaattaagatattatctgaaatagaaaaagaagaatttatgagaagtaaaaccgattgtgccactcctgattttgttcctgagcctagtcctcatgacttgcctatggatgaacatgttttaccagatgatgctgatataaattttggatactgtgaagtggaaga
